United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 10

SEQ ID NO: 46629 - DNA, 552 bp, Glycine max
  Peptide Sequence Number=SeqID_138314
atggaggccataaaagagcaaatggccacaatgatgaaggccatgatgagcatgaagaagataatggaagccaatgcggttatagttgctgctattagcgctgtcgctaaggtgaacccgacgtccccatccggcctcaagcaaatgaatcatccaacctcaaatatggtaggcaaagatttaggaagtatgggcggcccccatgatgtgcaaattcaaaatgagcatgccttcccgtcatatggcttgcctctcaactatacgccacccaatgtggcgtacactcccaataagaatacccatgaaattccccatcacaatctagccgacttcgagccttggctcggatataccactgaagggcaagcagttggtggtatacccctacaaaaccctttggagggccctcagtatcacccacaactgcacctcttgcattccacagcggttaaaagccctcatgactatggcaggaatgggaaagttggatcatctagaggaaaggctcaggggccattgaaggaggcgaagattatgcctttgctaacctag

SEQ ID NO: 46630 - DNA, 363 bp, Glycine max
  Peptide Sequence Number=SeqID_138315
atgagtgaagtagaggaggtgcaagagcagataaaggccgacatggaggccatgaaagagaaaatcgccacaatgagggaggccatgatgagcatgaagaacataatggaagccaatgcggttacagttgccgctaccagggctgttactaaggtgaacccgatgcccccatctgatctcaaccaaatgaatcatccaacctcagatatggtggacaaagatttgggaagtacggacggccccatgatgtgcaagcacgccttcccgccatatggctcgcctcccaaggaggatgtcaataactctgctcccatactcattgaaagccaacaaccccaaactgatcatgcacatgtctcttaa

SEQ ID NO: 46631 - DNA, 202 bp, Glycine max
  Peptide Sequence Number=SeqID_138316
gcttgaggaatgtgggctatggggagtgcatagccccaataggcatatagcaaagttggcactggccgtcgttttacaacgtcgtgactgggaaaaccctggccctgaatggcgaatggcgcctgatgcggtattttctccttacgcatctgtgcggtatttcacaccgcatatggtgcactctcagtacaatctgctctga

SEQ ID NO: 46632 - DNA, 690 bp, Glycine max
  Peptide Sequence Number=SeqID_138317
ggaatcttccaaatgccaaggaagaattggaattaacccgaaacagtgtgaaggaacgagttgaagaagctattaagaggactgaaaaaattgaaccagcagttgagaagtggctgaaagatgttgagaaagtcttagaagaagtgcatatgcttcaaggaagaatttcggaagtaagcaagagctatttcagaaggcaatgccaatattttcttacaaaaaaaatagaaagaaaaattcagaaaatgactcaactcaaccatgacagcaagtttgagccattttctaagattgctgaacttccaggcatgaagtactattcatccaaagattttgttcttttcaaatcaacagaatcaacttataagaagcttttggaagcattaaaggataaaagcgcttgcacaattggactagttggactaggaggctcaggaaaaactactttggcaaaagaggttggtaagaaagctgaggagttaaaactttttgagaaggttgtcatggtaacagtctctcaaactccaaatattagaagcatccaagtgcaaattgctgataagttgggtttgaaatttgaggaagaatcagaggaagctagagcacaaagactatctgagacattaatcaaacacacaacccttctaatcttggatgatatatgggaaatcctagactttgaagctatag

SEQ ID NO: 46633 - DNA, 833 bp, Glycine max
  Peptide Sequence Number=SeqID_138318
ttggccccagggcttccccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaacatcggtactttcaacatcgattttaaaaccgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46634 - DNA, 459 bp, Glycine max
  Peptide Sequence Number=SeqID_138319
atgccctcatccgccttagcatcaaatttacctaggctttctttaccattgtttaggacaaaacatttatatccaaaaacatcttcagcccaaaaatattttggaagcggagtgtcatttaagagagttctagctatttcttctaaggatctatttttcctttctactacaccgttttgttggggtgtcctaggtgcagaaaagttgtgttctatgccatgttcatcgctgtcgcaacatgccctttcgcgggtgagcgaaggcgaggctcacgggtgcgctttccaaaggaggaaagatgcgcgaagtcgccaccaacgtttatttgtgggaaacgtcggaaaaaaccaaaggaaaccggtcaaaatgaaaattctaagttcgggagttgtatttacgtttgaggaaggtattagcacctctcacgtttgtctcaaaggacaacaacctattttttag

SEQ ID NO: 46635 - DNA, 309 bp, Glycine max
  Peptide Sequence Number=SeqID_138320
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgccctttctcaacagttgcgcagcctgaatggcgaatgggacgcgccctgtag

SEQ ID NO: 46636 - DNA, 379 bp, Glycine max
  Peptide Sequence Number=SeqID_138321
ggcgcagaagacgacgttagtctctgcgtgctatcaggcttttcgtcttacagacagcaaaaagtttatacggataaccactcgggtatttccgcccgtcagcgtgactcaaaagtcactatgacaaatcttgtgagcgcgaaagatgacggcggagaagacgacattagtcaatgcgtgctatcaggcttttcatcttacagactgaaaaaagtttatacggataaccactcgggtatttccgaccgtcagcgtgaatcaaaagtcgcagaagacgaagttagtctctacgtgctatcaggcttttcgtcttacagacaacaaaaagtttatacggataaccactcaggtatttccgcccgtcagcgtgactcgaaaa

SEQ ID NO: 46637 - DNA, 357 bp, Glycine max
  Peptide Sequence Number=SeqID_138322
atggataagagcttgaaggtaggagaagataagtggaggaagagggagagaaggggaatgaggcccacttgggccttccagattcttcctccagaaggcggttgcttctggaggaagcaacctggctcgcctcagcaagttgagctcgcctgggcgagctgggaaggaaggggttcagccttcttggcacttcatattcacttgaaattactgagggaaattgtttccgtgaagaaaatccaagccgaggcgcttccgcaacgtttccgtaacgtttccgtgggtgatttcgtgaagattttcaatcgttcttcgtcattcatcgtccgttcttcattgttcttcgatcttcaaccg

SEQ ID NO: 46638 - DNA, 90 bp, Glycine max
  Peptide Sequence Number=SeqID_138323
atggaggctaagctcaaggagaccgacttccataacataccctgctacgtgcagattttagacgcggaaggccctccttctcagttgaag

SEQ ID NO: 46639 - DNA, 855 bp, Glycine max
  Peptide Sequence Number=SeqID_138324
atgtttgaagataaagagctgaacatcaagattttgaattgtctcacaagaacttgggaaccaaagattacaacaatcaaggaatccaagaatctagctacaatgacgatggaagctctcttcggtaaattgctagactatgaacatgaactgactcaacaatcttatgcagaagaaacaaaaaagaaaaggaaaggaattacactgaaagtaaatgttaactcattggggctgatgtggatagaagaagagagatggatagaggaggataaagggataatggacatagaaagagagtttcccctattagagatgctcaggcttaagatgtattcattagagagctccgagtctgggtgtatcgatgtcccgttatcaataaactcttcaagggaagaatacaaagatagttccagcagtgaggaagatgcaaagaaattcaacttgatgaaaaatggtgaaaagaaaggaaagaaggacaaaaaacaaaagaaagcctacatcgcatgggatgatagtgcatcaacaaccttcgactcttcaagtgatgaagaaattgcaaacatatgcataatggaaaaatccatgaatgatccatcaacaagtgaagaagttgaggtaaatcctaattttgaagaaattttagaagcatttaatgaaatgaataaggaagctcaaaggcttgctgtattaaacaaaaagctgaaaagcaaactgaaattgcatatcaataaactagcttcaacacaaggtgagctgaatgtactgaagcaagaaaatgaaaagattgtttcaagatgtaaagccattgcttgtgatgacacctctacttcctttaacatggatgattactag

SEQ ID NO: 46640 - DNA, 430 bp, Glycine max
  Peptide Sequence Number=SeqID_138325
gtcgactctagaggatccccgagacggtgagtccgatgacatgtgggggtaccttatggttatccgcaccttttgtcatccagagatggcgagtctgatgacatgcggggacggcgagtccgatgacatgcgaggttaccttatgattatctgcaccttttgtcatccagagacggcgagtctgatgacatgtggggatggcgagtccgatgacatgcgggggtaccttatggttatccgcatctttcgtcaaccagaggccagcaagcccgttgacacgcagagactaacgttgtcttctgcacctttgtcatctggagacggcgagtccgatgacaggcgggggttttactttcgtcatccagagacatccaagcccgacgacgcaccagattcttctctgctaggcagggacgatcgagttcaatag

SEQ ID NO: 46641 - DNA, 213 bp, Glycine max
  Peptide Sequence Number=SeqID_138326
atggaaaaaacaatgaaaatgcgatataatggtggtgatagtagtagtggaatggtgattgtggcaacgatgtgtggtggtgctgatgacggaggtggcgttggcaatggagatagtaatggtggtggtattgataacaatgataatgggtggaatagtggtaacgacaacaacaataacgatggtggtgacatattggccatttaccattaa

SEQ ID NO: 46642 - DNA, 303 bp, Glycine max
  Peptide Sequence Number=SeqID_138327
atggaagacgcacccgtgagccctcacgtcgccctcccgccaaaggattgtagaattagtcctctattacttatttacttcaaggccaaatttgacatccctgaaggtttaactgcgaagaagaaggttatgtccaccgttgggaccagatggaggcaatttaagtcctccctgacgaccagatatgtatacgctgagaatgacgatgaacaaaacaaggatccatctgctaagtatggtattgatcgaaatacatgggaagaatttgcaaagactcgacatacccctacttggaaggtttaa

SEQ ID NO: 46643 - DNA, 141 bp, Glycine max
  Peptide Sequence Number=SeqID_138328
atgtcagtcactttgcggcggaaagaaagtatgtatatagaagctagaggcaaggtttcagcgcaaaagggcaagagtaatgtcgttgctcaatctcaaaattcttccgtatcttatgtttctggtcaaaacatggcctag

SEQ ID NO: 46644 - DNA, 264 bp, Glycine max
  Peptide Sequence Number=SeqID_138329
atgaagacaacttatctaacactttgccttgcacccaggagtttcagcctggagcatgttaaatgcagacgaagctggtcgtccatgagggctttagaatatggagatagatatccattgttttgtgtaggctctgtcaaaagattaggaaaaattgtattggtaactgctcggaaccattgggctggagatgtgaaattattcatggttttgcttctgtatctgcaagagaaaaatgttatagccgagggtagagcttgttaa

SEQ ID NO: 46645 - DNA, 3420 bp, Glycine max
  Peptide Sequence Number=SeqID_138330
atgcatggatgtaactcaggatctgctctccttgtaaatgctgaggttgattctatgggaggtgttgttgatggcggagttggtattggtttgaaaacctctccacgccgagcagcaattgagaaggctcaggcagtgctcagactggagtatgatgcgcgtgaagaaagaagaagggaactagaatttcttgaaaaaggagggaatcctttggactttaagttagggaatgctgcttcagttagtgttcagtctacttcactcactgatcagcatcaggagcagtttgtgaccagtgaagcaaaaggtagttttgtattgactgcctcccctcatggtgactctgtcgacagtagtgctagaccaggggtcccttctcttagtgaaccaaatactgctgataacctcttgctttttgatggtgagaatgagttgcttgaaggcgaaaagaggtctctacatccaaataaaagtaataacattgctccttcagagcaatcttctcgaattggtgggaatcaaaatgcaaaggagactgaagattctgctattttcaggccatatgcgcggaggaataggtccaaaccaaatcatggtcctcgtggggcttcaagggatgtgaagggaataatatctgatacaaacaaacaaaaggaccacaatgttctttctgtttctaagccaaagcctacaggtttaaatggcgaggtactttctaaagatccaacatctaataatccactgggcaatgagttggttggtgcccgagcttgtcaaacagctagtggcaatgccagtgttcctgaagacaacttggatattggcatgaataaaaacttcaaagaagatcaacgaattataccttctcaagatgatattgtacaaaatccagttgtcttggcttctggggaagctaaagcagttggagaaagggacctgggaaattcaggtgatcttgagcctccaccttgtgcagctactaaacaacctggaaatgaatcttgttctggtcagccaaatggatttggaaacataaaattagacaggaaaggtgtaccgaatggagaccaaaatttcagtgctgcattaagcatgaagaattttgattcggagtcctcttgtgcacaaactagtttagctatagatgtaaataataataataatatgtgtagtaatgcaaagaatattgatgcaaataaaaatacagtggaacaaacatcagaatttgagcagaagctgtatttaactggctgtggagttgtaaaagaaaggagtaataccaatgctggtgaaagtggtgttacttctaacaatgaacatgctactggttacgaaaaccattctggtagtggtaatatggtcaaaagtgaggaaggcatccatactaatagtcttggcatgcaaaacaaggtgaaagattcttccaatattaaaggaccgcaccacaatgaaagttccgtatcaaatgctgataaagagaaaagtgttggcctgatgggtcatcctaattgtatcagggaagacaactgtgaaagacttaaagttcctatggatgtgtcaatttcaacaactcaaactgctccggttgaaaaggttgctactactgcctctgactgtcaaccatgttctacacacaacttgaagttagcagacaaggctcatgaagattctattttggaagaggctaaaattatagaggtcaagcggaagaggattgcagagttatctgttcgcacattgtcctcacagatccatagaaagtctcgctggggttttgtcctcgaggaaatgacatggttggcaaatgattttgcacaggagcgtctttggaagataactgctgccgcacaattgtctcatcaggcaacttttacttctcggttaagatttgaaaaacaaagcaaacatcttggggtgaaaattttgtctcacaacctggcaaaggcagtcatgcagttttggaattcaattgagctccttctagacaatgatgttcctgactgtaactgcattgatgattcagtcgaatctgggaacattgattcaaatgaagcttctggggacaagaggagcaattcgaagatggtgctggaaacaagcaaatacctggatggacaaaatcccagaaaacaggtggcacttaaggtgcatagttatgctttgagatttttaaaggatagtagatctcagggaatttccagtcaagcagaagcaccgacaactcccgataaaatatctgactcgggcattgttggcatgtcatgggatgatcatcttacagaagaaagccttttctatacagttcctcctactgcaatggaagcatacagaaagtctattgaatctcattttctacagtatgagaaaactggtagtagcattcaagaggaagttgaaacatctatgtatgatgctgcaacagagtttgggcttgaagagattgcatatgacgaggatgaaggagaaactagcacttattatttgcctggtgtctatgaggctagcagatcatcaaaatcatttcagaaaaaacacaaaaacaggataaagtcttacagtcataagtccagtgaaattggaactgatttgccttacgggcattattcaactggagctcagccatccgtgctatttggaaaaaggccagctagtttaaatgttgggacaattccaacgaaacgcatgcgtactgcttctaggcagagagttgccagtccttttgctgtgatctctgggacagcacaggctcaagctaagacagatgcttctagtggagacaccaattcctttcaggatgaccagagtgctttaaatgttggatcactgatccagaaaagtttggaggtggagtcagttagagattttgaaaagcaagtaccttatgactgtggagaaacatcagttaaaacaaagaaaaagaagcccaagaatctgggttcttcatatgatcaaggatggcaattggattctgttgtcctgagtgaacagagggatcattccaagaagagattggatagtcattactttgaacctaatggaagtagcggtttgtatggcccgcatagtgtgaagaagctgaagacaacaaaacaatcctttgataattttgacaatgttgctccaatagctaattctattccctcccctgctgcttcacaaatgagtaacatgtccaatccaagtaaatttattagaatcattagtggtggacgagataagggcaggaaagccaaagcacttaaggtttctgcgggacagcctggttctggaagtccttggtcactatttgaagaccaggctcttgttgtcctggtgcatgatatgggtccgaactgggagcttgttaatgatgccatcaacagtactatacaattcaaggaaaggtgctatggttgcaggacagaaggacatcttcaatga

SEQ ID NO: 46646 - DNA, 1152 bp, Glycine max
  Peptide Sequence Number=SeqID_138331
atggaacaacttttgtatctcaattttacttggaagggaagggaagcgttaggtgtggcaaagccttcagtagctagttaccttagccaggagatactagcagagcaagaagctgatacagtgcatggattacctgtgcagcctccggtgaagttcaacaatatggtggttataacactgtcaatgaaactcaaggaagagcactgttctattggttttccgaggccactcacaaaccagaacaaaaacccgttctcttatggctcaatggagctttgtcacagcttagagggcaatgccggtgcactcacaaattttgaggtccttgatttcttacgagctaaaggagcttcaaaggatccaacaaaagttattgccaaagtagcgcagtctgaatacaagcttcatgccgcacctcaacttctctcttccaactcgcatatcaataatctgcctcttctcctcaccttcaccttcgtttccccttcttcccctcgtcactcctctccttcttcctccctctcccccaagctcccttcctccttcgcctccgcctccgctgctccctttcctttcctctcctttcccttcaaacgaatgtttcttcatgtcggactcagccaacaagttgcgattgaaagttctttggagaaaggcttagttgatcgcagtgacgcttcagatgttgatgctaaagtagataacatggcgaggtgtttcagaaccaaccaaaggatactggtgagaaaaaggaataaagatgaactaggtaaaacaataggaagagaacaggaggaacctcccaagtctcaaattggtcgtgagaatgggtccaaattctctaattggccgaatgagagagaagtattgtcagcagccaaagttgccaaaaagatgaagctaaaatttactaaagaatggattgcatatcttagattgcctcttccaattgatgtttacaaagaggtaatccacaagttatgctttcgaaatttgaatatagctgaagcattatattctgaaacatggtgtgaatgtcatgtaagatgtctcaaggttgtcatgagatccaatgtaggattggaaggggggaagaaacacaaatggtggaattgtaaggttcatgtacctttttttgttttctacgaatga

SEQ ID NO: 46647 - DNA, 1448 bp, Glycine max
  Peptide Sequence Number=SeqID_138332
tggaacaattgaagcagcaactgcatcaatttgatacattagcccaggacaaaactttaggggaagatgaagttaagaccatgaagtccattcagcaggaactgtgggaggtttctcttgcccatgaatcaattttgagacaaaaatcaaggattaaatggctcaaggaagctttgttgggtaaatggctatgggatttagcctctaatcaaaaccagctatgggctagaattctaacatccaaatatggtggctgggcagaccttaataatggcagagatagaccttggcattctcaatggtggaaggaccttcgaaaattagttaagcagcctgaattcagcccgattcatcaacacatggaatggaaggtaggggatgggagtttagtcaaattctggaaggacaaaactatcaaggcttttaatagagccattgttatcaaatggaagtggctgatgttccatcaaccagaccaattatggattagaattctcatttcaaagtacaagggatggagaggattggaagagggctctcacaagcagacccattccttttggtggtctgatttgaagtctataatgcatcacggcagcatggctgaggttttaaagcagtttcactggaaattaggcagcgttagtgggaagcatggggtccttttgaagaagaaggttggcagtgggaattctcatggagaagaaacctttttgacaatgagctgggaaggtgctgatccaaaaggattttttactacaagcactgcatacctttgtattaaaggtcatgataaaagcaatggtacaaagttgaagactgatatggacaatacagaaaattctccaaaatcaggagttgaaaccaaaaaggaatctattgatgcaaaactatgtcagtacctgtggggttacaacaattcttcttgggagtgtcttccttcctccaacactgctggaggactattatgcatttggaataatggatcattcttggttgataggcgggtgctggggagaggtttcataatgctggaaggcctttggtgtgtcttgggagattttaactccataaggcaccgagaggagaggctcagttcatctcagacaagggatactccacccagcatatctgaatttaactcttggatttcaaatatggctttagaggagggtcatatcagttctagaaaagtccttaacctaaagaaggagctgaatgctttggaggagggtttcaccaacggaatcttatctcaagatgaagtcaaacttaggaaatcactacaggaacaactctggaacgcagcctatgcagttgaatctatgttgagacaaaaagctagagtgaagtggttaaaagaaggggacagtaactccaattatttccacagattgatcaactatagaaggagacaaaatgttattcaagggcttttcataaacgga

SEQ ID NO: 46648 - DNA, 294 bp, Glycine max
  Peptide Sequence Number=SeqID_138333
atgttccctcacgacttcctcctcaggttagtacttgaaaatgtgctctctgagcaacgtctttgctttgtgtttgaaaatgtgctctatgttcctaaaaatgtcgttgaaaatgtgctggttgaccttaatgccaagtatgaggttgaaaaattcacagggcaaaatgatttcgggctatggcgattgaagatgagaactcttcttgttcagcagggcctggtggaagcacttgatggagaagccaaacttgaaaagatgatgggtgatggggataagaaagcattactgtag

SEQ ID NO: 46649 - DNA, 746 bp, Glycine max
  Peptide Sequence Number=SeqID_138334
ttaggattcagaccttaatgtgcggaagccagttgaacatagtagtgatgcaaagcttgcagaatccagtggaagtgccatgggaggcgagccaatttggacttcctgatattggggcaaaattttacatcacacatgcagatctagcagaaataatatcaggtgacaagtgtttaaacatagcgatactacagttgtggaccatatttatgaatgagtgtggtagaagcaaagctgatcagtcactgtatggtttgctggagcctcaatctatacaaaatgctaaggaaagacgtcaacaatgccaacaatacattgaaacatgggtcaaggaatcacaaagacagttgtatttaggagcttacttgcatcaggcacgttggcaactatttgttctccacccaagggaaaacacggtcgtttggttttgttctctgaggaagaagcctgatattaacatcaaaggcgcaattaacagtgcaatgaagacaataaccagttcttttgaaggcatgtctaatcaaggtgcacctcggtgggttgaacccaagagtaatgtgcaaagtggagggtttgagtgcggatattatgtcatgcactggatgtggtgcatcgtgactgccggtttgaaggatgattggcacaagtggttttctgatggatcaccgttagacgtggaggccatcacaacagttcggcagaaatgggcaacttactttttaacttttaggaaaagcagttgctaa

SEQ ID NO: 46650 - DNA, 233 bp, Glycine max
  Peptide Sequence Number=SeqID_138335
atggcattgaacgagaaattagaagaacatttaggggcaagtggtaacgagaaagaacaactcattagtgacgacggcgttggggttatgtcagacactttgtggcggaaagaaagtatgtatatagaagctagaggcaaggtgtcagcgcgaaagggcaagagggcaagaggttcgaaagggttacaagcgagactagggttagagagagttcagcatgaaaggggaaaaag

SEQ ID NO: 46651 - DNA, 219 bp, Glycine max
  Peptide Sequence Number=SeqID_138336
atggaacaagttgatcataggatggactctccctatcccatccattcagaaaggcaagataaaatgtcaaatgaagaattgaagttgcaggatccacgatgtcggatacaatgtcctgacatcctgcccgagaatactggagtcgctgtacaatgcaagataaaagtcaagtgcagaagtgaagctgcaggatccacgatgtcggacacgatgtcctga

SEQ ID NO: 46652 - DNA, 278 bp, Glycine max
  Peptide Sequence Number=SeqID_138337
cttgcttctacaaaatctatcctgaggttcatgagaaccctagggccttcttcagcaactctagctcaatcctcttggagcctcttgctcatggctctagtgactgtggtgctgactccatactattctgggaggtccaacctataggcattgttattgatcctctccaaaacctgaaaaggttcatcccctctagggctaagcttggatttccttttagtagggaatctatccttcctaagatggagccaaacccagtcactgtcattaagaactag

SEQ ID NO: 46653 - DNA, 483 bp, Glycine max
  Peptide Sequence Number=SeqID_138338
atggagaaaaacgaagaaacaacaatggaagagaaggtaaagatgaaaactaatggaggtccttcaatggtgattttcaaccatggatatgtagcggaagataaagaagaagaggattgcatcagtgaggatgataaacctttagtcttcaagaaaacaaaagttgcacccccttcgaatgagacctttgtgcctcaagtgaagaagggtgaacaatcctcaattcaagataatgttgctaacgacccccctctaactgatattcaactggttcgtcaacaggcttcaattgttcaacagaatgaagcacctccatctcccatccaccttgatcactttcaacatcaaggccctcctgtcgtagatcctaaccttaaagctgaagacattgcaaggttgtgttttcccgttgtctatgcttacaacattcaaagaacaatgggagcagaattccaacctccaattgattggacacggttttga

SEQ ID NO: 46654 - DNA, 234 bp, Glycine max
  Peptide Sequence Number=SeqID_138339
atgccttatcaaggcccaaaagataatgctgccttgggtctaattttgtatgattggagtaggtactataccaaggatgtgactacaaaatctcatgcattaaagcttggcattgagtttgatcagaatgatgccatgttcttttactataaagacatgtatgagaactcacgccttgcttccacctccaactatgatcaagaagacaactccaaccctaagcggatggcataa

SEQ ID NO: 46655 - DNA, 1089 bp, Glycine max
  Peptide Sequence Number=SeqID_138340
atggaggaagaaaagcaatcaggattctactcccctcaatttgatcctgatacatgtgaatcacaagctaaatttggtcattctggtatccctagttcctcctctaatttgaatttaacgtccaactcatgcaatgtgggaacttctgaatgtctggagcaatcagggtcagctgccaatgaaggagatgatggcaccatctattatgatggagagtctgatattattggaactcctgctaaaggaaaaaaaatgcctcaggaagagctttctgtacaaaggaaattatcagttgcagatgtgacttgtacgatgtgcaagcaactgctctttcatcctgtagttcttaattgtggtcatgtgtactgtcaaacttgtgtcatcaacatagatgacgagatgctcagatgtaaagtttgtcaaagtccacatcctagaggattaccaaaagtgtgtttggagttggatcactttttggaggaacaatttcctgaagaatatggacagcggagagatgccattgaactaaagcaaatcaaagtcaaacccgacaccccttcttcttgttcattggataatggtaaaagagtagaaaatatagattggtggtctgatcctgacccaaaagttcacattggagttggttgcgatttttgcggggacatgctctccaaatttctctatttcattgacctagataggtggcggccactttatgtggttgcttgtcttttgttaactaatggtgtgctaatgtgtgacttctctgtacagatgtttccaataattggagatagatatagatgcattgactgtaaggagaagatgggctttgatctttgtggtgattgctacgcaagccgctcgaagcttcccggtcgatttaatcaacaacacacctcagagcataagttcaagcttgtaccaccgaacattattcataacatgatgttgaggctggccacagcacagttaggagaaggttctattgacctggagtctatagcaaacatagaagttacttcagatggtgccgctttgtttgatgatggagaagataaccacaatgattctgaagccaccaattga

SEQ ID NO: 46656 - DNA, 171 bp, Glycine max
  Peptide Sequence Number=SeqID_138341
atggcatcaagatttggcttaatttcgaacatcatccctagaaagaccgaattgaggttgaaggcacgtgtttttcgtttatgggctataaccgagtacaaaaatcctcccaatgaagccagcagtcttcagatgttattaattgatgaaaagctactaaagatgatatag

SEQ ID NO: 46657 - DNA, 270 bp, Glycine max
  Peptide Sequence Number=SeqID_138342
atgtctggttcatgggatagggtggtgtggtttcaggaatcgggtcgagatggttgccggaaaatgatcccagagctggagcagtccaatgaagatgcatggatgcgctcggggatcaagcttttgtcgatgtgctttaaaagtgttagtataacacaagcaaccaaaaactcgaaggcttgcttgaaaaaggagagcacgtgtgacattaagaagatgctggtgtttgcgctttacaatgccattatgtttgggtgtttcaaagcatga

SEQ ID NO: 46658 - DNA, 102 bp, Glycine max
  Peptide Sequence Number=SeqID_138343
atggaagaaggatatgctgtgaacaaggctcccatgaaagggcaatcacattcccttagacgcttaaaagaacgagatcctcaaggacaaatggacagatga

SEQ ID NO: 46659 - DNA, 1059 bp, Glycine max
  Peptide Sequence Number=SeqID_138344
atgattatgaggggccaagacatttatagtagccaagatgaggctattacttcaccttcctctagtgaaagtgaagaagcaaaggggaaagaatctagtgaagaaatctacccccgagaagaaggacaacctttaatggttaaggaggagtgtaaggagacacttgttagcactaccacacctcttgggcttgatattattcctcaagtaaaagagttgttggatgagggtttggttcgtaagagcttaaatccttatactttgttggtgcctaaaataggtattattaggcatcaaatccctaaaataggtgatatgatgaatgtgttgagtggtgcaaccctcttttgtaaaatcactcatgcgcccaacatcttcaagattcgtgtagatagggactcattaggtgttgaggaaagaaccccagattttcaagaacttatggatttgaggtcaaatccttttcaagtgggagggaatgatacaatcctattccccaaaggcattggtggcatctccaatcatctttcttccttctccattccgctgccattcatcttcaagaagcaaaggactccattcatgaagatccaaggcctacaagctccacatggagctacatcagtaaagagaatagaaatctttattcaatcaattgatccgggtgcatggaatgccattgttaaaggtcctttcattcatactaaagaatcaaatggtgaattagtacctaaagaatgggatgagattgaagataatgagaaaagaaaaaggcaagatgatcacaacaacaacaacttcacatgctttgaatgcgataatgcatcaacaacctttgactcttctattgatgaacaagttacaaatgtatgcttaatgacaaagtcaatggatgactcatcaaccattgaagaaactgaggtaaatcctgtgaaccgtgcaatgatcgtgtacaagtggcaaacatggagaagtgatgttgatgccaaggagcgaaatgaagagaaagatgccattgaaggaaccaaagaatcttacttgggttttgggagttcatag

SEQ ID NO: 46660 - DNA, 2247 bp, Glycine max
  Peptide Sequence Number=SeqID_138345
atggctcagaatcagagtaattgggaagctgataaaatgcttgatgtttatatttatgattatttgatgaaaagaaaattacatgctgctgcaaaagcttttgttacagaaggaaaagtttccacggatccagtagcaattgatgcacctggaggatttctctatgagtggtggtctgtgttttgggacatattcatctcaaggacaaatgagaaacattctgaggctgctgcagcttacattgagacccagcaaacaaaagctagagaacaacaacttcaaatgcagcaattgcaactaatgcagcaacgcagtgcacaattacagcgaagagatcctaatcatccatcccttggtggttccataaatgccatgaactctgaaggaatgttggggcagccacctgcaagtgtgttggcaatgaaaatgtatgaagagcgaatgaaacaccctcattcaatggattcagaggcatctccaactcttattgatcccaatagaatggccttactcaaatctgcagctagtcatcaaggccaattggttcatggaaattcagggaatatgtccactgcattgcagcaagggcgggctcctttaaccactgacatcaaaggagaagttaatttaggcgccactccaaagagtttgcctatggatacatcggtttatcgacaagcaattttacattcaaaatctggacttggcagtgcaggattaaatcaaggagttacaggtcttccgttgaagggttggcctctagcatctggaattgatcaactaagacctaatttgggtgtccaaattccgaagcccaatttgacagcccagaatcaatttgttttggcatcacaacagcaacaggtcttggcacaggctcaggcacaaaataaccttggaaattctaattatggtgacatggatcctcgtagactttctggtcttccacgaggtagcttaagtgcaaaggatggtcagtctactagaaatgatggatctatttgctcccaaatgcagtcagattcacctaagatgaagattgctcagtcacaacattcattatctcaacagcaggagcaattacagcagcagagtaacagaaaaagaaaatctggagctgccaatagcactggtacaggtaacactgctgctccttcccctacttcatcaccatcaacacatacacctggtgatggattaaatacagcaagcagcatgcagcatgtccaaaagagcatgatgatgtatggtacagaggcaacaggaggccttgcatcatcgtcgaatttgctggacgacatggatcgatttggagatgttgatgctttagatgataatgttgaatcctttctatcaaatgatggcggagatggtgggaatctctatggaacagtgaaacaaagtccagctgagcaacagaaagagtcttctaaaggtttcacctttgctgaagttggttgcagaagaacaaggaacagcaaagttacttgttgtcacttttcttcagatggaaagtggctagccagtgctggagatgacatgaaggccgagcatgggacactggtctctaatcttaggctaatttgccaaacaactgctgttgacatctggaacatggacactttagaaacagagagcactcctgcagaacacaaatcagttattacagatgtccgttttagacctaattcatctcagttggcgactgcttcaactgataaatctgtgcggttatgggacacaaccaatccaagccgttgtctgcaagaatatagtgggcattcatcagctataatgtctcttgatttccatcctaagaagactgaacttttctgcttctgtgatggtgagaatgaaattcggtattggaatattaattcatccacctgcacccgtgtaactaagggagttagtgcacaagtcaggtttcagcctagactgggacgttacctggcagcagcttctgataaaggggtgtcaatttttgatgttgaatctgatacacaaatttacaccctccagggacatcctgaaccggtgagctatatttgctgggatggcaatggtgatgccttggcatctgtgagttcaaatttggtgaagtccttggagttatggaacatgacagagaacaaaagcatgacaattactacacatgaaaatgtaatatctgctttggctcagtcttctgtcactggaatggttgcctctgcaagtcatgacaactatgtaaagctgtggaaataa

SEQ ID NO: 46661 - DNA, 183 bp, Glycine max
  Peptide Sequence Number=SeqID_138346
atgccaaaagatagggggacttgtcttgatttcagggattgtcatcatcaaaaagggggagattgtagacaaaggatcacgctgaatgttttgatgatgccaaagtttcacatgcgtctcaaagctttattcgagacaaagaaattaaagatattcaagatggatgatcaagacagtctctag

SEQ ID NO: 46662 - DNA, 543 bp, Glycine max
  Peptide Sequence Number=SeqID_138347
atgcagaagcttccatttcacatactccacatagttcccggtgacccctctcggaataaagaagtcccacacaacagagccacacgccctaagccacctgtcatcgaaatccacgccggaggccgcggccgctctgccgccgtcgacgctcacggcgacctgcaagcagtttccagtccagaagaatctcgagaccctggcgggggtcctcaccaaaaagggaagccgaattggcggcggcggcagcgaagaagaagaagaagagcccttctcgacccttccatcggagacgcagtcgagggaggttctgagcgaggaaaaggccgagaatctccgaaaaatgggattttggttaatgggtgttggttgcttggggtttgggagagagaatggcatgagagtttgaacgtgagattacggagcttcgaagagagtcaagccactttattctgctattggtttgaagaagacaaatgtttcgggctcttgagtggtgggagttggagaaagccagaaaggttgcaatttgctgcaaatgaatag

SEQ ID NO: 46663 - DNA, 869 bp, Glycine max
  Peptide Sequence Number=SeqID_138348
ccacaggatgcacgcttagcgcacttgcatgtgacagcttgcttccaaggtggcttcttgaggtaagtgggcttcttggactgagcggtcctgatgtgctaagcgaggtcaatatgccacccaggaatagacatgctagtgattcaatttctgatgagacttctactcaaccccaaaatgtagccccgagggaccatggacgtggcggcagtcatggtcaaggaagacatggtaggggtggtggaatgccaaatgttgaggttcctagagctactcgtgggaacccaacacttgctcaattaactgctaatatgaaaaatatgcacgaaacattgcgacaattagctcatgcggaccctcaagctttcatagatgaagagtcatggatatttcgaggtctagctatgagttcaaaggttcttggaaggaaacatggtaaaggtgggaattctcgtgaatcacgcaagaggtctcacttgaagacatcttgtggtggccataaagccatggttgtgtcggctttagagatgatactagttagcatcatcaaggccagcatggaggttgacagccacaggtcactcaagctagcacaactcatagtcggggcaagatcaataggttgttatcaatgtgggcaagttgaacactttgctaggagttgccccatgccatcctttcagtcatcttctaatagagtggcaacacctatggtcaagatgggacactctagtggaggcaaaggacagggaatgactagtgaaggacaagctcatgtgttcaccttgattcgtcaagatgctcagctacacactcctttgtatctgccttttttgcatatgcttttgggagagatccatcaccattag

SEQ ID NO: 46664 - DNA, 225 bp, Glycine max
  Peptide Sequence Number=SeqID_138349
atggagatggaacttagcaacaaaaaaggctcaccaagggtgaaccttggttttatcgagccttggaccggggacatgtttgccctaggttttgacaagcctgtggagttgcatcgaggcttactaaggatgagccttggattttgtgaacctgtgaaactcaccaagtgcgaagcttgggtttatcgagccttggaccggggacatgtttgccctgggttttga

SEQ ID NO: 46665 - DNA, 360 bp, Glycine max
  Peptide Sequence Number=SeqID_138350
atgaaatacatcatgaattcggttataacagtgttgtatttcaatggaatgatttttagtgtctggaaaggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 46666 - DNA, 333 bp, Glycine max
  Peptide Sequence Number=SeqID_138351
atggtgtcaccacaagggaggaacatgtggacagttgatgatctcgtgccttatgtggagaagataacgattttatccgaagagcaagagataatcattgagcctgtggcacatggtccatcatctgagcgtcgatttccaccacaagagtttcacatgcttcagtcaagtgttgaaactcggggtgttgatttgcgtcacgagttttctgctgaggctgagcaattagaagcggggagacatcgcggcagaagaaatcctgatcgtcaagcgcgaagatgggatcgaccatgtggcacatcctcacgtcatcacggatatcataatgaatga

SEQ ID NO: 46667 - DNA, 582 bp, Glycine max
  Peptide Sequence Number=SeqID_138352
atggggaagtacatgaagaagtccaaaatcgccggtgacgtcgccgccgtgatcatggaggctccgccgccgcactcccacctcggcgtccgcacccgcgccaagactctcgccctccagaatacctccccggactcctccgcctacctccagctccgcagccgccgcctcctcaagctcccccctaccccgccggaaaatccccgccgctccgccgccgaaaccgccgccaattcccgcctcgccaaaacgacgtcgtcccgtaacgccgaaaagttcgcatctttcgatgacgacaacaataccgaatgctctttcggcgaaaatttcttagacgccgaacccagggaggaaagggactcaaatgccattcatacccctggttcaaccacaaggccaaggactcgccaaataatccatgagcacatccaaagaaacattccaacggcttatgagatggaggagttctttgcttatgccgagaagcagcaacaaacaatatttatggacaagtacaatttcgacattgtcaatgaagtacctctgcctggacggtacgagtgggtcccagtactccactag

SEQ ID NO: 46668 - DNA, 1356 bp, Glycine max
  Peptide Sequence Number=SeqID_138353
atgattcaagatgcatctacttatgatgcttataacgagcatggtatggctagaggatataagagaagaaatcttaacatttgggaattatttctaattgaaaagataaagaccaaagttgatgttgtttggcataatggtgaacatacttcgggattggatccacacaacttagtcccaatgaatgtcataaacactcatgaattttggccccaacagtttgtgctggaaaaaggtgcttctgatgattctcttaatcctagcaaacaaagatggggtgttgttctttccatagatgcaaaagagcatactgtaaaggtgcactggagaactgttcccacatctgagacagataatttagctggagacacaatgattgagactatgagtgcctatgaacttatcgagcacccagattactcctgttgttttggtgatattgtgttcaaggtggcccaaaaacttggttacgaagctgataaagataatgcaaagttagtgactgacttgaatgtggaagttcctcggataaattgggaccaaatcagttatccgaataagtctgtagataacaattacctttcctgtatttccaatgttactggttttgaagatggtgacgtggaggtgaaatgggctactggtttaacaaccaagttaatggctatgtatgatgtagaacttatatcagatcctatcagtttaatgattccttcctctcctccatcttccttgtacctggaattgaggtcattacaagtttatttgtgcccctacaggttgcacgttatgaaaattttcaaattgataagcacgaaggttcaattgcaaccccctattccttatgaagcaaatgttgaggagttgactccagagatgattggaagtcaaccattagacaagaagggaaaggacttgttagattatgatggctatagagataatagtgaaaagcatccaggagaaagtagttcctcttcccttcctcaagctgcctttgaacttttctccagtattaaggccagcatattcaaaacacttggtgtaacatcactttacggaaaattctccccagtccctgcatttgaagagggcagtgaatctggctaccttgataagaaagatttggacacttgtggtcttgaatctaaatctgaatcacatccagtgagcaagatgaagtcttctgaagacataactctttattgtgaagttattaggactcatgagaggaatgattttccagtttctttagacaacaaaaacaattcagatcagttgaagcagtttgatgtaattgacaattgctcagaccaccatttttttcatgaggggaaaggattgacatcatcttag

SEQ ID NO: 46669 - DNA, 255 bp, Glycine max
  Peptide Sequence Number=SeqID_138354
atgatgtatgcaatacaattaggtgaagttaggcacaagacagatgtcaaggaaagtagcttaaaccaaagtctcacggctactgtttcactcaagctcaacataggagtgaccggaggagtggtagtcaatcccaggattggtgtagagggtcctctagaagatcaagagggtctactggctgctgaagagaagattgatccaccactggagagggtggatctagtgaaatctgtggtgatctctctggagtag

SEQ ID NO: 46670 - DNA, 571 bp, Glycine max
  Peptide Sequence Number=SeqID_138355
atggcagattctcttccagattcttccaactcgctaagcaagctgagtgcctcggttagcggatgcttagacattgatggaataccctcacccttaccttggggacaccaataccatcctactgccagagctgccaaatggattcattttgacttcaagcatgagttcctacaaatgttggagaacaacctgtttagtggtgctacccatgaagatcttatgcagcaattgaggaagttcatcaagttgaccgacatgagcctagttcatattttctatggtggagtagtgtcctcacacaacaggacaagtttagatgctagttgtgggggtaacatcatgttaaaaccccctactaatgccatcaagatgattgaagatatgtgctctaacccttataacaacttacgagatatgaggattatgaagagaggcatgaaccaagtggagaaagatgattcccaaactaaattgggaaaacaaatgcaagctttgacaataaagattgagacactcatgagagctcaagcccaagtccccatcactacaactctattctctgttggatcga

SEQ ID NO: 46671 - DNA, 105 bp, Glycine max
  Peptide Sequence Number=SeqID_138356
atgatgttcggggagtttctagctactgtctctcctgaattcaaaacacccatgaatggcattctaattgccgaggaagaatttttctttgatgcttgtgtttaa

SEQ ID NO: 46672 - DNA, 153 bp, Glycine max
  Peptide Sequence Number=SeqID_138357
atggacaatggatatgggagctatggatatgagggacgatttaagggtgttcttattatggaaaggggttgtgcgggagacaattacagtggacagaatgagatcgtgagagaaaactccgacaacgacagtgaaaggattgtcaccacatga

SEQ ID NO: 46673 - DNA, 153 bp, Glycine max
  Peptide Sequence Number=SeqID_138358
atggttgatgcatccaccagtaaggcagaatcagaactggacgcaagttcggatgatgaggactctcagcctgaggacgttgttaactctaatggtaaagagggctatgcacacgaattggtggtaacaacgagaggaccaaaggaagagtaa

SEQ ID NO: 46674 - DNA, 300 bp, Glycine max
  Peptide Sequence Number=SeqID_138359
atgggtccgaaatctacgctaaggttcatgagaaccctaaggccttctcttgcatctctggcccaatctacttggagtcttctatccaatgcccttgcgggattggcagaactcgagggaggaggaggaggagggagtccgctccgacggggttttagcatcgttggaataaggcgcgcgtcaaaggaggaggatgaggacaaggaatgcgagatggagacggagacagaaactgagggttattggtggaagaagtatgattcgttcggggaggtgtggtcttctccagcaacgcgatga

SEQ ID NO: 46675 - DNA, 408 bp, Glycine max
  Peptide Sequence Number=SeqID_138360
ggtaacatcaaggtggctcacaaaacactcaagtcccaaaactcacaaaataactcttcaatctcggacttggtaggaaactcgtgcagccttcatgtttatatagcagtgtgcgtatctgggctgcaacaacttgtgctggatgagatctatcattctcctgaaaaatctgcacttgaagatctaaaggataaaatttatgtgtccagtattttcgggcaggatgtcctggacattgtatccgacatcgtggatcctgcattgtgcattgtgcagcaactccagtattttcgggcaggatgtcctggacattgtatccgacatcgtggatcctgcagcttcaattcttcatttgacattttatcttgccttgtgcattgtgcagcccgatctgattccttgacataa

SEQ ID NO: 46676 - DNA, 171 bp, Glycine max
  Peptide Sequence Number=SeqID_138361
atgaaggagtcgagcttcatcgaggagggcatgaatgagttgaagtatgactctatccttatggtgtttctagtttggaatctttgtgtggctcatgttgatcccatgggttggagtatccttgccagattgggtaaccttaacgcgccatcgatagtctcgtctcagtga

SEQ ID NO: 46677 - DNA, 462 bp, Glycine max
  Peptide Sequence Number=SeqID_138362
atgttacggaaccttgcggattacataatcatcccctttttgacctacggaatgttacggaacctcactaattatgcaacgatgcttccatttgatttccggggtgtcacggaaacttacggattgtgcatcaatatttttttgttttccggcatgtcctggaatttcacaaattgcctaatgatgggtgccaagcaccttacaaggaccaaacaaaggtcgcatgtcatcaagcaaaggtccctggacgaaattaggctttcaagaccaccatggcgaatgtctggaaagctaaagagtgacatggagaaacttgttaggaattatccatggaattttgaccaacgcatattgattctaaaggatctaaatccacaagagtcaccaaagaacattgaccttagatggtgtcatttttggcttcagggggaggatatccctccagaatgcagaacaaactag

SEQ ID NO: 46678 - DNA, 893 bp, Glycine max
  Peptide Sequence Number=SeqID_138363
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcgacagtcagcattaaaacttgaagtttctgcgataaactgctttaaatttcatttcgagttttactcgccatctttgattttgaacttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46679 - DNA, 477 bp, Glycine max
  Peptide Sequence Number=SeqID_138364
atggggacaaatcaaaacggcaaaaggttttatcaagtcaaggttaaaagtctagatgtcaccagcctcaaggaattgggacgattgatgggacccctccaaaggcaagccttccacaaagtgtacgggaagatcctagatttggccgcagcggaggtatttacgaaagccgttgtatccctcacccaatactatgaccatccgttgaggtgtttcacgtttggggacttccaaatggtaccaactattgaggagtttgaagagatattaggatgccctctcggggggataaaaccgtatcttttctccggctttcttccttccttgagcaaggttgcggccgtgattggagattcagcaaaagagttggatcgcatgaagaaaattcggaacggcgtagtgggcctgcctcggaaatacttggaagacaaggcaagggatatggcgagccaagagaagtggggcccgtttgcggat

SEQ ID NO: 46680 - DNA, 233 bp, Glycine max
  Peptide Sequence Number=SeqID_138365
atgcctttcttcgttcatggttcgatattctggtgtcctaggcgtagaggaaccacaccaatccatcccgaacttggtggatactccggggaacagatatccagtggagatgacggggtggggcctgtagctcagaggattagagcacgtggctacgaaccacggtgtcgggggttcgaatccctcctcgcccacaaccggccaaaaaaagggaaggatttttccctctgggg

SEQ ID NO: 46681 - DNA, 438 bp, Glycine max
  Peptide Sequence Number=SeqID_138366
atggagggggaacggttaacgccgttgagtccgataggccgcacagcttcgcaaaaacccggacaccccttagcagctaaacctgttcctttcccataccaaaatagccacgcggtcccatggagatatacacctccaagggagagggaagaagaagccaccgacgtcagctcgttgtcggctaaagtaacaaatatcacgggactgagtggtgtgacccgtagtggtcgtgtgttcgcgcctccggacctaccagtccaacccgcggacgtcaagggaaaaggaaaagtgggggaggaacaagatggcaaggcaccctacgcttcgaataaagatattccggcaaaaggacttccggagaaaaaggagggtaaaaaggaggtgtcgctagaggaagccagtgagttcctccgaataattcagcagagcgaattcaag

SEQ ID NO: 46682 - DNA, 207 bp, Glycine max
  Peptide Sequence Number=SeqID_138367
atgtctataatggtttcttctgaacattcatgggaggattgtcaatctgccaatggagacattccatatgaaaacttaagctatggccaattaatttcctatgtccaaaaggtagccttaaaaatctgccaggatgacaaaattcagaggcaattagccaaagaaaaagctcaaacaaagaaggatttaggttccttctgtgaataa

SEQ ID NO: 46683 - DNA, 225 bp, Glycine max
  Peptide Sequence Number=SeqID_138368
atgtcagtgaaaaacctcgtcaagcgcctaggagtacatgacaagacaaaccacacaataataagtcaatcagggtcacagtgttttgcaagaatgctccaaccatatgggatcaacataggtttaaaggagcactcaaactgtgtgacccccaaggcctatattccgaagagtccgtcagggcctctccctcctgattcaggtctaacccaaaaaacattttag

SEQ ID NO: 46684 - DNA, 512 bp, Glycine max
  Peptide Sequence Number=SeqID_138369
atgaacatatcgttcctggatttgtccgttatcatattccagcctcacattttgcatgagtcatggcatcatcatgcatatgcgttcaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46685 - DNA, 769 bp, Glycine max
  Peptide Sequence Number=SeqID_138370
gtctgagttcctcattggaggatacgtaggagcaagagcctcgcttttgtcgatcgcaccgctttttgttaccatgacccaagagctggtagcccgcggagacaccttacggttatccgcacctcgtcattcagtgaccccaagtgtgattgatgagcagaggccaatttggtcatatgcgccctttccggagatgtcagcatcttccggtggagactttttcaagtctcacaagatctgtcatactgacctgaggtcatgtaacatgcggagacaaatttggtcattccgcacccctttgccatttagacacagtcgtgtccgatggcacgcagagacaaaatttggtcattctgcacccttttgtcatccagaggcggcgggcccgatgacatgcggagacaaaatttggtcattccgcacccctttgccattcagacacagtcgtgtccgatggcacgcagagacaaaatttggtcattctgcacccttttgtcatccagaggcggcagaccccatgacatgcggagacaaaatttggtcattctgcacccctttgccatttagacacagtcgtgtccgatggcacgcagagacaaaatttggtcattctgcacccttttgtcatccagaggcggcgggcccgatgacatgcggagacaaaatttggtcattccgcacccctttgccattcagacacagtcgtgtccgatggcacgcagagacaaaatttggtcattctgcacccttttgtcatccagaggcggcg

SEQ ID NO: 46686 - DNA, 494 bp, Glycine max
  Peptide Sequence Number=SeqID_138371
ttgtcctctttccgaatatggaaggtttagtggacctagcagtgattgacgctttcctcacctttcatcatggcaaggaaagcccggtcgtcgccattttggccatgtatgacacgttcgaccggggatgcccgtctatccgctacaaggaaggaagaatcgggattctatcttcatgcgaaggatgtccaaatgttcccttgatgggaacaagggtgaccacaacgcgagggtactccaaggagttcgcaaggcatgggatgcggcatgaagaaaggacagagagcttatgggaagcaactgtgagagacaatgaggttaaagcttcggaagaaagtgatgaggtacaagccctaaaggcgaagcttgaaagagcccgggtagtcaaagagaagttcaaggcagcaatagtgagctcaagctccgaagaggtgaaaggaatcatcacgggtcaaaggcatgatcttgaaggacgagctaaaggcttgccttag

SEQ ID NO: 46687 - DNA, 57 bp, Glycine max
  Peptide Sequence Number=SeqID_138372
cgccgagaccattaatccagcactaagcatgcctgaattaaaagccaccaattccaa

SEQ ID NO: 46688 - DNA, 162 bp, Glycine max
  Peptide Sequence Number=SeqID_138373
atggcagcggaatggagaaggaggaaaggtaattggagacgccacttcaaggagaagatgagtcaagaacaagctcaccaccataggagctcactaatccaagatcaagtccaagattctccactaagtgtgcttaggtgtcatgaggcatgcaaagcatga

SEQ ID NO: 46689 - DNA, 513 bp, Glycine max
  Peptide Sequence Number=SeqID_138374
atgtctgaatacaccaacgtcagtaacggtaccaatcagcaacaagaactggcgctgtataaagcgattgtcaaaattaaagataaacagttcgaatatgacgggaaaaagctaagcctctccaatgggcttaaagcacaggctgttgtcttccttgaagaacgccctctctacatgtggatgtttactccgggggtaacgttgatgtcactgagcaaaacggcagaacatgctggcttaaaaagccgtgcgctgtcgctcgatcttgatgaaatcagacaattaaagctgccctgcgttatccactggggaatgaaccactacgtcgtgctcaccaaagtacgcaaatctagctttgtggttcacgacccggcgctgggtaaacgcattatcggcattcaggaaatgtcgaacaactttaccggcatcgcgttagagttatggcccgatcagaacttccagcaggaaaaagccaaatctcgcctgcgtttgttagatctgatgcgtaatatc

SEQ ID NO: 46690 - DNA, 1008 bp, Glycine max
  Peptide Sequence Number=SeqID_138375
atgttatctgacaactttagcattgataaggaaacccttaggacaaatttttattctccggagaatgaacctcaaaggagatggtttttccaaaattataagggtacaaacaaaaaacagatccaagacaagttttacaaatttgtcgaaagggtcaaagtcaatgtccttttctttgattggttccatgcttacagcatcaaaaacgatatagattacccatggaagcaagacatcataggtgatccatcaacaaatgttataaccaactggcaagtaagatatggtgaaataatccaatcggaattacctcccacgaccaaatatcaactcccgaatatcaaagatagtaacaacaagcctgtaatggcaaccccatttaaaacaaaagatattaatgaggaagtaacctctgaagatattaaaagcctaatggaacaggcaaactacaccaataaatatttacaaattttaggagaaaccattaaaactaaggtagttcctaagcaaaaatcgattgaagaaacctctccaagtattcccattgaaaaaccactgttcaaacctttcaaagtcagtgagaaagctaaacgaaagattagagaacttaggaaaactaaatccttagttgaaggagtaggtgacaaccatagtgaattactaaacaagattggtagtttacttaaggtcattccggaaactccccaaacctcggaaaatacttccaaaatggtaacaagaagtacctccaaattaattaatgttattaatgaagacagtgaccaaaactcagataatacaactgaaataggatcagtgtcagaaaagaatataaatccaattaatttcaaacattggaaaacaccttccaaattatattatcaacgtccaactgcccctgaccttctattagaagaaagaggagaaaataatttcaagagttttagtgcaaacaacatttatgaatggaacatagatgcacaaacggagtataatatcatgaattaa

SEQ ID NO: 46691 - DNA, 252 bp, Glycine max
  Peptide Sequence Number=SeqID_138376
gtcgactctagaggatccccctcgaaactcgaaggtggaggacacatgaacgaaaacacaattcaaggttctccgaaaaagggtgagaatggagaattgcactatgcaatcactacgcatggctccgaactcgaaggtggaggacacatgaacgataacgcaattcatggggctccgaaaaggatgagaatggagaattgcactaagcaatcactacgcatagctccaaactcgaaggtggaggacacatga

SEQ ID NO: 46692 - DNA, 728 bp, Glycine max
  Peptide Sequence Number=SeqID_138377
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaagcatccagcacaggggaaagatgtaggctgggaggctaagccagtcttgtcttgttttttcatgttcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46693 - DNA, 378 bp, Glycine max
  Peptide Sequence Number=SeqID_138378
atggatagagctaggttggtttacggcttggtaactcacatggatatgaacattggcgcccttatcttgggccaaatttcttctattgctcaatctaactcctctaggctcggatttccagccttgattaatgctctctatagagctagaggagttacttctgatagtttgacctacgagagcctgagctcggccattaatttggcctacattaaaaagaactgttggaatttgggtgatcttacagttaatttcagaggggcaaggaaggcaagggcaagattagctgatgttccttcttcttctactccaccacctccatccacatctactaccccagcaccagcacctccaggcccatctacccagggcttatag

SEQ ID NO: 46694 - DNA, 1854 bp, Glycine max
  Peptide Sequence Number=SeqID_138379
aacgttaattttgcttcgccagttgtgcagttattaaccaggggtgagactggcatgttccgtggagcaacgttagtcaatctcgacagtaaagggcgtttatcggtaccaacccgataccgtgaccagctgattgagaacgctgcgggtcaaatggaacgccgcgtgcagcggttgttattgggacatgccagtgaatgtcagatggataacgcagggcgattactgattgcgcctgtattacggcaacatgccggtctgaccaaagaagtgatgctggtcgggcagttcaacaaatttgaactgtgggatgaaacgacctggtatcaacaggctgttaacggtctgaatattcgtccggatggcatctacattgatggcacttttggtcgcggtggccactcgcgtttaatcctctcccagctgggtgaggagggacgtctgctggcaatcgatcgcgatccgcaggcgattgccgttgcacagaccatcaatgatccacgtttttccatcgtgcatggacctttctctgcgctcgcggaatacgttgctgagcgcggcctgacgggcaagatcgacggaattcttctcgatcttggcgtctcttcacctcagcttgatgatgctgaacgcggcttctcttttatgcgtgatggtccgctggacatgcggatggatccgacccgtggtcagtctgccgccgagtggttacagaccgctgacgaagcggatattgcatgggtcatcaaaacctttggcgaagagcgctttggcaaacgtattgcgcgcgccattgttgagcgcaaccgcattgagccaatgactcgcaccaaagagctggccgaagtgatcgcggcggcgacgccggtgaaggacaaacacaaacatcccgcgacccgtaccttccaggcggttcgcatctgggtaaacagtgaactggaggaaatagagctggcgctaaaaagctcgctcgacgtgctggccccgggtgggcggttatccatcatcagcttccattcgctggaagaccgtattgtgaaacgctttatgcgtgaacaaagtcgcggtccacaggtgccagcggggctgccgatgacggaagaacaactcaggaagctgggtggccgtcagttgcgagcactaggcaagttgatgccgggcgaagaagaggacgaacgcatgatcggcagagtgacagagaccctcagcaaagttaaggattcgttaggaagcaacgagcgccatgccttgcctggcgtgatcggcgacgatcttttgcggttcgggaaactgccactctgcctgttcatttgcatcattgttacggcagttacggtggtgaccaccgctcaccatacacgtttattgactgcgcaacgcgagcagttggtactggaacgcgatgcgctggatattgaatggcgaaatctgatccttgaagaaaacgcgctcggcgatcacagccgggttgaacggatcgcaacggaaaagctgcaattgcagcatgttgatccttcccaggaaaatatcgaagtctccacatcccgcggaatgatcaccgaccgttccggccgtccgctggcggtgagcgtaccggtgaaggcgatctgggccgatccaaaagagctgcacgatgctggcggtattacgctcgacaaccgctggaaagcgctgtctgatgccctgaaaatgccgctggatcagcttgcctcccgtgttaacgccaacccaaaagggcgctttatctatctggcgcgtcaggttaaccctgacatggccgattacatcaaaaaactgaagctaccgggtattcatcttcgtgaagagtctcgccgttactatccttcaggcgaa

SEQ ID NO: 46695 - DNA, 139 bp, Glycine max
  Peptide Sequence Number=SeqID_138380
atgtacggttgtgataacctgagccttttcgctcagtccatgggatgccccaagcgcttaactgaacctaaccaactgtcataccctaatttcgttcggggacctttgcttgatgacatgcgacctttgtttggtcctt

SEQ ID NO: 46696 - DNA, 96 bp, Glycine max
  Peptide Sequence Number=SeqID_138381
atgaagtcgttgagaggaaaggagatcgcgttggtgaaggtgcagtggggaaacgatgaggaagtaggaatagcgggggcaagatatgctggttag

SEQ ID NO: 46697 - DNA, 450 bp, Glycine max
  Peptide Sequence Number=SeqID_138382
atggcctccatcattgtggccatttgctctttcatggcctccatgttggccttcaccttctcttgcacctcctctgctttacccattactctagctctaacacagatttccaacacggtccatgacatctttgtcaaggtgaaacaggaagtaacagggacatcaacagccctaaatgtgtttggcagtagacgaagcagcgatgtaacacgatccatcttttgccccaatttttgcaagatggttacttccatacttcaacttgactcgatgaaccttttcgtaaaagcgcgagcttggttcaaccccataacccagggaatggcaattttgatcgccaatacttcatcaacatttcataaggatgaaagactcgggaatacgcatgctatgcatggaaaatgtaattatgagattgagatgcccgaagaaacatcctttcttagttaa

SEQ ID NO: 46698 - DNA, 171 bp, Glycine max
  Peptide Sequence Number=SeqID_138383
atggcgatcagtgaaatgaaaagaaaagtgaaaaagaagaagattgcaagttacagcagtcgatttgatgaagaaatgagtaagataggaaggtttggaggtggaggcagcctactggtaatcgattacatgaatactgtaatcgattacaggccatctgttctagtgtaa

SEQ ID NO: 46699 - DNA, 705 bp, Glycine max
  Peptide Sequence Number=SeqID_138384
atggaggggcttcaactgtcggctgtttctggggttgttgttgttgttggactggtggaggaatgtcataattgttctgctgtggttgattttgctgctgaggttgaggaggtctattgtaaatatttgcagcataagcttcaggctactcaattgctccaggttgctgcatggaagggcaaaggtctgactcagtatatggagagaagtatgatagatgctgccagtggtggagcccttggagacatgactcctgctgaagccagaaatttaattgagaagatggcttccaactctcagcaatttagcgccagaaatgatgccatagtcattagaggactgcatgaggtagctacaaactcagctgcatcatctgagactaagaagcttgaaggcaaactagatgcattggttaacttagtaactcagctagccttgaatcagaaatctgtacctgttgcaagggtttgtggtttgtgctcctctgctaaccaccatacagacctttgcccttccatgcaacaatctggagcaattgagcagcccgaagcttatgctgctaatatttacaatagaactcctcaacctcaacagcaaaatcaaccacaacagaacaattatgacctctttagcaatagatacaaccctggatggaggaatcaccctaatctcagatggtctagccctcagcaacaacaacagtag

SEQ ID NO: 46700 - DNA, 657 bp, Glycine max
  Peptide Sequence Number=SeqID_138385
atgaggggagcgccaaccgaagaaagtctctcgcctttccttgtgagggatctaggcgcccaaggtctcaaggttatacaaagaatccacaaggcgtggaggagtccgttgaggaaagacaaggagcttagaggcatccgaaatgatgtcatcggaggttatcatggatggctaagaattcatacgcgagggttagattggctctccaaattgaaagttattgatgaggagaacttcgaagctccggaggaagatgaagaagtccgagctctaaaattagagctagggaaggcgagactcgccaaggagaagttcaaatcagctgctacacacatccggaaggagtgcaccgagttacaagaggaaaacgcgaccactgcaaaagcccttgaacaagaaaccaaaagggcccgcaaggaggaatatggccgagagaaattccaaggagcattgtggggtagtaacaatgagctcaagctccgaagagaggagagagatcggtcatgggtgcatggcatgatcttaaaagaggagttagttgcctgcgcaaggtccaaaaggagtttggctcaacacttggaagccatggagcaaagcatgctagctatcatagggcagtacaaggaagagttgaaccagttagtggcccatgaataa

SEQ ID NO: 46701 - DNA, 87 bp, Glycine max
  Peptide Sequence Number=SeqID_138386
atggctccacctgaagaaattgcgaccatcatttaccacaatggtcacattgtagacgacctagttcaaggatcgatgtacacatct

SEQ ID NO: 46702 - DNA, 390 bp, Glycine max
  Peptide Sequence Number=SeqID_138387
acgtatcaagcttattcgcaatacgtgcgacctcagggggatgctccggtaagcttattgttccctttagtgtatgaggtgtttttcgagctccagtggctatcatggtttctatcagctgttccctcctgttcagctactgacggggtggtccgctcacaattcggcacacaagcataccgagccggacatcagcgcggcaagtgtagcggggtgcctaatgacgctgcagctaaccacccacccgccggcttaatgctgccgctcagcgcgcccattcgccattcggctgcgcaactgttcgggaagggccgatcggtgcgggcctcttcgctattaatgaatcggccaacgcggcgaaagggggatgtgctgcaagtttgcgattaa

SEQ ID NO: 46703 - DNA, 464 bp, Glycine max
  Peptide Sequence Number=SeqID_138388
catagtaagccagtatacactcccgctagcgcccaatacgcaaaccgcctctccccgcgcgttggccgattcattaatgcagctggcacgacaggtttcccgactggaaagcgggcagtgagcgcaacgcaattaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 46704 - DNA, 249 bp, Glycine max
  Peptide Sequence Number=SeqID_138389
atgtcgagcctctcgatatgtgatgtgcttgaatcggacctccgtgtgaaaaacttatcttccttcaccggaagtggcgtctaccctgactcatcttccttaaccggaagtggcgtctacccagacttatcttccttcactggaagtggcgtctaccatgacttatcttccttcaccggaagtggcgtcatccaaaccttcgtaacctgtatcaagcgatccaccccgtatggttcacatcagttatga

SEQ ID NO: 46705 - DNA, 570 bp, Glycine max
  Peptide Sequence Number=SeqID_138390
atggtgaaagttggaacctcttacgtgccgatcaacgtctcattttcgccaaaagttggctcatgtcagggcccgatcacaacaccaaggatattatctgatctaagaatgtgctccagtggcgtatcatggtttctatcagctgtccctcctgttcagctactgacggggtggtgccgctcacaattcggcacacaagcatacacgccggacatcagcgctggcaaggcgcgctttccattcggaaaccatgtcaggctgcgcaactgcattaagacggccaacgcgcgggcgatcgagtgcgggcctttcgcgtattacgccagggcgctaagcggatgtgtgcaactggcgattactatgttggcactgataacgccagggtgtcccagtcgaatgcgttcgtggcagaaaaagcgcaccggtgcgtcagtcagaatatgtagatacaggactcatataggtccgcgaattcccgtcactgagctcgctaccgctcggtcgtcatgcggcgacgctgaacagtggttaccccaacggggcaggaatttccggaaggatgctcggtaa

SEQ ID NO: 46706 - DNA, 309 bp, Glycine max
  Peptide Sequence Number=SeqID_138391
atgcactgcaggccacagacgcaccgccaccacctcatcaggctgatccagctgggtcatttggcatggagcggtatttatagcacttggttcgccagcaggcggccaaccacagggggcaggtgcagatacatgaatgtctttactagctcagcctcattcagggctgaggttgcatgtcccggagattggcctgaggcccaggcaggggaggcgcccgtagaggctcccggcgacacggaggaggcccgcatggatgaggagatgacaaatttactcgatttcttgggagggagcggagccacatga

SEQ ID NO: 46707 - DNA, 324 bp, Glycine max
  Peptide Sequence Number=SeqID_138392
atggagaattgcactaggcaatcactacgcatggctccaaactcattggtggaggaatcaatcgggaaaataacaaagaccacatttttcagtcaagaggatccgcacttgacggcaatcactacgcatggctccaaactcgttagtggaggatgcatgaaggacaaatcaattcatggggctccgaaaaaggtagttggcaggaccaaatggtccaccggtttttttccacctaaaaaggcaaacatgctttttggaaagaaaaataaatcattcgcgagtgcaccatatcttatagaaacaacatactcatgtcaaggataa

SEQ ID NO: 46708 - DNA, 366 bp, Glycine max
  Peptide Sequence Number=SeqID_138393
atgggggagacacatgaaattccccaccacaacctagctgacttcgagccttggctcggatatgccactgaagggcaagcagttggtggtataccctttgaaaacactttggagagccctcagtatcacccacaactacacctcttgcattccacagcggttaaaaaccatcatgctatggcagaaatgggaaagaggaaaggctcagggccattgaaggagttgttcctagtacccaatatcaccacccctcccaagttcaaggtgctggactttgacaagtacaaggggactacttgccccaagaaccatccaaagatgtattgtcggaagataagggcatacacaaagatgaggaactgctaa

SEQ ID NO: 46709 - DNA, 836 bp, Glycine max
  Peptide Sequence Number=SeqID_138394
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatccccagagtggaaagtattggcttaagaaggctgattcccaaagggaaaagtccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46710 - DNA, 177 bp, Glycine max
  Peptide Sequence Number=SeqID_138395
gagggagaggccctgacggactcttcgcagtgtaggccttgggggtcattcgatttgagtgctcctttaagcctgtgccgatcctacatggttggagcattctcgcaaaacatcgtgaccccgactggtctccctatgatttcacttagtgagagtgacctgacttacccattgtga

SEQ ID NO: 46711 - DNA, 254 bp, Glycine max
  Peptide Sequence Number=SeqID_138396
gattttacaaggatagtggaaatcttaagcggtttgcttggggactgaacagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 46712 - DNA, 797 bp, Glycine max
  Peptide Sequence Number=SeqID_138397
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggattatctcaagttctcaacagctacagttgcagcagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46713 - DNA, 435 bp, Glycine max
  Peptide Sequence Number=SeqID_138398
atgaccatgattacgccaagctcgaaattaaccctcactaaagggaacaaaagctgcctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 46714 - DNA, 453 bp, Glycine max
  Peptide Sequence Number=SeqID_138399
atggcttccaactcccaccaattcagtgcaagaaatgatgctattgtccttagaggagtccatgatgtgcaatttgaagtcaatgagcaacctgaagcctatgctacaaacatttataatagaccccctcagcagcaaaaccaacaacaacagaataattatgatctttcaagcaacatatacaatccaggttggaggaatcatccaaatttgagatgggaaaaccctccacaaccacaacagcaacaacaacaacctatccctcttttccagaatgctgctggtccaagcaggccatatgttcctcctccaatgcagcaacaacaacaaagacaacaagaaactgaggccccgtctcaaccttccttagaggagttagtgaggcaaatgaccatccagaatatgcaatttcagcaagagacaagagccttcattcagagtctgacaaattag

SEQ ID NO: 46715 - DNA, 777 bp, Glycine max
  Peptide Sequence Number=SeqID_138400
atggctccgaagaaactctccacgaagaggtctagaagagacgccacagcagaagggtccagtgccgcccccaagtttgatagtcatcgtttccagagcgccgagcaccagcagcgctttgaggccatcaaaggatggtcgttccccagagaaaggcgtattcatctcagggaggatgagtatacttactttcaggaggagatagctcgcagacgttggacgccactggtgactcccatggccaagtttgaccctgagatagtcctagagttctatgctaatgcttggcccacagaggagggagtgcgagacatgcgttcatgggtgaggggtcagtggattccgtttgatgcaaatgccctcaaccagttcctgggtgacccgctagttttggaggaaggtcagcagtgtgagtttagccaaaggaggaaaagggccgatgggttcgatgaggaagccattgcccaactgttgtgcacaacggggcaggatttcgcccggactgctgtagggaggcggcgatcacaactccgagaagtaatccgaccgctgatcacccgggccttcatcgagaagtactgcacgcctaggcaggcacaaggtgatgcacatcaggccacaaacgcactgccaccacctcggcaggccgatcccactgggtccctaggcatggagcgttatctacagcatttggttcaccaacaggcggctaaccaccgtgggcaggtgcagatacatgagtgtctctaccgattcagcctcagccagcaggggcag

SEQ ID NO: 46716 - DNA, 267 bp, Glycine max
  Peptide Sequence Number=SeqID_138401
atgcaaagttcaaaatgtgatgtctatattggagcctacctaaatgggccaaacaactactttaagggaataattaacagtgctttaaaaggtcttgatgatgctccacaacctaagtcaaaggctcctactaggtggattgtcgtcaaggcagctgtgtctccgacaaaaccacctcaaaagccagatccggaggtcgatgatccgctttatctgatgacatcgaccatcacaaagcttttcctgaggctttaccaggttacatag

SEQ ID NO: 46717 - DNA, 582 bp, Glycine max
  Peptide Sequence Number=SeqID_138402
atgcagagccctattatgtcctctcccctcggcggggatttcctcttcagcgaaggtgaggtagttgttggccgtgatgttattgacgattcccccaaagccttctacggagatgtcttgggctacatgagcttcattcaagacttttaccagcaaagctcgatgaggcccagagctcatgagcagttccagaaggaagactctagctggggttttgttgatttgttcaatgaccttgaactcgctttgttggataatgtggaggaactcgttggcctcctcgagcgatacctctttcttgccacaaccttcacttccctcggaaagatccttcgtcggaacatcctcgtccggtgtgaggatcactttgatgttttgtccttccgtcatccttgctttccctttagtgttcgtgggctgtattggcaggctaggggtgcgaacatgcgaccgctgcgggttatgccgctcagcccggtgatattggtcactttggccgatagtgagctgatattggtggcttcttccttcctaatgcccagaggggcatacctccacggaattgcacggctgttctcgtaa

SEQ ID NO: 46718 - DNA, 303 bp, Glycine max
  Peptide Sequence Number=SeqID_138403
atgacatctgaggcaacaaaggaaattgctgacaagattgattcgttggaggagcagtcctcgcagggttcctttgtcgcccatggacgttatgttgtactaactactgccattgggcgactagaataccctcgtcatgtgtgtgttgctggagccggtgtgacgatcaagcaatactctttgtccatggctcccagaaaaaggagagttgtgttaatctctcagggaacgattaagacatgggtgactcagagaaatgcgggttatacatcgaagaaaatcctccccgcctggttgccctag

SEQ ID NO: 46719 - DNA, 561 bp, Glycine max
  Peptide Sequence Number=SeqID_138404
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatcgtcagcccaaatcagcctccattgtctctagttaagaaatacgaggcttggctggatgtggtggctcatgcctataatttcaacgttttgggagatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 46720 - DNA, 165 bp, Glycine max
  Peptide Sequence Number=SeqID_138405
atgccaatgtttgagccttcttataagaggaatggtgtcgaaggccagattctagatctagacactgtggtgaaagatggggttttgggtggtggtgttgattttggggttgtaagaaataagattatcgttaatgcattatcatcatcaccacctacaccatga

SEQ ID NO: 46721 - DNA, 380 bp, Glycine max
  Peptide Sequence Number=SeqID_138406
gagaggccaagaggtggcttcactcatttaagggtaatagtctgaaaacctgggaagaagttgttgaaaaatttctaaagaaatacatcccaaagtccaagactgcggaagggaaagctgctatctcttcatttcatcagttccctgatgaatctctgagtgaagcattggagaggttcaaaggttgtaccatctatggtgaggctcatgaaataggccaatgtattcccattgaagaaaacactcaagaaattcattatatgggaaatcaacagcgacaagggtatactcaaggaggattttcaggcttccagcagggttcttataatcaacaaggacagtggaggtcacaccctggaaatcagttcaacaaagactag

SEQ ID NO: 46722 - DNA, 309 bp, Glycine max
  Peptide Sequence Number=SeqID_138407
atgggtcgcttccattgggaccacatcacacagcaccctatcattatatctctcaatggtgagacacacctcaacctgttgagtcacttttacctcttcatcttccacttcttcttcattgattttagactcactagtgatttctccatcagccttcatgagcatggtcctcctgtattggatgaggaagtggaggtgttatgtttgcttccacctacactggacactgctgactttccatgcggggatgtggctacagggctggacaaattacctccctccttcttggatctgttggcccagttctag

SEQ ID NO: 46723 - DNA, 415 bp, Glycine max
  Peptide Sequence Number=SeqID_138408
gtcaaccactaaaggtgcaccgaagaaaccgataaatagaaaccaaagatccacaaagcgtgatctgtcttattgggagtatgttgatgcttttcattctattcaaaacagaaactcttcagtgaaacgtagtgcatcatcttctgacccgctgaagccaacaaggatcatcccgatgttggatcaatttgagccatttatacagggtttcattgacaacattgtggatgttaaagcgaatggtaactgtggatatcggtccattgccgctttattagaacttggaaaatggtcgcatgactacatcaacctctttggtggcacagagagatttgacgaattaagactgtccctacttgttgatgggttttccaaggttagtgtggacaagtggatggatataatgaagatgtga

SEQ ID NO: 46724 - DNA, 315 bp, Glycine max
  Peptide Sequence Number=SeqID_138409
atggggaattgcgatgaacgacccaaagttgcgctaagcccaattccaactgagaggaagtgcgctgagtgcccagagggttataaatacgtccttagcatgaaaaacacgattttcactctcctcttcccccaaaaacgtctcccaaaccctaaaaccttattttccaccacccaagaccactggttgccgccgttgcttgccgttggatccccacaccaagaggaacactttaatcggagcagaatccttaaaatcctcctcgaagattcaatggagaaaacccctcaatcctccatttcaaagtttctctga

SEQ ID NO: 46725 - DNA, 168 bp, Glycine max
  Peptide Sequence Number=SeqID_138410
atggatgtggccagtaatggcagaaacttcaagaccatcgtaaagaagacggagaatgttgtcattgtcgaagaacagagagtggagaagttgagggaaatgagtccactttatgaatttgtcaaggaaggtatcaacatcaaggacattcaatgggcacagcactga

SEQ ID NO: 46726 - DNA, 608 bp, Glycine max
  Peptide Sequence Number=SeqID_138411
atggcaaaaatcaaccaaggtaagacgatgaccggtcacgattggccgtgtatttttgtttcctacttacaggtacatagggacggatcgagtggggctagggtcatgaccgaccgattgttgccccttcccggtgctaaacgagcagagaacgtcgctgcaaggcagcccaaaatggccccgaggaaactcgcctcaaagagatccaggaaggataaggcggccgaaggaactagttccgctcccgagtatgatagtcaccattttaggagcgctgaacaccaacagcgcttcgaggccatcaaaggatggtcatttctccgggagcgacgcgtccagctcagggacgacgagtatactgatttccaggaggagataggtcgccggcggtgggcatcactggttacccccatggccaagttcgatccagaaatagtcctcaaattttatgccaatgcttggccaacagaggagggcgtgcgtgatatgaggtcctgggtgaggggtcagtggatcccgttcgatgcagatgctatcggccagctcctgggatatcctttagtgttggaagagggccaggagtgcgagtatggccagaggaggaaccg

SEQ ID NO: 46727 - DNA, 171 bp, Glycine max
  Peptide Sequence Number=SeqID_138412
atgctggaagcggcaactgcaaccacattggcttccattatcttcttcatgctcatcatggcctccatcattgcggccatttgctcttgtacctcctctacttcacccattactctagctcagttgagaaatgggtttataatcccaacatggttggctcatggtacctaa

SEQ ID NO: 46728 - DNA, 538 bp, Glycine max
  Peptide Sequence Number=SeqID_138413
gtgcatggtatttccatgatcattgatcaatcattgctattttctttgactaaattacctagtcaaggtgcaccttttgagggcaccattgttgatgactggaaatttgattattctagtcatgatgctcgccgtatggtttgtaatgaccagtctgaaatgaccggaggacttgattttgatgtgggtttccttaccggtcgtcagatcgactgggcttacttggttcggtaccgaatgcataaagcattacgggccaatgcacctctcccttaccctcaattggtcactctgtttctccatcattttcaaattccacttgatgatgaaccttttgttcaagtcaagcgttcctttgctattggtgctggggcagtcacttcatttggataccgtaaggatcggaatggtcaatggctgaagaaagatgcacttcctccacaagatgagcgtactccttctcctcctcctcagcgagatgattcagcccttatgactgaagttctttccgagttacggggtcttcgtacttatgttg

SEQ ID NO: 46729 - DNA, 171 bp, Glycine max
  Peptide Sequence Number=SeqID_138414
atgtcagtgaaaaatcaccctggggcacttaggaggagaccagtcagggtcacgatgttttgcgagaatgctccaaccatatgggatcagcataggcttaaaggagcactcaaacccgatgacccccaaggcctacactccgaagagtccgtcagggcctctccctcctga

SEQ ID NO: 46730 - DNA, 567 bp, Glycine max
  Peptide Sequence Number=SeqID_138415
atggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaggtggtgaaaatctcagcacaagagttggaccgtgcgaatggactttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgtatgacacgtttgactggggatgtgaaaagagcggcgcaagaattgaaggaagaatcaggattctatcttcatgcgaaggatgtcccatgagaggagtgccatcagacgaaagcatcacgcctttcatcgcacgaggtttcagtgaccacaacgcgagggtactccaaggagttcgcaaggcatgggatgcggcgtga

SEQ ID NO: 46731 - DNA, 133 bp, Glycine max
  Peptide Sequence Number=SeqID_138416
ttctgtcgaccaacatgaaaaggttcaagacttgcttaaggccattgatgaccaattcatcacttcagatagggatttagtgatgcaatcctaccccccaagggcattggatagaagactccaagaagattag

SEQ ID NO: 46732 - DNA, 147 bp, Glycine max
  Peptide Sequence Number=SeqID_138417
aaaattctaatgagggtgttaatgccgatgctttattccccttttctgaaggagaacaggccattcgacagggagactcggaagttgcggagtcttggtttaatcaagccgctgaatattggaaacaagctatagccctaacccctg

SEQ ID NO: 46733 - DNA, 255 bp, Glycine max
  Peptide Sequence Number=SeqID_138418
atggaagacatgatacgtgatcttgggcaagagggatttttggaagctcatgcaccctattatgaagatttggaaacagattccaagttaccgttgtacttggggtgcacaaccttcactcggttatctgcagtgctagctttggtcaacttgaaggctagatttggaaaagagtttgtcgaattgcggaattgcccaacatgtggggtatcacgatacaatcaaaacgatgcggggaatacactgatgatgtag

SEQ ID NO: 46734 - DNA, 324 bp, Glycine max
  Peptide Sequence Number=SeqID_138419
atggaggctcttgctgaaattgcatattatagattgtcatttgccttactaactcctctaaggaaggttgagatgggcgctcagttgcttgttgtctttgttgttgttgctgctattgctgcattggaggaggaacatatggcttgcttggaccagcagcattctggtagggagggacaggctattgttgttgtggaggacttgcccatctcagatttggatgattcctccaacctggattgtatctgttgcttgaaagcagaagcttcaggttgctcattgactccagattgctgcaaagaaggacaaagatctgtatggtga

SEQ ID NO: 46735 - DNA, 659 bp, Glycine max
  Peptide Sequence Number=SeqID_138420
atggagtggtggatattgctgtctctgaacatcaaattgccaaggaaatcactgccaaacaagtccagcattggccaaagaaagggaagctgtctgcagggaagctaagtgtgaaatatgcaatcctgcacaggattggagctgcaaactgggtacccactaatcatacatccactgttgccacagaatcctttgctgtcaaattacccattgccttcccaactgtattgtgtggcattatgttgagtcaacatcccaatattttaaactacactgactctgtgatgaagagagaatctcctctatccctgcattacaaattgtttgaggggacacatgtcccagacattgtctcgacatcagggaaagctgctgcttcaggtgctgtgtccaagaatgctctgattgctgaactcaaggacacatgcaaggtgctggaagcaaccatcaaagccaccacagagaagaagatggagctggaacggatggtcaaaaggctttcagaaagtggcattgatgatggagaagcagctgagcaagaagatgaagcagctgaggaagaggtagaagcagccgaggaagaagaagaagctgctgaggaagaggaagatgcagcagaggatactgaatcagatgatgattccgaagccaccccatga

SEQ ID NO: 46736 - DNA, 382 bp, Glycine max
  Peptide Sequence Number=SeqID_138421
atgactagaggtaatccatctgacttacaaccctttgatcctgagatagataggacacttcatagattagttaggcatcattttataccttttgatcattctgagcattccattactggtgaatctgtgcattctgttattggtgattttgaacatcctgatcttaagcattataattttgagcattctgattctaatcattctgattttgcacattctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcag

SEQ ID NO: 46737 - DNA, 201 bp, Glycine max
  Peptide Sequence Number=SeqID_138422
atgacgggagatgcctcaaagttcacaactatctctcctaggaaaagtgggcatgaaacctatagcgacaacaacagagggcttaagcatagtttgcttagtgttagtcaattatgtgatagaagttgtatgatgataatcaatgttttcttagcaaagacaatgatccttggctatggcataaaaggatcgctcacataa

SEQ ID NO: 46738 - DNA, 213 bp, Glycine max
  Peptide Sequence Number=SeqID_138423
atggcatgcagcgtgtctgcttcgtgcccctattcaagggacctatatgggaggcagctaactaggcttttagtgataattcccaaggtggtcatatctctcttgatggtctctagaggtatcatccccttcaaagaacatattgcagcagtagggactactagcaacaatatgttatcaaagagaaaaactctagatgagggttcactgtaa

SEQ ID NO: 46739 - DNA, 217 bp, Glycine max
  Peptide Sequence Number=SeqID_138424
atgaaaagtgataaagcctcacaagatatacactctatctctcaagcttgtagtgagcttcaaaacaaggaaagggaaacaaggctcaaaagggctatcaaaggaattaattcaaggacgcatcaacaagaatcaagccaaggctattgtgcaagcaatcaatggggcaaaacacaccaaatgattataatgatggatggctcaaattctcacaaag

SEQ ID NO: 46740 - DNA, 287 bp, Glycine max
  Peptide Sequence Number=SeqID_138425
cagcccaagtcgtcccgcctatgactgaaagggaaatgatcacgattatggtagatacgttgcccacgttctactacgagaagctgataggatatatgccggctaactttgcagacctcgtcttcgctagagaaagaatcgagtccggactgagaaaaggcaagtttgaatatgcctccaacgttgtccccaacaacagtagaagagccccagtagtgggcacacggaaaaaggaaggagatacccacgcggtcaccaccaccccaacatggatgaaaacgccctaa

SEQ ID NO: 46741 - DNA, 460 bp, Glycine max
  Peptide Sequence Number=SeqID_138426
atgttggtgcgcatgatccgcacttgtctctttgcagcggcacaggtgaaatcttgccccggtatgcatagtagctgtgtgatagcctccctccctggttgtgctcgcacagttggccctcctccaatatcagggggtggcccaggaatcgtgtggatgtcgagcacactgaaaatgaggacgcgtagtcctctaaaggcgagggcgtgtagccctctgaagttcaggacgtgtcgcctttcgaaggcgagggagtgtagtcctatgatggcaaggacgtgcaatcctttgaaggtgaggacgtgtagtcctctgacggtgagggtaactagtacccaaggtgaggggcgtgtagccctctcaaggcgaggacgtgtagtcctctcaacagtaagggtaactagtacccgaggacgtgtagtcctctcaagcgaggacgtgagtcctctcaacggtgagg

SEQ ID NO: 46742 - DNA, 247 bp, Glycine max
  Peptide Sequence Number=SeqID_138427
aaatgacgaacaagaccaaagaaaaggcaaggaggtcgccggaaaaggttctgccggcaagcgcaagggcgccttcgacgataacatgcaagaccggtggcgaccgaaagagaaacaagcgaggtgtcctttagttatttctgacgacgaattaaatgctgcgccaagaaggatggacatgccagataagggccagagtagcaggccacgtgtcgtccctcaagaggaaatgttggcccgaaactaa

SEQ ID NO: 46743 - DNA, 579 bp, Glycine max
  Peptide Sequence Number=SeqID_138428
gaaagtcatttagctgtgcagtttatggaggaaataagctctgttcctattcagagacaggataaagatactctgctatggatggctgaacctaatggacagtacaccactaaggacgacaacaagccaccacctctggaccttgcagttagtgacactatacataaggaagatgacatgtcagggggaggacttccaccaggaattagccagacatttgggcctgtcctttcaataaccagccttttaatcctgaaaaaggtcatggatgatgccttattccacacttggtcttggcttaatcaaaatcaagtaggcaaggataaatggagggaggatgacttaaccctccaagaaaaataccccattttgtaccaagtgagtaatggcagcgttggggcaattgggaagaatgagcagtggcagatggaggcagctggatacctgaattgtggaggtaccttcaagagtaatatccagattggaagcaattcagaggcaatttctatggggaggaggtgtggaatagagaaagattgcttgggttcattggaaaacagtctgcaatccaaagaataa

SEQ ID NO: 46744 - DNA, 236 bp, Glycine max
  Peptide Sequence Number=SeqID_138429
atgaaagggaaaacacatgcaacttttgcacaaaagattaataggcctaactctctaaaaatagtccccaatggagttgccaactgtcgcaacctaccctttggcgggagggcgacgcgagggctcacgggtgtgtcttccaagggaggaaggcgcccagagtcgccaccaagtatattcgaggaaaacgttggaaaaaccggaaaggtgtggtctacgaactttaagtgtgaaag

SEQ ID NO: 46745 - DNA, 416 bp, Glycine max
  Peptide Sequence Number=SeqID_138430
tcgggaaacctgtcgtgccagctgcattaatgaatcggccaacgcgcggggagaggcggtttgcgtattgcgcgctagcggagtgtatactggcttactatgttggcactgatgagggtgtcagtgaagtgcttcatgtggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccaagccagttacctcggttcaaagagttggtag

SEQ ID NO: 46746 - DNA, 351 bp, Glycine max
  Peptide Sequence Number=SeqID_138431
atggctccgagaaagctttccacaaagagatctaggaaggacgccgcaaccgaagggactactgccgctcccgagttcgatagccatcgtttcaggagcgctgagcaccagcagcgtttcgaagccatcaagggatggtccttccaccgagagagatgcgtccagctcagggacgacgagtacacagatttccaggaggagatagctcactggcgttggacgtcgctggtcactcccatgcccaagtttgatccggatatagttctcgagttttatgccaatgcttggcctacagaggagggcgtgcgggacatgcgggtcatgggtaaggggccagtggattccttttga

SEQ ID NO: 46747 - DNA, 318 bp, Glycine max
  Peptide Sequence Number=SeqID_138432
atgttggtgcgcatgatccaaactcgtctctttgcagcggcacgggtgcttaccccggtatgcatagtgaggcagtgtaatagcctccctctctgggtcgaggacagtgtagccctcctctcaacgccctcatgggctgaggacgcgttaaatcctctcaaggcgaggagtgtagtcctctcaacggtgaaaggccctctgatggtgaggacgtgtagtcctctcaaggcgaggacgtgtagtcctctcaacggtgagggtaactgtagtcctctcaaggtgagggcgtgtagccctctcgaaggcgaggacatgtag

SEQ ID NO: 46748 - DNA, 979 bp, Glycine max
  Peptide Sequence Number=SeqID_138433
atggcctttgctgctggcaataacgatgctttaggttgggctacaaacggtggtgtagaagatggaccaacatcaacattgacctctacagcgctttttacgactttattgggcaactatgtaacgacattaaccgcaggaggtcaaaaaggggtactggcaacaattcccgatgtaacggcaacaccttattttacaactgttacacgggcagctttattggcagcggtgaatgcaacaaacccgccaactccggtaactaatatttatatcgccactaaatcgggtccccgtgcggctacggatcaagattattttgtacttcctttctcctctatgggattattaggaaaaccaaatgaagcgcaaattccttatggcttacatccattgaaccctgtggaagacaaatatgtattggatgtgagcgaaacagcaacagtcgtgcaacgcatcaatgaatataatgcagctatcaaggctgccgcagattcaaaaggcctggctttagctgacgtacatggattcctgaacaatgtaaaaggtggtgtccgtatcaatggattagccgttagtgcaaaatacattactggaaatgcattctcgctggatggaatacaccttacaccaattggaaatgcattgatggccaatatctttatcagtgccatcaattctaaatatggttcaaaaattccacaagttgacgtagcgaaatatcgcggtgttaaactgcctgataccatttcaattagatctgttgttaccaacgatgggctattcgctaaacttgccagcagtgaattatctcctgtcaaagtcaacatcgatggttcggaagccatcggcggtgaaggaaaaggcgttcgtccaatggaattggttttaatggcactgggttcttgtagcgtattcgatctccatagcatactggtaaagcaacgccagcaaattgatgatatccaggtcgaagtggaag

SEQ ID NO: 46749 - DNA, 888 bp, Glycine max
  Peptide Sequence Number=SeqID_138434
atgaaggaatgggaagaatgggaatgtaaaggtgtgacgggtgcttttccacgtcttcaacgtctttccataaaggattgtcccaagctgaaagggcacttgccagagcaactatgtcatttaaatgatctaaagatttctgggtgcgaacaacttgtaccttctgctctcagtgccccagatattcatgaattggttggtggttctcttctttctgctttccttcaggttgcatttgagaagcttgcttctcttcaagttcggggcttctttcgtggaagaaagcttgatgaaaagctgctcaacaacttggaaatcaagctgaactccatacaggctctggctgatgatgcagaactaaagcagttcagagatccacttgtcagaaactggcttcttaaggtcaaagatgctgtgtttgacgcagaggatatcttggatgaaatacaacatgagatctccaaatgccaggtcgaagttgaagctgaagctgagtctcaaacctgcacttgcaacgtaccaaatttcttcaaatcttctcctgctagttcctttaacagggaaattaaatcaaggatagaacaggtccttgagaaccttgaaaatcttgctaggcaaagtggctatctaggtttgaaaaatgcaagtggtgttggatcaggatttggtggtgcagtatcacagcaatcacaatcaacatctttgcttgttgaaagtgttatttatggcagagatgatgacaaagaaatgatcgttaattggctcacatctgacattgacaattgtagcgaactatcaatactttctattgtgggcatgggtgggttggatgaatttgatgttttcaatgtaacaagaacattcttgtggaagtcactaaatcactga

SEQ ID NO: 46750 - DNA, 63 bp, Glycine max
  Peptide Sequence Number=SeqID_138435
atggctgagggtcacagagtttggatgatgcgacttccagagagggaagataagtcagggtaa

SEQ ID NO: 46751 - DNA, 264 bp, Glycine max
  Peptide Sequence Number=SeqID_138436
atgtgggaggatgaatttgtgcgatgtagccagtttccttctttgatccttaaggacaaggctgtagctccaagaaagggccatagtccaaagaaggtcaacttggttgctgctctggttcgtggtatgcttgttaaagatgcatcgatgcagttggaatcgacaataaaacgagcagcaaaaactgtatatcaggttaaagagttccatagaagagttggttttgaggtagcaagtgctgacaagatggctaagtcatgcatg

SEQ ID NO: 46752 - DNA, 174 bp, Glycine max
  Peptide Sequence Number=SeqID_138437
atgacgacgaataactatttcagaggtgaagcagtgaaaaaggtttggctaaaccgttatcccgccgatgttccggcggagataaatcctgaccgctatcaatccctggttgaattgtttgaacacgccaccacccgttatgccgatcagccggcatttatcaacatgggcgag

SEQ ID NO: 46753 - DNA, 198 bp, Glycine max
  Peptide Sequence Number=SeqID_138438
atgcagcagcgaggaatcggtgtttccgaatggaccattgcttacatggcaggaatggctcgtgccatacgtgcgtctcaaactggcgatttagggcaggagtcggattgccggcggtgcaaaagtgcaacccacttccttggaactagcgccaacttcgggacgtgcgcttggcaacggcatgttttgtcctcgtag

SEQ ID NO: 46754 - DNA, 186 bp, Glycine max
  Peptide Sequence Number=SeqID_138439
atgccacttgtagaaggggatttagaagcagtagcaactccaaaagaagaacctcgatcttccgaggcatcttctagttttcctattatagggcattctcatatagaacttgttgaagacccaatcatggctgaagagccaagaagagtaaccctggaggattattcaagttctagtgtgccataa

SEQ ID NO: 46755 - DNA, 651 bp, Glycine max
  Peptide Sequence Number=SeqID_138440
atgcatctcctgcgccagcgcgctcagcgtatcagcgcgccgctgcgtgtcattgtcactatggcgcgaccgccggccaaagcgcgcatcacgcaggcgcagcaccggatagtacgcgcgcaactgcgccagcgcggcgtcggtgcccgccagcggcagcacctcgccacgcgcatcaataaagcaccagcgggttttgacttcgctgccctggcgcgtcgccagcgtactgaagcgcaggtagcgccccgcgtcatcctgctgccagaacggcgcaaacagcgcttcatgctcatcgtcctgcgcgcgaaagcgaaacaccagctgcaacttatgccgccgggcttccacctcaccgggcggaaaatggaagtcctgttcggtgaacatatagggctcagcggccggtgccagcagcagcaatcatcgcgcagtccctccgtgctttgccagagcatgggtccgccgcgctgcgttggtcaagtcggcagcgggagaaaaggtttacacttcaggcgttttccattagcgtggcgtctcgcaaaaaaggacgtcatttttcatgtataccggactgcttatcattctggtgccgctgatggtgggctatttgctgccgtggcatcagcctgcgctgttgcagcgcgttaa

SEQ ID NO: 46756 - DNA, 878 bp, Glycine max
  Peptide Sequence Number=SeqID_138441
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcattaaaagactctggactaactggtcgataagattcgtgtttaagattgaaattaaggttgaatcaaaagcataccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46757 - DNA, 234 bp, Glycine max
  Peptide Sequence Number=SeqID_138442
atggcatgttgtaatcgattacacgtgtattattgcagttatacatgtcctgaggctgtcgtaaaatttatgcttgagaggattgatggggacccggtgttgagagaacacgaggagatgggctacgtgggagtacgtgagctcgttggaggtgggcaacaggggatggtgggtttatcagcgcattgtggatgtggaaagcttgtgcacccatcgcccgaccatatcgtctag

SEQ ID NO: 46758 - DNA, 1069 bp, Glycine max
  Peptide Sequence Number=SeqID_138443
atgaaacccgcgccgacgggcgcggtcgcgccgccagcatacaacgcggattgttggcgcatcgcttcaagccgtgtccggatgcatctcgcgcgccagcgccagccaggcctgcgccgcgggcgacaggtaaccgccacgccgccacaccagtcccatctcccaatccgtatgggcatcgcgcaacggcaccagcgccacgcccgcgtgccgttcttcctccgccttgacgcgcggcaggaaggccacgcccagcccggcgctgaccagcgccacgatgaagtcgatctggccgctcctcgcggcgatggccggcgcaaagccggcgcgccggcaagcctcctggatgatgcggttcagggcgaagccggtctcgaacaggatgaagggggagtcgcgcaattggtcgaggccgacggtggcggcccgggcgtgcgggtgatcggccggcagcaacgccaccagcggctcgcgcgccaccggttgccagtcgaaattgtcggagtccggccgcagcgacgccgccagctcgatcccgccggccatcaccatttcttcgagccggtggccgccgtgttccagcaggctgatctcgatgtgcggatagcggctgcgaaagcgcgcgaacatcggcgcgaacagcgtgctgctgcccagcggcggcaggcccagccgcagcacgccgcgcttgaggccgcgcagctcgtccagttcggcgtacagatcgtcgcgctcggccaacatcttcacggcgcgccgctggcgcacggccttgctgaccgtgggctgggtggcgaaaaccgctttcgcggcctgggagaatccgccctggcggaccacttccaccagcgcgcgcaaggggcgcagatccatgggggtactggccaacgccgccggcctgcccataccgggcggtgtcatcggcatggtgctggtgctggccctgctggccgccggcctgttgcgggtgcgcaatgtgcaccggggcgccagctggctgctgggcgagatgctgctgttcttcgtgcccgcggtgatgtcgctgctggaccatcgcgaattcctcggc

SEQ ID NO: 46759 - DNA, 444 bp, Glycine max
  Peptide Sequence Number=SeqID_138444
atggtgaaagttggaacctcttacgtgccgatcaacgtctcattttcgccaaaagttggcccagggcttcccggttcaacagggacaccaggatttatttattctgcgaacgcggtcgtcttccgcctgccacagtcagctttattcgcaataccgtgcgcctcggggatgcccgaacttatgactttagtgtatgatggtgtttttcgaggtgctccagtggcgttctgtttctatcagctgttccctcctgttcagctactgacggggtggtgccgctcacaattccacacaagcataccgaccggacatcagcgtggcaagtgtagccggggtgcagacgctgcagctaactcaccattaattgcccgccgcgctcactgcgccgctttcacagggaaacgcggtgtcagtgaagtgcttcccatgtgcacgacgttgtaa

SEQ ID NO: 46760 - DNA, 348 bp, Glycine max
  Peptide Sequence Number=SeqID_138445
atgactaccttgacccagatatggatgacactgctgcatagcaatgtcttgcctagcgaccacaactctgacctccctctgcctaagtgtcaattggcacagggcaacgcacatcaggacgcgggcgcaccgccgccacctcggcaggccgattcggttgggccactgcgcgtggagtggtatatatatcatttggttcgccagcaggcggccaaacaccatggacaggtgcagatacatgagtgtctctaccggttcagcctcagtcagcagggccagggttccgccccttttgtatgtcgtaccccaaagcagtttggggctgaggtcacatggcctggtgactag

SEQ ID NO: 46761 - DNA, 363 bp, Glycine max
  Peptide Sequence Number=SeqID_138446
cggtggagggacctggcagcacaagtggcccctcccatggtcgaaagggaaatgattaccatgatgctagacacattgccaagagggaagttttgattaaggtctcctccacaagtaccaaccaactagaaggatcggagcaactggggcaaaaaggaaggaaggagatacccatggtctcttcaacacccgcatggatcaaaccccagcaaacacctcacggtacccatcagtacgcgcaacatcacccaagcttctcggctcatgctgggaacgcctctagctcaacacccgtgcagcctaaggcacccacccagagggaagctccccaagttccaactccgaacacgcctcgactggccg

SEQ ID NO: 46762 - DNA, 180 bp, Glycine max
  Peptide Sequence Number=SeqID_138447
atggagaactcaaaacacttggctactcctatgagcactggttgctaccttgataaagatgagtccggtcaacccgttgatgaaaagcaatatagagtaattagaaataaagctagaatagttgcaaaagggtacaaccaagaagaaggtatagactatgaagaacctttgcacctgtag

SEQ ID NO: 46763 - DNA, 196 bp, Glycine max
  Peptide Sequence Number=SeqID_138448
tggaagtgaaagaggagtgaaaaagaggaagattgggctttacgggatgtgttttggtgaagatttgagtaagatacgaaggtttgaagatttagggatggacgaggcacgaggagaagccttggctgtgcagcaacactggtttcgtggtatttatagacgaggacgagttgtaatcgattacaaggcttggtaa

SEQ ID NO: 46764 - DNA, 306 bp, Glycine max
  Peptide Sequence Number=SeqID_138449
ctagtgaaaatggtggtgtatatcatcaactggacgaatctcagcgcctatttctggacgcgatgactacacaaatgcaacatttgttgaactgtaacaaagaagagctctacagacgaatagcgaaatctcccttgtttactcttaaacctctatctcctagagaagtgtgtgatgaccaaatcagaatgagagaaaagagagaacaagagaaagaaaatagtgaggcaccacaaaggaatatgaaaaagaagagtgatacacccgatgaaaagagtgatacacataagagagagagtgatacac

SEQ ID NO: 46765 - DNA, 490 bp, Glycine max
  Peptide Sequence Number=SeqID_138450
atgggtgatcaagagaagacacaggaacagatgaaagccgacatgtcggctctgaaagaacagatggcttccatgatggaggccatgttaggaatgaggcagctcatggagaaaaacgtggccaccgctgccgctgtcagttcggctgccaaagcagacccaactctcttggcaaccgcgcgccatcctccctcaaacatagtaggatggggaaggaacacgctggggcatgatggcaaccctcatctgggatacaaccgagcggcttacccttatggattgccgcccaactactcacctcctgtcctgcaagacgatgcgggccatattgcttctcctgtccttgaaagagagcctccccaacagcccgacgaggtccacgaagaccctcaagactatgctcgaagggatgtcgagttctatcccccgatcctcaaaagaccggcacccagcacatttgcctcagcccaacgtcacgacacaaccaata

SEQ ID NO: 46766 - DNA, 594 bp, Glycine max
  Peptide Sequence Number=SeqID_138451
atggctccgaagaaactctccacgaagaagtctggaagggacatcactggagaaggctccagtgccacctcagagtttgatagtcaccgtttccggagagccaagcacttacagcgctttgaggccatcagaggatggtcattccacagggagaggcgtgtccagctcagggaggatgagtactcggacttccaggaggagatagctcgtaggcattggaaacctctagtgactcccatggccaagggtcagtggattcccttcgacgcagatgccctcagccagttcttgggtgacccgctaattttggaggaagaccagcagtgtgaattcaaccagaggaggagccaggcagatagtttcgatgaggaagccatcgcccagctgctatgcataccggggcaggatttcgcccggaccgctgcagggaggcgggtgcagatcatgcgcaccagtatgactactttgacccagatatggatgacacttctgctcagcaatgtcttgcctagcaaccacaactccgacctccctctgcctaagtgccagttggtgtatgccatcctgacacggatgagcgttcacgtggcctag

SEQ ID NO: 46767 - DNA, 537 bp, Glycine max
  Peptide Sequence Number=SeqID_138452
atggtgaaagttggaacctcttacgtgccgatcaacgtctcattttcgccaaaagttggcccagggcttcccggtatcaacagggacaccaggatttatttatttggaagtgatcttccagtacacaggtatttattcggcgcaaagctgcgtcgggtgatgctccaagcttatctgatttacgtgtatgatgggggggcccggtaccagcttttgttcccttttgaggttgtccagtggcttcatgtttctatcagctgtccctcctgttcagctactgacggggtggtgccgctcacaattcgcacacaacataccagccggacatcagcgctggcaagtgtagcgggggtgtccagtgaagtgcgttcgtcgaaaaaagcgacggtgcgtcagtcagaatatgtgaatacagactcactattccgggcgaattcctcgctcactgagctcgctacgctcggtcgttcactgcggcgagcggaacagtggcttaccaacggggcggaattcggagatgcaggaatgatcttaaag

SEQ ID NO: 46768 - DNA, 730 bp, Glycine max
  Peptide Sequence Number=SeqID_138453
atgttctcatcagaagaacaacggatacagtacacaaatcttttctcctctcattccattatcgaccctaagttcatagacatggatgtcttctccaatgagaattttgaatgcattcagacatttcaaaattcaaatgtcattccttttatgtcattgaaattgcctgtttattctgaattagttaaagccttttattctaacctcgaaattcaagaaagcactttgatttttgaggtttttgggataaaaatggtcattgaccaatccctattctatgacttgacccaattatctagtgaaggtgtaccatttgaaggtacactgaatgatgattggaaatttgatttctctgtacatgatgaccgccggttggtttgcaccaaccaaacagatatgaccggaaggctgcttgtcggttcattggcttttgaaatccgcatccttcattatctcattgtgcgtattttgcttccaagatcttcaaaccttgcacaggtttctgaggaagatcttattgtcatgtgggcttttcataccggccgacaaattgattgggcacacttagtccgatatcgcatgcataaggcattgcgattaaatggtcattttccatatccacacctagtcacacttttccttcaacactttaacatccctcttgattctgaaccttatgttccaatcaagagatccttcttgatcggtgctgctgtgattgcatcttttg

SEQ ID NO: 46769 - DNA, 201 bp, Glycine max
  Peptide Sequence Number=SeqID_138454
atgcctataggtggagctgatattgaggaggaggaactaacatatttgaggtcaaatcctcttcaaggggaaggggatgatgcaatcctccctaggaagggaccagttactagaaccatgagcaagaggctccaagaagattgggctagagctattgaagaaggccctaggattctcacgaacctcaaggtagatttttga

SEQ ID NO: 46770 - DNA, 546 bp, Glycine max
  Peptide Sequence Number=SeqID_138455
atggctcacgcagtcgcagaaggtgcaaacagggtggacggcgttgaggttgtggtgaagcgcgtaccggaaaccatgcaggcggaagccttcgccaaagccgggggaaaaacacagaatgccccggtcgccacgcctcaggagctggcagattacgatgcgattattttcgggacgccaacccgtttcggcaatatgtccggccagatgcgcaccttcctcgatcagacgggcgggctatgggcctcaggcgctttatacggcaaactcgccagcgtcttcagctctaccggcaccggtggcggtcaggagcagacgattacctcaacctggactacccttgctcatcatgggatggtgattgtgccgattggctacggcgcgcaggaactctttgatgtttctcaggtacgtggcggtactccctacggtgcaaccaccattgccggcggcgatggttcccgacagccgagcgacgaagagctcgccatcgcccgttatcagggtgagcatgtcgcgggcctcgccaaaaaactgaacggctaa

SEQ ID NO: 46771 - DNA, 303 bp, Glycine max
  Peptide Sequence Number=SeqID_138456
atgcacacaccaagtttcacaattccacaatttcctaaaataggcctaactcacaaaaacagtccccagtggagtcgccaactgtctcaacctacccttttgtgggcgagcgaggcgaggctcacgggtgcgtcttccaaaggaggaaaatgcgcggagtctccaccaacgtttatttgtggaaaacgttggaaaaaccgaaggaaaccggtcatgaagaatattccagattcgggagttgtatttacgtttgaggaaggtattagcacctctcacgtttgtcccaaaggacaacagccttaa

SEQ ID NO: 46772 - DNA, 450 bp, Glycine max
  Peptide Sequence Number=SeqID_138457
atgcataaggcattgcgattaaatgctcctttaccctatccacacttagttactttgttccttcaaaattttaacatccctcttgattctgaaccatatattccaatcaagagatctttcttgatcgatgctactgtggttgcctcctttggttaccgcaaagagcgtgatggctcttgggtaaaaaagggtgctcaaccaaatgatgatgaaggacacttaccggttgaaggggactcttctctccttcagagtattttggacaggtatgatggacttcaaacctatgttggtgaaaggattgtcatcatcaaaaagggggagattgtggaagcaatgacttccaagattattttgatgatgccaaagaatcaagagttaagtaaattccaaagattcaagaatcaagtttcaagaatcaagagaagactcaatcaagataagtactaa

SEQ ID NO: 46773 - DNA, 228 bp, Glycine max
  Peptide Sequence Number=SeqID_138458
atggctccaaagaagcttctagctaagagggcaaggaaagatgccgctggagaaggatccagtgcggccccacaagtggatatggaatttgatggacatcgattccgaagcgaggaacaccaacaccattttgaagccatcaagggttggtctttcatcaaggagagacgggtccaattgagggaaggagaatatgctgagttccaggaggaaattgctaggaggtag

SEQ ID NO: 46774 - DNA, 531 bp, Glycine max
  Peptide Sequence Number=SeqID_138459
atggtgaaagttggaacctcttacgtgccgatcaacgtctcattttcgccaaaagttggcccagggcttcccggctgtccttcctgttcagctactgacggggaattggtgcgtaatcggcaaaagcacacgccggacatcagcgctggcaagtgtagcgggtgcacaaggctgacgcgtaactcaacacccgccgcgcttaatgcttgccgctacaggcgcgtcccattcgccattggtgcgcaactgtctgggaaagggcctgatcggtgcggcctcttcgctattagacgccagctggcgaaagggggatgtgctgcaagtttgcgattaagttgggggtcagtgaagtgcttccaccgcggtggcaggctagaaaaaaggctgcccgggctgcagcagaatatcgatgatacagatatattccgcttcctcgctactgactcgctacgctcggtcttcgactgcggcgagcggaaatggttacgaacggggcggagatttcctggaagatgccaggaagatacttaa

SEQ ID NO: 46775 - DNA, 323 bp, Glycine max
  Peptide Sequence Number=SeqID_138460
ggccctggggtttccagctttggttacgggcctctgtagtcctacagggtgctcgttccccccggcaaggtcacgtcatcatgacatagggatcgcgcctgcaagacacccagtggacccgaagaagtccgacaggttctacggagtgcctgtcgcccccaacaaggtcatcaggccccctactaatcgagctttcatcaagaagtactgtgcccccaggcaggcacagggcgaaacaccacagcagcctggggatggccgacagtgggcaacagacgcactgccaccacctctagagttcacctcagctcatccacaaaaag

SEQ ID NO: 46776 - DNA, 204 bp, Glycine max
  Peptide Sequence Number=SeqID_138461
atggatcgcgcccacaagacacccagtggacccggaggagcccaacagggccctgaggttcctagctctggttacgggcctctgttagtcctacagggtgcccgttccccccaacaagggatcgcgcccacaagatacccaatggacccggaggagcccaacagggccctgaggtttccagctctggttacgggcctctgttag

SEQ ID NO: 46777 - DNA, 863 bp, Glycine max
  Peptide Sequence Number=SeqID_138462
aaattgagatccagactgttgctgtccttggcggccattgtcgtcgcgggtggctatgtctacaaaaacgttccggagaacggccaggcctcacagcaaacagcacaagcatccattaccactgaggagtacctgagtcgttttgatcctgaacggtacatgcgtatcgggacggactacttcaatccgagatacagcccgagtcgactcaataagccgattgatcagatcgacataacgtacgactacccatttgcgtaccttgccaaggtcgagaaaaagctggcagatgttgaccgtctgactgccctgcgagagatcttcaagaaattgaccgcaggcgcgaaaacaaaccaggaacgccacctggccgtcctggacttcctctacaaggcggcgtaccacaatccgtatgtccaaccgatgtacgaagacaaacaagcagtattcgatccgattgtgcttctcaagctgggcgaaatgcgttgtggtggtgttgcccgtgttgccgcagacttgttcgaagcggcgggctacaagaccaggctggtgcaagcccatgcccatatcaccacggagatttattacgacggaggttggcacctctttgaagctgaccttgtgggcggcccccccgtaatgatcaatgggcgtatcccttccgttgccgaactcgcaaacaacccatttctcatcgataagtccccttctcatttcctggtgtacgtggctccggggccaagtggcgggggggataaatctccagtctatccgtcctactactacttctccagtcaagccctggcgggccttgacgcggcttactactacagaccgccacgccggagagctgcggactccaa

SEQ ID NO: 46778 - DNA, 798 bp, Glycine max
  Peptide Sequence Number=SeqID_138463
atggcggaatacagccagccgggcgacatgatggtggtatcggccgccggcagtaccaccaaccagttgatcaactggctgaagctcagccagagcgatcgcctgtctgcgcaccaggtgcagcagacgttgcgtcgttatcacagcgatcttatcagcggcctgctgccgccggaaagcgccgagccgctgatcgccgagttcattcaggatctggaacgtctggcggtgctgctggacggcaaagtcgacgaggtgtgctatgccgaagtggtcgggcacggcgagatctggtcggcgcgcctgatggcggcggtgctcaaccacctggatatgcaggcggcctggctggatgcgcgtgatttcctgcgcgccgagcgcgccgcgcagccgcaggtggatgaaggccgttcttatccgctgctgcagcaattgttggctcaacatccgggcaagcgcctggtggtgaccggcttcatttcgcgcaacgacgccggggaaaccgtgctgttggggcgtaacggcagcgactactccgccactcaggtcggcgcgttggccggcgcggcgcgcgtcaccatctggagcgacgtggccggggtttacagcgccgacccgcgcaaggtgaaagacgcctgcctgctgccgctgctgcgcctggacgaagccagcgagctggcgcgcctggcggcaccggtgttgcatacccgcaccctgcagccggtctccggcagcgatatcgatcttcagctgcgctgcagctaccagccggagcagggctcgacgcgcatcgagcgc

SEQ ID NO: 46779 - DNA, 513 bp, Glycine max
  Peptide Sequence Number=SeqID_138464
atggtgaaggaaatgatccacggtaacaagagaaatggtgaaggaaatgatccacgactttactttccttcttcttcttttccttctgcgttttttcctctattttctttttcagaaccccttaacctctccccctacatgactatttatagagaaagccatttggtgcaggggaagctcgcccaagcgagctgcttgcttaggcttgaagtcattagctcaccctggcgagtagcttgcttagggctgaatctttttcttggcccaagcgagctagatgctagcctgggcgagtttaggggtctagcacctaccttgtttgataccggaacttttaaccccagagcagttttacaaaacatttatgctcctttttctccgaatctcaagaatcctaacagagcaaccgaaggaggagctctagagagcaccaaaaataccatcattgctaatggagaatgcttgagcgactacatcgaggtaaggaatgagttactcacacttggggattag

SEQ ID NO: 46780 - DNA, 1083 bp, Glycine max
  Peptide Sequence Number=SeqID_138465
atgccggtcgcgcagtttccaggtgagagaaattggggttacgatggtgttttcccatttgctgtacagcaatcttatggtggtgctactgagttccagagattcattaatgcttgccacgaggtaaatatagctgttattttagacgtagtttataaccacattggaccagaggggaattatttgccgaatttcggtccatattttacggataaatatcataccccctggggcgaggcactcaactatgacgaccgtttctgtcatggacagcgcgacttcgtgctgaataatgttcgcatgtggctggaagactttcatatcgatgctcttcggatggatgccgtgcatgcaattaaggatttcagtgcagtccatatcctgcaggaaattcgtaaagaaacagacgagattatcgtcaggtcaggtaaacagcgctttctatctattgagtgtgatctcaatgatagacgatttctggaccctttggcaaaaaatggctttggtatggatgcgcaatggctagatgaatttcaccacgccttaagagtaacagtaggcgaagccaaaagagggtattatgaggagtttaatgggttggatgatctcgcaaaggcctacgagaaagcttacgtttttgatggtaactattctttccatagagaaaaattcttcggaacggataccaacggcattagcggtaatcgattcattgttttctgtcaaaatcatgatcaggtgggcaataggatgctgggcgatcgtgccgcctcgctttactcaaaagaaagaacgcggctcatggcatttgccgttttcatgtccccttatcttcctttagtgtttatgggcgaggaatgggggacagaaagggcctttccatattttgtcagtcatggtgatcccgaacttgttgaattggtgagagcgggcagaaagcaagagtttgaagactttcataccgattctcaaattcctgacccgcaggatgaagcgatatttagaaaggcgatctttggatttgggacgaacttaatctttgaatcatatcagcaacactttgtttgtattataaatcattga

SEQ ID NO: 46781 - DNA, 333 bp, Glycine max
  Peptide Sequence Number=SeqID_138466
atgaacgtccacgtggcccaggtgattgctgacgccatctatttgtttgcaagtatgcaacccaccaggtaccctctagacccggataagtctaacagggccctgtggtttctggcattgatcacgggcctcagccaattgttcggggttctcgtcacccttagtaaggtgatccgaccgccgatcacccgggccttcatcgagaagtactgcatgcctaggcaggcgcagggtgatgcgcatcaggccgtagatgctccgccaccacctcatcagactgatcccgctggatcactaggcatggagcgttatctacagcacttggttcactag

SEQ ID NO: 46782 - DNA, 453 bp, Glycine max
  Peptide Sequence Number=SeqID_138467
atggggatcgcacccacaaagacacccagtggacctgaagaagtccaacagggccctggggtttccagctctggttatgggcctctgtcggccctacagggcgcccgttccccccagcaaggattgtgcccgcaagacacccagtggacccgaagaagtccaacagggtcttggagttgtcaagctctaattatgggtctctgtcagttctacggagtacctgtcagctccagtaagggcatcagcccccctactaatcgagctttcatcaagaagtactgcgtctccaggcaggcacagggcgaaacaccacaacagcctggggatggccggcagcgggcaacagacgcaccgccatcacctctagagttcacctctgctcatccacaaaaaggtttgagtattgtctacaccacatggccgaccaataggcgaccaagtccaaagccaaag

SEQ ID NO: 46783 - DNA, 343 bp, Glycine max
  Peptide Sequence Number=SeqID_138468
gcatctgactaagacaagtctgcgagtggggaattccgatgtgtatggattcctcgagccacagtccattcagagatctaagcaatcacaatttgaatcagaaatttacatcaagagttggatgcagagttcaaaacaagatgtctaccttggagcctacttcaatggcggacactggcaaatggtcatcattctgcctaaggaaaacctagttgtttggttttgttctttacataacaggccagacaactatcttaagggaataattaacagttctttgaaaggacttgatgatactcctcaatctaaatccaaggctgctgctaggtggattgttgttaag

SEQ ID NO: 46784 - DNA, 327 bp, Glycine max
  Peptide Sequence Number=SeqID_138469
atgtcaggatttacacgcgattctcctcaaatttcagtcagcccgcatcaattagaccttgcaccttacgcttcagagccctaccatgctcaatggaacgccccggggcttctccgtgacaagcacacgttgcgttcgagtcatattctcggagaaatggaggttgatgaaccttggctagggttatggctaccattgaattatcaaacagactttgtggtagatttagggatggcctttgtggataactgggtggtgggtaaggagaaggtttgttattggctgagtaatgacattgttgggttggtgggaaacttggccgtatag

SEQ ID NO: 46785 - DNA, 639 bp, Glycine max
  Peptide Sequence Number=SeqID_138470
atgaccaccctgactcagatatggatgactttgctgctcagcaacatcctgcccagcgaccataattccgacctccccctgccgaagtgtcagctggtgtacgccatcctgacgcggatgagcattcatgtggctcagttaatcactgacaccatctatatatttgcaggtatggcgcctaccaggcaccctctggacccggataagtccaacagggccctaggatttcccgccttgatcacaggactctgccagtcgttcggcgtcctcgtcgcacctagcaaggtgatttggccgcccatcaccagagcttttattgagaagtactgcatgcagagacaggtccagggtgatgcaccacaggccgcggacgcgccgccaccacatcaggctggtccagccggatcatttgacacggagcagtatttgcggcatttggttcgccagcaggcggccaaccaccgggcacatgtcgcatggcctggagattggcctgaggcccgggcaggagaggcaccagcggaggcaccagcagaggctcccgacgaggcagatgaggcccgcgaggacgaggagatgacccgatttactggatttcttaggagggagtgggggccacatgattgggagatctcttga

SEQ ID NO: 46786 - DNA, 659 bp, Glycine max
  Peptide Sequence Number=SeqID_138471
gcgagtattcgaacagcggtggcgtactgttcggcggcaccgagcgcgaggtggtcatccaggaaagcgtgttcacccgcgtcggcgccgagcgggtcctgaaattcgccttcgaactggcccgcaagcgcggcaagcacttgaccgcggcaaccaagtccaatggcatttcgatctcgatgccgtggtgggaccaacgcgtggccgacatggccgggaacttccccgacgtccgctgggacaaatatcacatcgacattctgtgcgcgcatttcgtgcagcatcctgactggttcgacgtggtcgtggcttccaatcttttcggcgatatcctgtccgatctcggcccggcttgcaccggcacgatcggcatcgcgccgtcggccaacctgaatcccgagcgcaagtttccgtcgttgttcgaaccggtgcatggatccgcgcccgacatctacggcaagggcatcgccaacccgatcggccagatctggagcggcgcgctgatgctggatttcctgggttatccggacgcatcggcggcggtggttcgcgccatcgaaaccgtgctggccgatggcccgcgcacacgcgacatgaagggcagcgcgtccacggccgaagtgggcgacgccattgcgtcgctgattcccacggcgtag

SEQ ID NO: 46787 - DNA, 915 bp, Glycine max
  Peptide Sequence Number=SeqID_138472
atgaggggagcgccaacagaagaaagtctctcgcctttccttatgagggatctaggcgcgcaaagtctcaaggtgatacaaagagtccacaaggcgtggagaagtccgttgaggaaagacaaggagcttaggggcatccgtaatggcgtcatcggaggttatcatggatggctaagaattcacacacaagggttagattggctctccaagttgaaagttatcgatgaggagaacttcgaagctccggaggaagatgaagaagtccgagctctaaaattagtgctagggaaggcaagactcgccaaagagaagttcaaatcagccgctacacacatccgaaaagagtgcaccgagttacaagaggagaacatggccactgtaagagcccttgaacaagaaaccaaaagggcccgcaaggaggaacatggtcgagagaaattccaaggagcattgtggggtagcaacaatgagctcaagctccgaagagaggaaagagaccggtcacgggtgcatggcatgatcttaaaagaagagttagccgcttgcgcaaagtccaagaggagtttggcccaacacttggaaaccacggagcaaaccatgctagctatcatagggcaatacaaggaagagctgaaccagtctgtgacccatgaacaaaagctagtggaggattttgcacaagtgtacgccgaaaaagaagcaagagggagggtgattgatgcattgcatcaagaagcgactatgtggatggatagattcgccttgaccttgaatggaagtcaagacctcccgcgtctattagccaaagcaaaagccatggccgaagtgtgtatggcccccgaggagattcatgggctaatcaattactatcaacacacgatagatttgatggcccatataattagaaaccgttag

SEQ ID NO: 46788 - DNA, 342 bp, Glycine max
  Peptide Sequence Number=SeqID_138473
atgcctttatgtggaggccgcagaggagtcattagaaaccgctttccagtctttcgaggtggtaagcatttcctccgtggattccttctctgggaaagcttgcctgtccgatgcagcagtaatgatggcccgagttatgttggggaacggttacgaacctccggaatgggtttaggctacagtcacaacccgcgaacgtacctgataagggaccaaaggaaagtgtggaggacaagtatggcgtgtaagcccacgcttcgaataaagagatattccggcaaaagagccttccgggatacaaagctcgcggtaacaaaggaaggtgtagaggaagcccagtga

SEQ ID NO: 46789 - DNA, 507 bp, Glycine max
  Peptide Sequence Number=SeqID_138474
atgcgagcggggaattctgatatctatggattccttgagccacagtccattcagaggtttgggcaatcgcagtttgagtctgaaagttacataaagactttgatgcagagttcaaaacgcgatgtctatcttggatcctacttaaatggcaggcactggcagatggtggtcatcctgcccaaggaacacttagttgtctggttttgttcattgcataacaggccagacaactaccttaaagggattattaacagtgctttaaaaggtcttgatgatgctccacagcctaaatcaaaggctcctgctaggtggattgttgtcaagtgtaatagacaaaaaggaagtactgagtgcggctactatgtcatgcactggatgtccaccatcattttaggaacttttaggaataactgggaagcggatcctagaccattggagccagagagattaaaggcgttgcggatccagtgggcacagtattatctccgagttagagatcagacctag

SEQ ID NO: 46790 - DNA, 518 bp, Glycine max
  Peptide Sequence Number=SeqID_138475
atggtcttaaaggaggagttagctgcttgctcaagatccaagaagagtttggcccaacacttagaagccacggagaaaaacatgctagctataatagggcagtacaaagaagagttaaaccagtcgttgacctatgagcaaaagctagtagaggacttcgcacaagcatacgctgagaaggaagcaagagggagggtgattgatgcattgcatcaagaagcgaccatgtggatggatagggaactcaccataactaaaaaagcgcaaaggcacccctataacacccgatccaaaagtaagatggataacgaagagggagtgcaagaacagatgaaggccgacatgtcgaccttaaaagatcagatggcttctatcacgaaagccatgctaaaaattcaaaaatcaatagaagacaatgctgtggcagccgcttccaatacaactacggaagcggaaccggtgctacaacccgcaatgaacttgggccgggacaaaagcgcgatgggtttcaatcggag

SEQ ID NO: 46791 - DNA, 141 bp, Glycine max
  Peptide Sequence Number=SeqID_138476
atggcagaacaaggctggtctcttgcaatgtgggtcgtaatgtgcctgaaaagcaacaaggatgatgacgtctgcttggtgaatttgattcgggagcaacaagccatgtgtgcaaagtcgtcgttggttcaaggaatttag

SEQ ID NO: 46792 - DNA, 1139 bp, Glycine max
  Peptide Sequence Number=SeqID_138477
tgccttgcgtccgctcgatattgccgggttaagtcaattcctggtgcaggtgtctaatctgatcgtggattgtgccgagatccagcggctggatatccatccgctactcgcttccggcaatgagtttacggcgctggacgtgacgctggatatcgcgcccttcgaaggggacagagagagtcgcctggcaatccgtccatatcctctgcatctggaggagtgggtagagatgaaaaacggggaacgcgtcctgttccgcccaattctgccggaagatgaaccccagctgcgggcctttatctctcaggttacgaaagaagatctctactaccgctattttagcgaaatcaacgaatttacccacgatgatttagccaatatgacccagatcgactacgatcgagaaatggcgtttgttgcagtgcgtcgtgcaggtcatgatgatgagatcctcggcgtcacgcgagccatttctgacccggataatgtcgatgcggagtttgccgtgctggtgcgctccgatcttaaaggcctggggctgggtagacgactgctggaaaaactcatcagttatacgcgagatcacggattgttgcgcctgaatggcattactatgccaaacaatcgcggtatggtgaccctggcgcgaaaactcggatttgacgttgatattcagctggaggaagttgatgatgtagagttcttttatgctcccgctcattttcgggaaacgcttctggaaaagattgccagcgccacgcgacgcatttgcattgtggccctgtatcttgaacaagatgaaggcggtcgtgcgatcctcaacgcactctatgaagctaaacgtcagcgtccggaactggatgttcgcgtactggttgactggcatcgcgctcagcgtggccgtatcggcgcagccgcttccaatactaatgcagactggtattgccgcacggcgcaggaaaatcctggcgtcgatgtccctgtttatggcgtacccgttaatacccgtgaagcactcggtgtccttcattttaaagggttcatcattgatgacagcgtcctgtacagcggcgcaagcctgaatgatgtctaccttcatcagctcgataaatatcgctacgaccgctaccacctgattc

SEQ ID NO: 46793 - DNA, 306 bp, Glycine max
  Peptide Sequence Number=SeqID_138478
atggctaaattcgatccggatatagtcatggagttctacgctaatgcctggcctaccaaggagggggtctgtgatatgcgctcttgggtgaggggccagtggattcctttcgatgcagaagccttcagtaagttcctagggcacccactgatcttggcagagggccagcagtgtgagtatagccagaggaggagacaggtctctggctttgatgaggaggctattgcccaactattatgcatactgggcaagattttgcccagactgccgcagggagacgggtgcggatcatgcgcaccagcatga

SEQ ID NO: 46794 - DNA, 393 bp, Glycine max
  Peptide Sequence Number=SeqID_138479
atgaccactcttacatggatatggatgacgttgctatttagcaacattcttcccagtgaccataatgccaatctccccctgcagatggattgcgcccacatgacacccagtggacccgaagaagtccaacagggccctggggtttccagctctggttacgggcctctgtcagtcctacagggtgcctgttcccccagcaagttctacggagtgcctgtcgcccccagcaaggtcatcaggccccctactaatcgagctttcatcaagaagtactgcgtcccaaggcaggtgcagggcgaaacaccacagtaccctggggatggccggcagtgggcaacagacgcactgccctcacctctagagttcacctcagctcatccacaaaaaggttag

SEQ ID NO: 46795 - DNA, 372 bp, Glycine max
  Peptide Sequence Number=SeqID_138480
atggtgaaagttggaacctcttacgtgccgatcaacgtctcattttcgccaaaagttggcccagggcttcccggctccatggcgtatcatggtttctatcagctgttcctcctgttcgctactgaaagggtggtgttatccgctccaattcggcaacaagcactacgaccggaagcatcagcgggcaagtgtaagccgggtgccatgacgctgcaactgtgcgcgaagggcgatcggtgcgggctcttcgctattacgccagcggcgctaaagcggatgtgctgcatactggcgattactatgttggctgataacgccagggtgttccagtcagaatgcgttgtggcagaaaaaaaggctgacggccagtga

SEQ ID NO: 46796 - DNA, 791 bp, Glycine max
  Peptide Sequence Number=SeqID_138481
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgatgcttcagctatcaaggcttacgattcagtaactggtgctgatgtgacagacaagttcgacattaaggttgaaaatggtgtgatgaccgcaactcttaaagctggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46797 - DNA, 372 bp, Glycine max
  Peptide Sequence Number=SeqID_138482
atggttgctagggagaatgttgctaagcagcaacattatccagatcagcgtgagggtggtcatgctggtgcgcatgatccacacctgtctccctgctacattccgggcaaagtcctgccccgaaatgcacagcaactggctgatagcctcctcgtcaaagccagaggcctgactcctcctctggctaaactcgtagagctagccctcctccaagaccagtggatgccccagaaactggttaatggcatcctcatcaaaaaggatccactggcccctcacccaggagtgcttgtctctgactccctcttctataggccaggcattggcatagaactccatgactatctcaggatcaaacttaaccatgggtga

SEQ ID NO: 46798 - DNA, 627 bp, Glycine max
  Peptide Sequence Number=SeqID_138483
atgaccatccagaatatgcaatttcagcaagagacaagagcctccactcaaagtctcacaaatcagatggggcagatggctactcagttgaaccaagctcagccccaaaattctaaaaaattgccttcacaaatggtccagaatccaaaaaatgtgagtgccatcaccttgaggtctggcaagcaaattgaagtgcctccaccaatagaagcacctgcacctgaacctgtcaagctttattctacacctgaaaaagaggatgagctagttgcacaaaagagaaagcttcctgatcatgcaggtggatcttcttctagtagttctgacttgccacagcctcatatccctcttccatttccacctagagaaattccaaacaaaaagatggaagaagtggataaggagatcttggagaccttcaggaaagtagaggtagaggttgaggaaccctcctcttcttctcctaccctagttcctcccactgttcaaccaccacccacattagtgttgaagcccttaccagcaaacctcaagtatgcttacttggaggacaaggaaaaatttccagtgatcatctctgcctcccttgctaccaagcaagaggagaagttgttgctagtgctctaa

SEQ ID NO: 46799 - DNA, 150 bp, Glycine max
  Peptide Sequence Number=SeqID_138484
atgtccccagtggagtcgccaattgtcgcaacctacctctcagtgagagggcgacgtaaggctcacgggtgcatcttccaaggaaggaaggcgcgcggagtcgccaccaacggtgtttcccttgctcctacgtatcctcaattgcaatga

SEQ ID NO: 46800 - DNA, 432 bp, Glycine max
  Peptide Sequence Number=SeqID_138485
atgcatggctccaaacacgaagatggaggacacattaacgaaaacgcaattcttggggctccgaaaaatggcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 46801 - DNA, 453 bp, Glycine max
  Peptide Sequence Number=SeqID_138486
atggcgccactaggcaccctttggacccagataagtccaacaggacctgggattccccgcactgatcacaggactctgccagtcgttcggagtccccgttgcacctaccaaggcgcgcccccaccacctcatcaggctggccaggctggggcatttggcatagagcagtatttacggcatttggttcgccagcaggcggccaaccaccgagcacatgtacggacccatgattgtctgtaccagatgagccttagcatgcagagccagggcttcgctcctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttgggagggagtggagacacgtga

SEQ ID NO: 46802 - DNA, 405 bp, Glycine max
  Peptide Sequence Number=SeqID_138487
atgttgcctccaatttgtttggttggaagtgtagcgtggtgcgcggtggtgccactcatttgtttccatgttgttgagtggcaccaacccgatagagttttgagacaatttggaatgcaacaacctattctcgggtgtccttcgcaacccctgaatattcatgacataacgctgaaagacaaacaagatgaaaattgggggcaactgttcgccccaatgatcagtcaatggaataatcgagctgattttagggtcaatggttatcctcgacaagaggacctattgagctttaactcggactacatggtctggctgaagttgcggagacattacagtacattgtgtctcctcaagggaggaatacatggacagttgatgatctcatgtcttatgtggagaagatag

SEQ ID NO: 46803 - DNA, 533 bp, Glycine max
  Peptide Sequence Number=SeqID_138488
atgactagaggcaatccatctgacttacaaccctttgatcctgagatagataggacatttcatatattagttaggcatcattttataccttttgatcatcctgagcattccattactggtgaatctgtgcattctgttattggtgattttgaacatcctgattttgagcattacaattttgagcattctgattctgagcattccgattttgaacattctaagaacatggcacaacctccaccccgtgagaggactctaagggaaatggctgcacctgatttcacctacgaaagcttgtgcatccaataccctaatgaggatgtcccatatgttcttaaaactggattgattcatttgcttccaaagtttcatggccttgcatgtgaagacccgcacaaacatttaaaggaatttcatattgactgctccaccatgaaacccccagatttccaagaggatcatatatttctgaaggcttttcctcattctttagagggagtggcaaaggactggctgtattaccttgctccaag

SEQ ID NO: 46804 - DNA, 573 bp, Glycine max
  Peptide Sequence Number=SeqID_138489
atggagaggagtatgattgatgctgtcagtggtggagctcttggtgatatgacccctattgaggctaggaatttgattgagaagatggcttccaactcccaacaattcagtgcaagaaatgatgctattgtccttagaggagtccatgaggtggccacagattcatcttcatctgctgaatataaaaagcttgagggaaaactggatgccttggtcaacctaataactcagcttgccatgaataagaaatctgcaccttttacaagagtttgtggtctatgttcttctgcaaatcaccatacagatcactgtccctctttgcagcaatctggagtcaatgagcaacctaaagcttatgctgcaaacatttataatagacctattcagcagcaaaaccaacaacagcataataattatgatctttcaagcaacagatacaatccaggttggaggaatcatccaaatctgagatggacaagtcctccacaacaacaacagcctgtccctccctaccacaatgcttctagtccaagcaagccatatgttcctcctccaatgcagcaacaacaataa

SEQ ID NO: 46805 - DNA, 375 bp, Glycine max
  Peptide Sequence Number=SeqID_138490
atggaaacatgtttggaagtagaggaattgttgcagcgaatgatagatcaaggccaactggaagtcggtgatgatgggaggaaaaagcaacatatatgtatgcagtccgcggatgagagaagttttggaaggcctaaacctttggtgatatatttcaccaagggctcagcttcgcaaaagcgtcgacacccgttggcagctaaacttgtccctttcccataccaaaacaaccacgcagtcccatggaggtacacacctccgtataagaaggaagaagaagccaccgacatcagttcattgtcggccaagtgtatatgcctatatgttcttggtagaaataggagtagtgggggcaagatatgcgggttaggctaa

SEQ ID NO: 46806 - DNA, 279 bp, Glycine max
  Peptide Sequence Number=SeqID_138491
atgaagggaagaaggcataaatatgggtttaacaacaacaaacgtgagaagggagagaagaaaagggtggtggatgatgaaactggcgacaaacatcagctggatgaagtcctaaggatgccatatcatgtgttctccacttgcctccactcctcctcttcctcctcttcctcctccttctcctccttctcctcctcctcctcctttggacgcatcggctttgccgtctactatgaagcgtacacgcaaagcttcacgtttacgatcgttgtccactag

SEQ ID NO: 46807 - DNA, 292 bp, Glycine max
  misc_feature (220)..(220): n is a, c, g, or t
  misc_feature (238)..(238): n is a, c, g, or t
  Peptide Sequence Number=SeqID_138492
atggcatcatcaaaacatcaaaggcaaagtctttgcttctacatgttgggccttggcatgggtagcacaccacttgaggcagtatatgttaaattacactacttggttggtgtccaaaatggatccaatcaagtagatcttcgaaaagcccgcttttactgggagaatagctcgatggcagtaaaaagaagcactttggcagattatctagctcaacagnccataaatgattatcagnctatgcatccagaattccctgacgaggatatcatggccctatttgaggaagagg

SEQ ID NO: 46808 - DNA, 222 bp, Glycine max
  Peptide Sequence Number=SeqID_138493
atgtccgattcaggcgcatcacatatcgagacgctcgaaattgaacaacggaagctctcgaaaaattcaaatggtcataacttttcacacggaggtccgattcaggtgcatagtatatcgagatgctcgaagttgaacaacggaagctctcgagaatttcaaatggtcataacttttaaggcggatgtccgattcaggcgcatcacatatagagacgcataa

SEQ ID NO: 46809 - DNA, 147 bp, Glycine max
  Peptide Sequence Number=SeqID_138494
atggggcgagcaaggagcagaatcgtctcaggccacggccaaaagtcaagacaagtcaatggtagaaatcaaccaaggtacttagggatggaagcgaatggaggatgggatcgtgaccgaccaagcgtcaccccttctcggtgctaa

SEQ ID NO: 46810 - DNA, 126 bp, Glycine max
  Peptide Sequence Number=SeqID_138495
atgcatctacatgatcaaggtacttacagggaagatccaacagaggatttagctttccataccaggaagccttctttagaacaaagagaagaacaagatgaaagattgcaaaaatacaagtggtga

SEQ ID NO: 46811 - DNA, 162 bp, Glycine max
  Peptide Sequence Number=SeqID_138496
atgaaacaaaatatcgaccaccacagcaaaataggggagaagcttgccacccagctcgcccaggcgagcaaggttgcttcctccagaagcaacagccttctggaggaaggatctggaaggcccaagtgggccagattgctatttgcaccccctttttactaa

SEQ ID NO: 46812 - DNA, 312 bp, Glycine max
  Peptide Sequence Number=SeqID_138497
ggtacatcctttgtggtacaagtaaagggtacatctacttgggttgttgtaactgagaacaagagagggtacatctcttgtggatcagttcaagtggagggtacatccacttggttgttcaaagagaacaagggagggtacatcccttgtggatctttgcttgtaaaggtttttacaaggttgaaagaaatctcaaggaccgcaggtcgcttggggactggatgtaagcacgagttgtctccgaaccaatataaaacacttgtgtttgtcttcttcttccctacactttttaatttctgttgtgcactttaa

SEQ ID NO: 46813 - DNA, 354 bp, Glycine max
  Peptide Sequence Number=SeqID_138498
gtactagtacctattgcctttagaggactacacgtcctcgccttcaaagggctacacgtcctcgccttcagagggctttacatcctcgccttcagagggctacacgtccttacctttggagggctacacgttctcatctttagagggctacacgccctcaccttcaaagggatgcaggtcctcgcctttagaggcctacgcgccttcaccgtaagagggttgaacgcccttgccttcagaggactgcatgtcctcaccttcaaagggcttcacgtcctctccttcagagggttgcacgttctcgcctttagagggctacacgtcctcgcctttagagggctacaccccccctga

SEQ ID NO: 46814 - DNA, 131 bp, Glycine max
  Peptide Sequence Number=SeqID_138499
gtgtcgagggaagtagcccagagtatgaagaacctcgagatttgaggtcaaatcctttccaaggtggaggggatgatgcaatcctacccaccaagggtattagatacaagccttcaagaggattgggctag

SEQ ID NO: 46815 - DNA, 309 bp, Glycine max
  Peptide Sequence Number=SeqID_138500
atggcgtgcccgttacgtgcgtaccaaaagagccctcatggaactcccccagcatgctctcatgcttccttagcattcacacagcgtacatactgtcatggtttctcttgtatagtatgcttccactcacgaaaagcttcgttcatctttggtcctcttgtcattgtcggaagccttcgtgggtactctttcgctttcaccccgaatcgcttgttatatcgaaataccaaggcttactatcccgctcttcttccaccagacaacaatgtgcgagtctgtgatgatccacgacacttgaactcaatgacg

SEQ ID NO: 46816 - DNA, 910 bp, Glycine max
  Peptide Sequence Number=SeqID_138501
ccttcgcttaaaaagaggttctatcaagtcaaaatcaagagcttagaggtcaccagtttacgaaagttggggcaattaatgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaggtggtgaaaatctcggcacaagagttggaccgtgtaaagcaaaacaggaatggggtagtcggagtaccaaggaagtgtttggaggaaagggcaaaggccttggcaaatcaagggttagtggacctagcagcgattgacgctttcctcgcctttcatcatggcaaggaaagcccggtcgtcgccattttggccatgattctatcttcatgcgaaggatgtcccatgaaaggagtgccatcagacgaaagcatcacgcctttcattgcacgaggtttcagtgaccacaacgcgagggacagagagcttaggggaagcagtaatgggatcatcggcggctatcataagtggctgagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacgagctaaag

SEQ ID NO: 46817 - DNA, 255 bp, Glycine max
  Peptide Sequence Number=SeqID_138502
ccccatgaatttattgcctagcgctgttcatgcttcttccaccatggagtctggagcccttggaagttattgcgtagcgctccccgcgaagttgttgcatagtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatttacgaactttttagtgaaag

SEQ ID NO: 46818 - DNA, 396 bp, Glycine max
  Peptide Sequence Number=SeqID_138503
atgcgttgccctttctgcagagatgctgaggaggaggtctcccatctttttttccactacaacaagatccaaccaatctggtgggaatcgatatcttggctgaatattaaaagcgcctttcctctcaaacctgtacaacatttccttcagcatatctctattcagataaaaggagtaaggggaaagaggtggagatattggtggctagcgaaaatctccaagatccctagcaagcctcaagatctatataacataaaggtttatgatggatggctaatgcacaagcaatttcagaaggtagtgagggattgttggttagattatcagcctatggggtggggtggttatgctttaaaatgcaagcttcagcttcttaaacagaggctgaaaatctga

SEQ ID NO: 46819 - DNA, 561 bp, Glycine max
  Peptide Sequence Number=SeqID_138504
atggagcggggcagattcaacaagcaggcctcaatacgaagataccaagccagacgatcaacagcagacagaaagaaacgtgtcacctttcgcggagcagttaatgagggtgatggagcttctggacacaaatctcgaaggaaaagcgaagctgtacaaagaagtaccactgagctgcatattcatgatgaacaacggaagagatcgacggagctgagaacttaccacaagaactaccaggttgaaacgtggagcaagattctgagttctcttagccctaaaggtttgaacgagaacgggaaggtgcacaagccggtgctgaaggagcgcttcaagagcttcaacgcggcgtttgaggagattcacaagacgcagagcgcgtgggtggtgtacgacgaacagcttcagtcggagcttagggtttctatttccgcgctcgtgattccggcgtacaggtccttcttgggaaggttttcgcaatacttgtatcccggaaggcaagtgttaaaatatgtgtgcatgtgtgtgtgtgtgcgcgcgtgtgtgttgtatgcggcatga

SEQ ID NO: 46820 - DNA, 342 bp, Glycine max
  Peptide Sequence Number=SeqID_138505
atggcttcaagaatcatctctcgtgattctgtatcactttctgctgccctcttcttctccatgctcactgcatcttcttcctcctcagctagctatcttcttccatcagctgcttcaccatcatcaatgcagcactgtctccccctcaagaatctattcgatcaactcctccctcaaaatcataatcattcttcctctgtggtggctttgatggttgcctccagcattgcatgtgtccttgagttcacaatcaaggcatccttggatacagcacctgaagcagcagctttccctgatgtcgagacaatgtctgggacatgtgtcccctcaaacagtttgtaa

SEQ ID NO: 46821 - DNA, 351 bp, Glycine max
  Peptide Sequence Number=SeqID_138506
atgaccctgattgatctccctatgatattacctagtgagagtgacttgacttgccagcacttgacgaggtttttcactgacatggtcttggacaaccttgtttttgtagaagcaaagcttcatgatgaatcaagattgattcaaagatgttttgatgatatcaaagatgatgacaatgattcaagaggaaagttgaagaacacttcaagattcaagaggaaagttgatttcaaggatcaagaatcaagattcaaggatcaagcttccaagaatcaagattcaaggatcaagcttccaagaatcaagatcaagattcaagactcaagattcaagaatcaagagaagacttaa

SEQ ID NO: 46822 - DNA, 521 bp, Glycine max
  Peptide Sequence Number=SeqID_138507
atgcccgggagaattggacaaattgaactaaaggaccgatgggacatctccgaagatgaggaagaggagcgtagaagaccagggcggatattgcaaagagatcaccagcagcggttagaagagcttctatttcaccaagagcttatgccataccagctgattcaagttgttgcttctccccgcgggggatatcgattactggtcgtaaggggtgggatatctggttcagcagcagatcctaattacccttctggtgactcccggagaagcgttaactactgggatatcggggagttcctctccagctactggaacttccctcgctacatgagctattgtataaatacaggaatactagggcctgctttagagctagccacaccaagcctagttctcttgcccgcttcgcttgtcgggcttaaagcggaactgagcttctcactaagagaatcaagcttggctagttctccttactcggacattctgttcatccgaccaccgcccatgcttccaatttcgtt

SEQ ID NO: 46823 - DNA, 57 bp, Glycine max
  Peptide Sequence Number=SeqID_138508
atgaagtatctaggaagtgatcctaggtcgtctcccaacgagcgatggtcaacagac

SEQ ID NO: 46824 - DNA, 522 bp, Glycine max
  Peptide Sequence Number=SeqID_138509
atggcccatgaacaaaagctagtggaggattttgcacaagtgtacgccgaaaaagaagcaagagggagggtgattgatgcattgcatcaagaagcgactatgtggatggataggttcgccttgaccttgaatggaagtcaagacctcccgcgtctactagccaaagcgaaagccatggccgaagaacagatgaaggccgatctatcggccttaaaagatcaaatggcttccatctcagaggtcatgttaaaactccagaaaaccatagaggacaaagccacgacaaccgcctccacttatccttatggcttgccttcggacttcactcctcgtgccactccggaagatttaagccaagcccctacttttgaggggcaactcccgccttatgacgactatcccgggcaagacgatgaggaaggagatacccatctcggccccctgctccacctcaaagatccgtccccacatgaactaccccaaccgaacatagtccgccatatcccggcctcacccacacct

SEQ ID NO: 46825 - DNA, 368 bp, Glycine max
  Peptide Sequence Number=SeqID_138510
gatggaccctcgggtactagtaccctggtcttcagaggactacacgtcctcgccttgagaggactacatgtcctcaccatcagagggctgcacgccctcacctccagaggactacacgtcctcgccttgagaggactacacgtcctcgccttgagagggctgcacgccctcaccttcagaggaccacatgtcctcgccttgagagggctacacgccctcaccttggagggctacacaccctcaccttgggtactagttaccctcaccgttgagaggactacacgtcctcgccaacagagggttgcacgccctcaccttcagaggactacatgtcctcgccttgagagggctacatgccctcaccttgg

SEQ ID NO: 46826 - DNA, 405 bp, Glycine max
  Peptide Sequence Number=SeqID_138511
atgtctcttgccactctctttggaaaacttcaagaacatgaaatggaacttatgagactccatcaacatgaagagaatgatataaagagaaaaggaacaacactcagagcctcatcatcttttattcaagaagaaagtgacaaagaggacttgactgaaacagaagaagatgatgatgatttcagactctttgtgaaaaggttcaataaatttctgagaaacaaaagaaataaaagggaatcaaacatcaatacaaagaagaaagaagaagactcctccttagccccaacatgctatgaaagcaatcaacctgggcacatgagattcgattatcttgtctttgaaagaagaattgaaaaatccaacaagaggaatctcaaagaaaagaaagaaaagaaagcataa

SEQ ID NO: 46827 - DNA, 222 bp, Glycine max
  Peptide Sequence Number=SeqID_138512
atgtataggttaattagacaagctttgaaaagtgttgtttttcaccttctcgctaagccaatctgttggcttaacgagcatccgctaagcacaacactcatgggccaaacgcgaggaagactctggaagaagatgagttgtacaggtttgctaagcacaccgcttcatctcactaagcgcactgcttcagtccatccgctaaatgagaaaggcacgcgctaa

SEQ ID NO: 46828 - DNA, 282 bp, Glycine max
  Peptide Sequence Number=SeqID_138513
atgggtgcatttagtaaaaaggggggtacaaatagcaatcatgtccacttgggccttccagattcttcctccagaaggcggtttcttctagaggaagcaaccttgctcgcctgggcatgctgggtggcaagctcctccccctattttgctataaatagggggaggagtgaagagggaaaggggttcagccttcttggcacttcttattctcttgaaattgctgaggaaaattgtttccgtgaagaaaatccatgccgaggcgcttccgtaacatttccgtaa

SEQ ID NO: 46829 - DNA, 318 bp, Glycine max
  Peptide Sequence Number=SeqID_138514
ggtacatcctttgtggcacaagtagagggtacatctacttgggtttgactgagaacaagagagggtacatctcttgtggatcagttctagcggagggtacatccactaggttcaaagagaacaagggagggttgaaagaaatctcaaggaccgcaggttgcttggggactggaggtaggcacgggaacggtttactcaaagatcatgatgaagaccaagtcaacttgtgtctcatgacaaaatcagatgagaataacaaagaagattctataaggaagaaatggtacatagatagtggatgttccaagcacatgacag

SEQ ID NO: 46830 - DNA, 896 bp, Glycine max
  Peptide Sequence Number=SeqID_138515
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcaagcattacgcaaaagccaagttcaacaaactgtacaaattggtggggcaacaacgaaaggtcttggtgcgggggcaaacccaaatgtaggtcgtaaagcggctgaagatgaccaagaagaaatccgtaaaatgcttgaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46831 - DNA, 342 bp, Glycine max
  Peptide Sequence Number=SeqID_138516
atgaatggtggggagaccggaatcgcttttgtcgctccggatttcctcttagccgaaagggtcgaggcaggaaggagaacgctatatatacacctctttgtacctgggactagacataatagctttgagaaaggctcgggaaaaactggccgccttgccttggcttattgtgtgatttttgagcaggagcgagctgtctttggcacaatctgtactgtagccgggaaagcaggagtcaagctgttcacaagcagtggttatgagccgtatctcgcatctaaagccaatccatttacaagtgaaatcttgcccaactccaactacaaggaaagaaaggggtga

SEQ ID NO: 46832 - DNA, 576 bp, Glycine max
  Peptide Sequence Number=SeqID_138517
atgcaatctcagggacttgcactgcctcccgagcctttgtttggtcccttcggtcctcgagaaacgatcctgagaagggtgactcagataggtgcggcttgtacatcgaagcagatcctgcccgcctggttgccctggggagagtttatgagggatccactattgttccataacaatcctttgttgcctggccaagtaaaggtgggtgtggaagaggttacagatgcagatgctccaattcctgtacccactgatgaggtttccttagtggggcaggcacttcacaccttccttgcttggccaacacatctggtcaagtctttatcacagcaggtagttgtgtctccggcaaaaccaccttcaaagccagatccggaggtcgatgatccgctttatctgatgacattgaccatcccagagcttttcttaaggccttatcaggttacatcggatgccaccgtgttcagggtctttaatccaaatttcccgctctacataaagcacgaagacctctccgaaatcgcacacggtggtcaatgtttcagcatatcagtgttacagttgtggattctgtaa

SEQ ID NO: 46833 - DNA, 201 bp, Glycine max
  Peptide Sequence Number=SeqID_138518
atgcctataggtggagcttatattgaggagaaggaactaacatatttgaggtcaaatcctcttcaaggggaaggggatgatgcaatcctccctaggaagggaccagtcactagagccatgaacaaaaggccccaagaggattgggctagagctgctgaagaaggccctagggttctcacgaacctcaaggtagatttttga

SEQ ID NO: 46834 - DNA, 138 bp, Glycine max
  Peptide Sequence Number=SeqID_138519
atggagttgtcaattgatgcaatcctccctaggaagggaccagtcactagaaccatgagcaagaggctccaagaagattgggctagagctgctgaagaaggccctagggttcccatgaacctcagggtagatttctga

SEQ ID NO: 46835 - DNA, 330 bp, Glycine max
  Peptide Sequence Number=SeqID_138520
atggatttcgaaatctgcctaattgtgcagcaaaaagctggtaaatttgtgcagcagaatttttcaacatgtgcaaaaaatgcttgtgcattgctggttatgggaaagatcccaacggtgaaaatgtatacttatgtactaggaacctccattaaaattttcaagtcgatccaacggttaacgaatcggaacgaagagaatgttactagggtatttgaatttttctgcctctactctgttttcttggttgagggcagtttcatgatagttggaattgatttgcttggatattatggaagcttggaagggttgatggggactcggtgctga

SEQ ID NO: 46836 - DNA, 357 bp, Glycine max
  Peptide Sequence Number=SeqID_138521
gggaggtggttgccgcccagctcgcccaggcgagctcagctcgcccaggcgagccaggttgcttcctccagaagcaacagccttctggaggaatattctggagggcccaagtgggcctgggtgctatttgcacccccatttttactaaaatgttacggaacctcacttaattatgcaacgatgcttccatttgatttccggtgtgtcacggaaacttacggattgtgcatcaatatttttttggtttttcggcatgtcctggaatttcacaaattgcctaatgatggatgccaagcacctcacaaggaccaaagaaaggtcgcatgtcatcaagcaaaggtccccagacgaaattag

SEQ ID NO: 46837 - DNA, 225 bp, Glycine max
  Peptide Sequence Number=SeqID_138522
atgaatgttttgagtggtgcaaccctctttggtaaaatcactcgtgcacccaacatcttcatgatttttgtacatagggactcattaggggttcctatgaactctaaaagaataaaggccattcctgagaggcccactccaccaagtgttaaagaaaaaagcccagagtttcaagaacctcggtatttgaggtcaatccttttcaagggggagggaatgatgtaa

SEQ ID NO: 46838 - DNA, 540 bp, Glycine max
  Peptide Sequence Number=SeqID_138523
atgtacttaaccgggcctcctctggatatcacgaccgaaggtgtatgtcgtggtttctcttatacaggtatgcttcccatgaagaagccggccgccaaccttctcaatgtccttttatcattgtcggcaatctctggcggggtttgccccagcatacaccccattgactcaattctaagattgtcatggtacaagatgagagccttccagggtaattcaagcttgcccaggactctagtttccccggacttgcccctctcagctgacggttcgcatctcaacgctgagtcgactgtacaccttgtagtttcgacttggagtctacctcattcgctgcttctggctcacgagaaaccaagggcaatgcttctattcggccatgattgtgggagtaaccaccggggaaaggtacacttgattgcggggttcaaccttaatgggactctccagacgccatggcctagaatgtttgacgctccgtcaaaccatatggtccatttgtcccgatctttgtccaatttttcctcaaacaagccatga

SEQ ID NO: 46839 - DNA, 393 bp, Glycine max
  Peptide Sequence Number=SeqID_138524
atgcaagaagaagaagaagaagaagaagaagaagaagaagaagaggaatctgatgatgaagaggacttctcactctttatgaagaagtttcataaattcgtcaaaaatagaagaatagagggaagccataacttcaacaatgggaagatctctcaagaagtttctccaacacttaaatgctataagtgtaatcaacccggtcacataaaggcaaattgcctctcaaacgagtcatggcccaagaagaatgagaagaaaagctataaagaaagaagatccaagaaggcgtacattgcttgggatgacaatgactcatctgatggtttggagaaggagatcaaccttctatccaaggactatgagagcgatgagaacatctctcaagaagtttaa

SEQ ID NO: 46840 - DNA, 138 bp, Glycine max
  Peptide Sequence Number=SeqID_138525
atgacttttgtcataaccgcatgtctcgggtatttccgccctcagcgtgactcaaaaggcccgccgcctctggatgacaaaagggtgcaaaatgaccataatctgtctctgcgtgccatcggacacgaatgtgtctga

SEQ ID NO: 46841 - DNA, 180 bp, Glycine max
  Peptide Sequence Number=SeqID_138526
atggaggatgtgcgcaaaaaggcacaggccttccagaagcagaacactatcccccacgttttgtctcgtgggggttatgactattcggagcagaagctcctggctgagaagacgaagaagaagctggaggaagctgcacagtcaggaagcgttgatggcatcatcgagcctccatccccg

SEQ ID NO: 46842 - DNA, 270 bp, Glycine max
  Peptide Sequence Number=SeqID_138527
atgggtctccgaataaaagtggagaatggaggattggcgaacaacgttacgcaaaatcttctcggggctccagactcgaaggtggaggacccaagaacagcgctaggcattgacattgatgggtctccgaataaaaagtggagaatggagaataggcaaatagcgctacgcaataacttccgctacgcaataacttcgcgcggctctacactcgaaggtggaggacacatgaacagcgctaggcaattacattcatgggtctccgaataa

SEQ ID NO: 46843 - DNA, 818 bp, Glycine max
  Peptide Sequence Number=SeqID_138528
aggactacactctcgccattagagggctgcatgccctcgccttcaaagggctacaaatcctcaccatcagaaggctacacgtcctcgccttcagaagactacacgtcctcgccttcagaggactacacgtcctcgccaacagagggccacacgccctcaccttcataggactacacgtcctcgcattcataggactgcacgtcctcacctttagacggctacatgccctcgcctttagaggactacacgtcctcaccttcagaggattgcaagtcctttcattcagagggctgtacctcttcaccttcaaagggctgcacgccctcgccatcagagggctgcacgccctcgccttcagagggctacacatactcaccatcataggactacacgtcctctactttagagggctacacgccctcaccttcagaggacaacatgtcctcaccatcgaaggactacacctcctcgccattagagggctgcatgccctcgccttcatagggctacatatcctcaccatcagaaggctgcacgtcctcgccttcagaggactacacgtcctcgccaagagagggctgcacgccctcaccttcagaggactacacgtcctcaccttcagaggactgcacgtcctcaccttcagagggttgcacgccctcaccaacagaggattgcacggcccagccttcagagggctacacgtcctcaccttcattggactagacgtccttgcctacataggactacacttcctcgccatcaaaggactacacgtccttgccatcagacggttgcacaccctcgccttcggatag

SEQ ID NO: 46844 - DNA, 291 bp, Glycine max
  Peptide Sequence Number=SeqID_138529
atgcagaacagcagggtcaccctaagggctgaatctcaacactttgcaagtgtcaatgacgccaatccctgtgtagcttccatcccttactttgggttcattgatgaaatttgggagcttaactatgtgaaatttacgggcaaaacaattggtgttaatgtagaagatgatgattcatacatggacacctatgttagtcctttgaccgctcaaatcactcctaacgtgtcagagaagaagaagctgacgacgttcatgctaatcgaaatgatcataatgaaggagaattga

SEQ ID NO: 46845 - DNA, 366 bp, Glycine max
  Peptide Sequence Number=SeqID_138530
atggaacttagtaatggaaagggcccatcaagggtgaatcttgggtttgtcgagccttggaccaaggacgtgtttgccctgggttttgtacttccatggagttgtgtcgaggcttaccaaggacgggccttggattttgtaaacccttatggatcagcaagcgcgaaggttgggtttgatgagtcttgcgtgcagtgcaagtactggagacacggtggtgtctatcagtgggactcaccaaaggaggaccttgggtttcgcaagccctttggaggattgaccagggaattttccgacttgggttttgagcaccgtactcttgcatacattgcatacatatcactcgccatgggtggtatgcactga

SEQ ID NO: 46846 - DNA, 419 bp, Glycine max
  Peptide Sequence Number=SeqID_138531
gatttgttggaggagcaagtctcatagggttcctttgtcggtcatggacgtcaggatgtactgattgctgccattgggctaccagaacaccttggtcgtgtgcgtgcttttggagccggtgtgacgatcaaacaatactttggaccagctccaaggacctcctgcacgtcttcgtgcatggctcccaaagacctagagcagctgacgcaaaaaatcagggactagctagaggagttgatcacgaaaaaagtgactcgacaactaatgttatccttcagccagatgcaatcccagttttagtccccagatgcaatcacagggacttgcactgcctcctaagcctgaggcatatgactgagacaagtatgcgagcgggaaatgtcgatgtgtatgaatttctcgagccacagtccatatag

SEQ ID NO: 46847 - DNA, 226 bp, Glycine max
  Peptide Sequence Number=SeqID_138532
gaattcgatgctgtgagaagccttgtgacttgaaggttcacacagaagagtatgaaggaagggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 46848 - DNA, 66 bp, Glycine max
  Peptide Sequence Number=SeqID_138533
atgaggattcccttttttacaggccaaggtgtcgctctcggcccgaacctccgtattattccataa

SEQ ID NO: 46849 - DNA, 270 bp, Glycine max
  Peptide Sequence Number=SeqID_138534
atgggttttcagaccttaccttactccaacataccagacaccactaatatatatgtttttattctttttacatgtgttgagggaagaagccttgagtttcaagaacctatggatttgaggtcaaatccttttcaaggggtagggaatgatgcaatcctaccgcccccaaaggcattggatagaagactccaagaagattgggccagagatgcaaaagaagaccctagggttctcatgagccttagggtagattttgagcccatgagctaa

SEQ ID NO: 46850 - DNA, 446 bp, Glycine max
  Peptide Sequence Number=SeqID_138535
ggccaagaaatctggaagaaaggtgcctggtaatgtccctgatgcaccattggacaacatctctttccactccattggaataggcattgacgttgagaagagagcagctgaggaagagagttggatgcaagcagaagacaggacagaagaagctgctgaggaagaggaagacgcagcagaatggagactagtgtttgtcagaggaaagtgtgttagattctcccctgctgtgatcaacaaatatctgggcagacctactgatggagtgatagatattgatgtttctgagcatcaaattgccaaggaaatcactgccaaacgagtccagcattggccaaagaaagggaagctttcagcagggaagctaagtgtgaagtatgcaattctacacaggattggtgctgcaaactgggtacccaccaatcatacttccactattgccacag

SEQ ID NO: 46851 - DNA, 887 bp, Glycine max
  Peptide Sequence Number=SeqID_138536
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatttggcaaagggagaagggaatgaaaaagattaatagcacaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46852 - DNA, 273 bp, Glycine max
  Peptide Sequence Number=SeqID_138537
atgtcgctgcatgttctctatctttatgcgttttctagatttccccccaggattttccggtctgttgtatctcttgttacgatctttcaaagaaataaacatggatttgaggcttttagtcctcacgtgcttaaggatgaacgcaagcggggatggggtcacgaccgaccgatcgttacccttctctgtgcgaaacaagcagggaatgtcgctgcaaggcagccccgtatcctttgtattttgcagctttcttttactatttgtttgttttaa

SEQ ID NO: 46853 - DNA, 391 bp, Glycine max
  Peptide Sequence Number=SeqID_138538
atgacgacaataacacacacgagcttcgacaactacactggacaacttcgacatagacgcttttctctacctaacccgtctcagaaaaacgatgatctcagaatcattcaccgttggatcgtcgtgaatttttatcagcacgttcacaacccaattacgagcattctcaccgttgggaattccaaaaacatgtcggagctaagagacatacctctcgcaccaaatgcaattgcgcacactttcaccgttgggatgtacgagataatattcgtggagggagaaacagaatcgcatgaagacagtacaagtggagaggaaaaattggaggaatctcagggaaccgctagagatgctgtgatcgctttcggaagacacgtgagtccgcttagag

SEQ ID NO: 46854 - DNA, 420 bp, Glycine max
  Peptide Sequence Number=SeqID_138539
atgtttgtgaaaaactttgtcatgaatcactctatgagactatcaattttcaattcattcaattcattgaaattgctatccattgctccaacaagatttgcctccactattgtaatgctcaagagattcaagcaattgaagaaaggactccaagagatggttgattatattctttctttcactagcgctatctataatgttcttagaagaactgatacggaagcttcatctctccatctagtatatgagatgtgggattcaatgattgaaaaggtgaagaatgtcatatatcaatatgagagaaaggaggagagtgaaggatcaaccttttatgaggtagtgcactccatattaattgaccgttggactaagagtagcactcctctccattgtttggctcattccttaaatcctaggtaa

SEQ ID NO: 46855 - DNA, 752 bp, Glycine max
  Peptide Sequence Number=SeqID_138540
gcgaatgggccccgttcatagaaatcctcacactgttgatctttggaggagtcctctttccaaatgtagatgggttggtggacctagcagcgatcgacgcttttcttgcctatcatgaccgcaaggaaaacccggttgtcgctatactagccgatctatatgacaccttcgaccgaagatgtgagaagagcagtacaaggattgtttgctgggcaaattgggatcaactcttagcaagcaaagaaggagcatctatcaactggttccctcgttggaaagaagggagaactggggttcttatttcgtgcggaggatttccgaatgttcccttgatggggacaaggggttgcatcaattacaatcccgttcttgctataaggcaacttggctaccttatgagaggggctccacttgaggaagagctcgcacctattattgcccgaggggaggaagttgaggcaccggaggaagacgaagaggtgcagtcccttagggcagaactcgagcaagcccaaacggtcaaagaaaggttcaaatcagcaactcttaagatccgaaaggagaatgccgaactgagagatgtagcgaccaccaaggccttggaacaagagaccaaaagggctcatagggaagaacatggctggaacaaattacgaggggctatgtggggcagtaacagcgagcttaagctccggagggaggaaagggaccaatcacgagtagacactttgatcgtgaaggatgagttgaag

SEQ ID NO: 46856 - DNA, 243 bp, Glycine max
  Peptide Sequence Number=SeqID_138541
atgcgaaatgttgagaacaaagctaatgcggttatcgtacgcatgtgggtgaatagtgtgcacgaaaatgtcattggttcacgtgcattagaatctcgatgcgtgacagtaccacagttgatgttaatgtgctttggaatctcgaggccttgcaacgagacaaattataaatgtgctttggaatctcgaggcactacagttatcttaagtgtatttgtgcttgcaaaaccgaacatagtgtaa

SEQ ID NO: 46857 - DNA, 120 bp, Glycine max
  Peptide Sequence Number=SeqID_138542
atggtacatctcttgtggatcagttcaagtggagtgtacatccacttgattgttcaaagagagcaagggagggttattggaaatctcaagaaccggtggttgcttggggagtggacatag

SEQ ID NO: 46858 - DNA, 198 bp, Glycine max
  Peptide Sequence Number=SeqID_138543
atggaggttgatgaaccttggctagggttatggctaccattgaattatcaagtagatatgggagaaaggattgcctttgtggataactgggcagtgggtaaggagaaggggattttctatttaggaacgacagtcgcagcatgggtttctccttcattctcaccctcttcctttgccccagttttctcattcgtctaa

SEQ ID NO: 46859 - DNA, 215 bp, Glycine max
  Peptide Sequence Number=SeqID_138544
ctgtctctagaatatgtccattggatttaatgatgaaatatgcgcaatttcagttgagcttagctcatcagtgggctaagtgtgcatccaccgctaagtgcagcttcaacactcttagcgtgatagaagaatctggcagggcatcaatatcaaggccatgcgctaagcacgagattagtgcactaagcacaacagttgtcttcagccaggcttag

SEQ ID NO: 46860 - DNA, 480 bp, Glycine max
  Peptide Sequence Number=SeqID_138545
atgttggctactgttgcttcttgtatgcgaggtaattcttcagcaaggaatttagctccactagatttggagattgaagctacttgcaggagaaacaatgcagaaaggaggagaaaagctttgcaagagaggatagtacaaccaagttccaagggaactcgttcatccgaatcatctttagcatttccagcagacttgagggaatccgaagttggtgcatctgaagcacacatcatggtggaagatcaaccacagagggttactctagaggactactccagctctatcgtgccgcaatttttcacaagcattgcgcggccagaagtccaagctcacaacatcacatattcacattccttgatccagttgattcaaggaaatctgtttcatggttttcctaatgaagacccttatgcacaccttgcaacatacatagaaatctgtaatacaatgaaaattgtaggggtgcctgaagatgca

SEQ ID NO: 46861 - DNA, 429 bp, Glycine max
  Peptide Sequence Number=SeqID_138546
atggaaacgtgtttggaagtggaggaattgttacaacggatgatagatcaaggtcgactggaagtcggcagtgagggaagagaagagcaacatatatgcatgcagtccgcggaggagagcagtcttgcgaagcctaaacctttggaagaagaaaccaccaatatcagttcattgtcggccaaagtaaccaatatcacggggctgagcggtgtgacccacagtggtcgtgtatttgtgccccctgacctaccaattcagcccacgaacgtcaaggggaaggcaaaggatattccggcgaaaggtcttccggagaaaagggatggttatggcaaaaaggaggtgtcactagaggaagccagcgagtttctccgtacaattcagcagagcgagttcaaggttattgagcagctcaacaaaaccccggccaag

SEQ ID NO: 46862 - DNA, 105 bp, Glycine max
  Peptide Sequence Number=SeqID_138547
atgggtagtgagcagaaagttctaccagggacagtaggaaaaggcggaatagtgaaagatcctgctgttcatcaagaggtgcgtgatttttggctatttgattag

SEQ ID NO: 46863 - DNA, 281 bp, Glycine max
  Peptide Sequence Number=SeqID_138548
atgtctaaagaagttgatatggattatcaaaatgaagaagaatgtggtatgaatgaaccacatgttgattgttcggatgcgttcaatacttctcaggtgtttgaccgccgagatgatgttttgcagcgggctcgatccgttgctcatgaaaacagattgtggcggagtgatgagtataggtgtaggaagaaagaatttgttagaggagatactgggactaggaaatgtggatgtcccttcaagcttcgtggcaagcaatggttggtcgacaaggctggatg

SEQ ID NO: 46864 - DNA, 320 bp, Glycine max
  Peptide Sequence Number=SeqID_138549
gttacatcctttgtggtacaagtagagggtacatctacttgggttgttatactgagaacaagagagggtacatctcttgtggatcagtacaagtagagggtacatctgcttgggttgttatactgagaacaagaaagggtgcatctcttgtggatgaattcaagtggagggtacatccacttggttgttcaaagagaacaagggagggtacatcccttgtggatctttggcttgtaaagcattttataaggttgaaagaaatatcaagaaccattggttgcttggggactagatgtaggcatggattgtggctgaactag

SEQ ID NO: 46865 - DNA, 249 bp, Glycine max
  Peptide Sequence Number=SeqID_138550
atgagtgcttctagtcctagtcaagctaaagaacaagatgatgataccagacctttatggacctattgtgattttacctttaatgggtcttacactagaatgagggcacacttgttgaagatgacaagaaatggagttagagtttgtcaaaaggtaacagttgccaaacttatagatttgaagaagatagacaatgaggctacattgagggtggagaggtcaaaaacaaaatctgtgtcattgcctccg

SEQ ID NO: 46866 - DNA, 555 bp, Glycine max
  Peptide Sequence Number=SeqID_138551
gagtgcgagtttagtcagagaaggaaccgggccgatggatttgacgaggagtccatcgcccagctgttatgcataccgggtcaggattttgcccgaaccgctgccgggagatgtggcactgacgttgctgctcaggcaatgtcctacccaacgatcataactccgcacatcctccctttctgccgaagtgtcagctggtgtatgcctcctgacacggatgagcgtccgtggctcacgttgatcgcccttacaatctgctctggggccgcactagttaagggccagccccgacacccggccctgaaaatgcacccgctgacgcgccctgacgggtgtctgctcccggcatccgcttacagacaagctgtgaccgtctccgggagctgcatgaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggctag

SEQ ID NO: 46867 - DNA, 479 bp, Glycine max
  Peptide Sequence Number=SeqID_138552
agtgcgccatcacactcgaagatgttgcacttcatctaggcattagagtcgatggtcgtgttgtggctggacctagcttcttacattgggatgagttatgtcacgagttactaggggaagtcgctcccgaaaatgcacgtaaaggagccgcactgaagctgacatggttactaagcatgttgcacgcactattgcccaaagaaccaacaatgcaccaactacaatgcaggtgtagagcttacataatgtacatgattggcgcaaacctgtataaagaactatgtcgagcatcatcggaggttggtaaatctatgggtggttgtgtcatactattgcagtcatggacttggtaccgcatgccttttattgcaccaagagtcccacgacccgaaacaacttttccactggctaaaagggtcatacctcatggtgacttagtcggatataggtctcgtatagatcatatagagagccatgag

SEQ ID NO: 46868 - DNA, 812 bp, Glycine max
  Peptide Sequence Number=SeqID_138553
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttttatctacgtcaagatttaagtcatcttaaagtgttattacccaaatctcctgatcgtacaaccgaggcacgctcgtcgtctttgagtcgtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46869 - DNA, 261 bp, Glycine max
  Peptide Sequence Number=SeqID_138554
atggtcattattgtcaatgcggaagcttgtggttacgtgagcatgaactactaccaatatatagatgttgtttacacaaatgagcacatcttcaaagcttactccgcacaatggtggcctcttgggaatgaagcggctattcctccttctaatgacgcatggacacttatccctgaccccactacaattcgtgcgaaaggtcagcctaaatcaacaaggataaggaatgagatggattgggtcgaatcatttgagcactga

SEQ ID NO: 46870 - DNA, 477 bp, Glycine max
  Peptide Sequence Number=SeqID_138555
atgtgggctttccttactggtcgtcagatcgactgggctcacttggttaggtaccgaatgcataaggcattacgggcctatgcacctcttccttatcctcaattggtcaccctttttctctgtcattttcaaattcctattgatgatgaaccttttgttcaagttaagggatcttttgctataggtgttggtgcagtaacttcatttggttatcgtaaggatcgtgatgggcaatggctgaagaaggacatgctacctccgcaagacgagcgtactccttctcctcctccacaacgagatgattccttagcccttatgaatgaatttctttcggaattacggggcctccgcacgtatgttggtgaatgctttgattccttggaaggtcactttgaaggaatggatacccgcatcacccagcttgaagaagatgtgagttatcttcgtcggtgcttcgatcttccaccaccttcctag

SEQ ID NO: 46871 - DNA, 420 bp, Glycine max
  Peptide Sequence Number=SeqID_138556
atgggtaaagcggaggaggtacaagagcagatgaaggccgacatggaggccatgaaagagaaaatggccaaaatgatggaggccataataagcatgaaaaagataaaggaagtcgatacggttgcagtttccgctaccagtgttgttgctaaggtgaacccgatgcccccatctggcctcaaccaaatgaatcatccaacctcaaatatggtaggcaaagatttgggaagtacggacggccccatgatgtgcaaattcaaaatgagcacgccttcccatcatatggcttgcctcccaactatacaccacccaatgtggcatacattcccaatgaggatgtcaataactccgctcccatactcattgaaatgtctctcaacccatggggggaggcacatgaaattccccaccacaatctag

SEQ ID NO: 46872 - DNA, 1000 bp, Glycine max
  Peptide Sequence Number=SeqID_138557
atgtgggagaacgagttccgctacctgacccaggcgggtacaggcttgatggagctcgattatctgccgtcagataaagtcttccaggatgagcatccgagcgaaggggacaaacaccgttggttgtactactggcgccatgcgggtgtgatggatcaggtctggcgttttaacgtcgactacaccaaggtcagcgatccttactacttcaacgactttgactccaaatacggttcaagtaccgatggttatgcgacgcagaaattcagcgttggctatgctattcaaaactttaacgccacggtctcaacgaaacagttccaggtctttagtacccagacgcgaagcacttacggcgcagagccgcagctggatgtgaactggtatcagaacgatgttgggccatttgacactcgcgtttacgcgcaggcggtccatttcgtgaataccaactcggatatgccggaagccacgcgtatccacctggagccgaccatcaacctgccgtggtctaacgactgggcaagcctgaacacagaagccaagctgatggcgacacactatcagcagaaaaatgtggatgattacaacgccagtaacaacaccgatcttcaggaatcggttaaccgtacccttccgcaatttaaaatggacggtaagctgatctttgaacgtgatatgggattactggctgatggctatacgcaaacgctggaaccgcggatgcagtatctctacgtgccgtatcgcgaccagagcaaaatccagaactacgactcgtccttcctgcagtctgactacagcggcctgttccgtgaccgtacctacggcggtcttgaccgtattgcctccgctaaccagttaacgaccggtgtcacaacgcgcgtatatgatgacgctgccgttgaacgttttaacgtttctgttggtcaaatctactatttcaccgagtctcgcaccggtgatgacaacattaactgggagaaagacaacaagaccg

SEQ ID NO: 46873 - DNA, 381 bp, Glycine max
  Peptide Sequence Number=SeqID_138558
atggcggcgaagatttcattggcaattggtttgagaactctcttcactgttttgggacttcttatgcttgctatcgttctttacactgtcttcaccgatggtcttccgtttcgcaaagaacttctcacacccatcactacatctgcctatattgttgtgcaatttctgaagctgtcatctcaagaatcttcacaggatcctatgtattatgttctattgcggaatccaaataagaacggcacagcacctcaaagaaagcattcatctatcgtgactctaagaataattttcagcattttgggtgttgtcatgcttggaactttggtgtacactcttatcaccgatggttctcctttccgtatagagcttataactccgtaa

SEQ ID NO: 46874 - DNA, 453 bp, Glycine max
  Peptide Sequence Number=SeqID_138559
atggcggcgaagatttcattggcaattggtttgagaactctcttcactgttttgggacttctcatgcttgctgtctttctttacactgccttcaccgatggtctaggtgttcgctttctcaaagaacttgtcagacccttttgctgtctggattgcttacaaggaatcaaacttgatcagctcaattctgtggattgttttgattgccttgttagggagctctcaatgctattcaaatgtgcttggcacagtacaagtggatatcacagagggagaggtagacatagagaagaggtgagaaagagagtggatcccagacagagctacgttgaaactaggcttggacaacatcaccggtaccaccatgcaaactggagggagagagatgatatcacaactttctatttgacgaggttccccgaagatacaacggagaaggatccttgggcctag

SEQ ID NO: 46875 - DNA, 2763 bp, Glycine max
  Peptide Sequence Number=SeqID_138560
atgggtgaggcttcgggagctggttccgctgattgtttcagccagatgatgtcgtcgatgccgggttttcgcttccatcccacggatgaggagttggtgatgtactatctgaagcggaagatttgtgggaagaggctgaagctcgacgtgattcatgaaaccgatgtgtataagtgggatcccgaggatttgcctgggcaatctatattgaaaacgggagataggcaatggttctttttctgtcacagagataggaaatatcctaatggtggaaggtctaaccgagcaaccagacgtgggtattggaaagcaacaggaaaggatcgtaacgtgatatgcaattctaggtcagttggagtgaaaaagaccctggttttctacgcaggcagagctcctagtggtgagcggactgattgggttatgcatgaatacaccttggatgaagaggagcttaagagatgccagggtgttaaggactattatgcactttacaaggtttacaagaaaagtggacctggtcctaaaaatggtgaacagtatggtgcaccatttaatgaagaagagtgggcagatgatgacatagtagattttaatattaactcagctgatcaggaggctccaaatgatgttgctgataatgttaatgtaccactgccttttcttgatgatgaaatcaataacatcattagggaaattttggatgatgagcttgtcctagatcagcagcatgtgaatggctatcctgactttcctcaggttgttagtgaagaaacacaaagtactgttgtggatcagttctctgaggatgtgatgctccctgaaccagtcagaatctcacatcctagctgccaattttttgatgcacagcctagctttgacttcaatcggccagttacttctcatctgcatgtttctgaaacatctgaggtcacttctgcttccaacattaaaacaaaggagcttgactttaatgaggatggcttcttggaaattaatgatctcattgatactgaacctacattgtcaaatgttgaaaattctgtggagtaccagcattttgaagatgggttaagtgaacttgatttgttccaagatgcacagatgtttcttcgtgacttggggccaattattcatgaaacagattcacatgcatatacaaatgcccttgtcagcagcaatattgaatgtcaaagttaccaattgctgccaaatccagaggatgccaatcaaactgttggtgaattctggatgcatggtgaaagtaatcagctatcatccccaggtgttgtatatgaatctgttggctttcctacggaaggcaataacaatcaaagtagcactgtggaagatgttgctacaagtagcttgtcctctgctctctgggcctttgttgagtcaatacctactactcctgcatcagctgctgaaagtgcattggtgaaccgagctttgaatcgaatgtctagcttcagcaggttgaagatcaagcacaccaacattgctgcatcagatcgaatcgaaacgcgaataagtttctttctctctcgttggacgaataatggttctgaggaggaagaagatggagcagcgcttcaccttcttctgctgttgatttcatggccacctcccagtcccagcatcgctgcgttttcggtattccacacactctctctctcttcgcacttttctgttgggaatataccgtatgatgccacagaggaacagcttatcgaaatctgccaagaggttggcccagtagtctcattcagactagttattgacagagaaactgggaaaccaaaaggttatggattctgtgagtacaaggatgaagagacggctttgagtgctcgacgaaatcttcagggttatgaaattaatgggcggcaattacgcgttgattttgccgaaaatgataaagggaatgatagaaatcgagaacagggtcgtggcggtcctggaatgacaacaaatgttgaccatcagaaacaagttggtgtcccagctgtccatggggaagctgttcagcatcagcctattggtcttcatattgccataacagctgcagctgtcatgacagcagctctaggtggtgctcagtttggcatccagtcaaatcaaaacagtttgcagagtcagtcagcattggcacatgatcctttaactctgcatctggccaaaatgtccaggagtcagctgacagagattatctctgagctgaagggaatggctacacaaaacaaagaactggctcgccagctgttgctttcaaggccgcagttgcccaaggctctttttcagttacaaatgccaaaccttaggctggtttctgatcaaacctcacagtcttcaatgaatgaaggccagctgggtcaggcatcattggttcaaactctgtcaggccttcctcatgggcaggacaagttgcagcctggtttgacaccttatgctcaagaaggccaagtcaacaccatacctcataatcctttggttcctagtcaattaactgcgcatccaaagcctccagtgcagcctcggattccccttcagcaaaatccaaacaatcttgtactgccaggaacattgtctgggcagtctaatttaatgcttccttctgcacgttctccaggtttgggaagtttgtctgttaggcctccaattcaactggcaacttcaactgctctaaaccagcaaatgcatgcctctttgctacagcattctgtacatgttggaaactcaactgtaggacataatgttcaaaag

SEQ ID NO: 46876 - DNA, 429 bp, Glycine max
  Peptide Sequence Number=SeqID_138561
atggaaaaccttccaccattgatgtgcaaaaacctcattagaaaaagaacctctaggcgatctacaatgtatcttggtgtgagaaaaaggccatggggaagatacgctgctgagattaggaacccatataccaaagagagacgctggctaggcacatttgacactgctgaagaggctgctatagcttatgatctttcatctatcaagatttgtggcattaatgctcgaactaattttcactacccttttgtgtctcttccaccacctcctatgtcgttgcctcctccaccgccaccgccgaccccggagttggatccaagtgttgaagtttgtccagagatgaatgctgcttacgatggcgatgatgaatctctggtcattgcttccattttgcaaagtttttctaatactggtaactgttcattttag

SEQ ID NO: 46877 - DNA, 4794 bp, Glycine max
  Peptide Sequence Number=SeqID_138562
atgtgtagtatgtgccattattgtggtgtgggcttgacagaatcaaattttgacaacaagaaacagggaaatgagagtagtctaaagttgaatggtaaagtttccattaggccttgcaaatcttgtggagagaagctagagcgagcaaatgcgaaatggcatagtacaagtccatatgcaacaccacttatcagtccaactatgtcattgctaagtactgatagctgtatctccacttgcagtgagttttcagttgatgtgaactcatctgacaggaatagtcaagaagaaagttcagttgaaggcattgtggaagagcttgattataagttgaatggttcacaaaaagtgatggaaaacaataacaacaatgagggttacacagtgagagatgtggagattgcacaaaactttcaagaagtaaaagctgatttttctgaagaacctattgcatcctctgctgtcgaagaagctgaatattctcttcctgatgatttggatgtccaaacttgggaacctcctgagccagaaaacccacaggatgatatggaaaatagtgtgacttgtaatgacgatgatgaagaccagggcctagggattgcaaactggggtgagcctacctctatgagtagttctgaggatgaattaagtgggagctataggttcaaagaggaaaaacaaaaagcaatggaagaagtaatgaatgggaaattcaaggcacttgttggtcagcttcttaaatctgtgggagtttcctcttctgatgaaggtgataagagttgggtggacatagttacatctttatcatgggaagctgcttcttttttgaagcctggtgcaattggaggtaatgcaatgaatcctgatggatatgttaaagtgaagtgcattgctgctggttcccgcagccaaagtcaactaatcagaggtttggtcttcaaaaaacatgctgctcacaagcatatgcctactaagtataaaaatccaagattattactgattagcggtgtgcttggccattctatcaatggactgtcttcctttgactccatggaccaggagaaagatgatctgaaatctaaaatggatcgtatagaaatgtgccatccaaatgttatattagtggagaaaactgtttctcgtgatatacaagagtcaattttggcaaagggaatgacacttgtgcttgatatgaagcttcatcgtctagaaagagttgcacgttgtactagttcaccaattttatcatgcgataatttgaacggtcaaaagctaagacactgtgactttatctattttgagaagtttgtggaggaacatgatgctgttggtgaaggaggaaagaagcccatcaagactttgatgttcattgagggctgtcctacacgtttgggctgcacgattttactgaaaggtacacacagtgatgaactgaagaggatcaaatgtgtcatacggtgtgcagttgtcatggcatatcacttgatccttgaaacctcttttcttgttgatcagaaagcaatgttctctaccattcctgctgtgagtgtagcagatatcttgccaactgataaaaaatcctgtgattcagcatccattaattcaagcattccatctcttgagtattctgctgagaatggaatagttagtactgatattcccatatgcagtggacttcatgaaaaaaacaccaatggtttaaaccttggatcggaggagttttcccaattctcttgtgaaccatataatccagccgtcttttctgggttctcagctatttcatcttctcttaagaaggttatgggggacagttttccctttgcatcttccgctccttatcaatctttatcagcatactttggcttcaatggaaggaaacctgatggtatggttaatgagtcaatttctgttttaaactctctagaggctgatgaaactaccacgatggaagcgaaaagtcattctaatgaagtgaagttacttaatggtggacaatccctgtcttcacctgtgcacttagattccaatgggaatataagtaaagatgatggaaataatagaaaagaactccaaagtaaagatgatatcaatgccgtgttggattctcagagtattttggtcttgatgtctagccggaatgccttaagagggactgtatgccagcaaagtcatttttcacatattatgttctacaagaattttgatattccacttggaaagtttctggaggaaaacttactcaatcagacaagactttgtgatgcttgtcaagaactgccagatgctcacttttattattatgctcatcactataaacagcttactatacaagttaaacgcttgccccaggaaaaaagtttgcttggagaggcagaagggaaaatttggatgtggagccgttgtcgaaaatgcaagtctggttctacaaagagagtattgatatccaccactgcccgtagtttatcatttggaaaatttttggagcttagcctttctcactattcttctagcagaaaattgagttgtggacattctcttgatagggattttctctacttctttggattaggtcacatggttgcaatgttcagatattcatctgttgccacatatactgtgtctatgcctcctcaaaagctagaattcagtggtgcaataagacaagagtggctttcaaaagagacccagaatgtgtatatgaaaggcataacattattcaccgaagttgcaaactgtttgaagacaatacaatttgatggccttggaggatcaattagagatttctctgaggttgagaaaatgttaaagcaagagcaagaagaatttgaggcaaacatcaagactgttgttgctaaaaagggggatccagatcaggctgccttcaaacttctcagtttaaaccgattgatgtgggatcttttgattaaatcctatgtgtgggttcggcgcttgtacccattacactcatctgatgtctctgagaaagttatgcaagaacacgattattcaaaggtggaaggtactgctagtagagaaactgggtctatgggtaattttattgaagatgggaatgccaatgtaaaaattatgtttgacacatctaagcaagtaaatgaactaccaataaaggaaattcctatcagtgggcctcttctagagtgcaatgaacaggctcatccatctaacacacagaatgaaaggataccaattgttgatgatttgagatcaaggagattgtctgaccaaaagttgaatttgagtctggatgttataccaactcatcttgaagtaggtgcaaattcttcaggttctacagatattcaaactaatcatttggtttctgatttcaagatattaaacaaaagtgcttccttgcattcaccaatttctaacatgctggattcaaatgattggttctggaagccatttgctgacattcggcagataggcataagggaactccagaaaagattattgccaaaatttgaatctgtaagctgctctattgctgaatatatacccacagcaaatcaattaatcactgaggaaggtacaaggttgcatatccctctcaagactgacaatcatgttgtgtctgacttcgagggtgaaccctcaagcataattgcttgtgcacttgcgttattgaaagatgcatatgaggtgtcagaagttgatgatgaggatgacagaaacgaaagtggaataacttcaaactcaacagaaagtttgcatggcttgacccatggcgctaccttaacttcttcacactcattttcaagaagttcttcagattcagattctgtgcattcagcaggaagcacttcttcagaggagtcacgagcctctcgtgctacagaaaaccatagcatagagattgctatgggttatgcaaaatcacttgggagggaaaaatattcagtgatatgtcattattttaagcagttccgtgaacttagaaattggtgttgcccatctgagcttgattttattgcttctttaagccgctgtaggaattgggatgccaaaggtggaaaaagcaagtcctattttgcaaaaacacttgatgacagattcatcataaaagagattaagaagacagaacttgattcatttttggggttttcttctctgtatttcaaacacatgagagaatcatttgaatttggcagccaaacttgtcttgcaaaagtcttggggatatatcaggttactaaaagacacgtcaaaagtggaaaagaggttaaatatgaccccctcatggtgatggaaaatcttacctacaatagaaatattacacgccagtatgatcttaaaggtgctctttatgcccggtacaattctgctgccgatggtgctggagatgttcttttggatcagaactttgtgaatgacatgaattcttccccattatatgtcagccataaagcaaaacgtgttcttcaacgtgctgtttggaatgacacatcttttctgaattcaatcaatgtgatggattactccttgcttgttggagtagattctcagaagcacgagcttgtctgcgggatcattgattatctcaggcagtatacttgggacaaacatcttgagacatggatgaagtcttcacttgttgtgccaaaaaatgtgttgccaactgtaatctctcctaaagaatacaaaaagaggttcagaaagtttatgtctacatattttttgagtgttccagatcactggtgttcccagaaatcctccaatccttgcaaactttgttgctcaggggaagatgacccttcccagcaaaagccctag

SEQ ID NO: 46878 - DNA, 525 bp, Glycine max
  Peptide Sequence Number=SeqID_138563
atggggagaagcttgcagccgactcactataacggagaggatgttgttgatgactggatgaacccatatagcttactgaagcattgcttggacttggaatgtgtggagacatggggattgatggtaggaggacctaagagatggctgaacataaggtgtactggctatggagtggttacgggaaacagatgggctagtgatgatctcgcagaatgtaaggcagaggatgccatagatgctgtccgggcaatttgtattgctgaagatgaagctagagatgatctcgcagaaggtaaggcagaggatgccatagatgctgtccgggcaatttgtattgctgaagatgaagctagtgatgatcttgcagaagataagacagaggatgccatagatgctggggttgatgagagcaagggtgtggactctgaaggtggtggatcagttaagccggttctagcatcacgcttgcaaactggacaaaaggttctccatgaagtaagccacgaatccacacaggcagcatga

SEQ ID NO: 46879 - DNA, 894 bp, Glycine max
  Peptide Sequence Number=SeqID_138564
atgggtacttcaaatcttctcttgtttttctctctgatgagcctgtgtgctatggcggcttccaaggtggtgcttattgggaataatatcactctctcctttgatgatattgaagctaattttgccccagcagtcaaaggttctggaaaatatggggtcttatatttggcagaaccactggatgcgtgtgcagaattgacaaataaagttgaacaacttcccaatgcgagttcaccttttgctttggtggttagagggggatgtagctttgaggaaaaagtcagaatagcacaaaaggctggcttcaaagctgtaattgtctatgacaatgaagagggtggcatcttggttgcgatggcaggaaattctgctggtataagaatacacgctgtatttgtatctaaagcttcgggtgaaatactaaagaaatatgctgggttgactaatgtggaaatatggctcattccaacttttgaaaactcagcatggtctatcatggcaatttcatttatttccctgctagctatgtctgctgtcctggccacttgtttcttcgtccgcaagcatcgcataagaagagaaaggcctcgagcttctcttgttcgtgaatttcatggtatgagtagtcgcctagtgaaagcaatgccgagtttggtatttacttctgttttggaagataactgtacatcaagaacatgtgctatatgccttgaagactattgtgttggtgagaagctcaggattctgccctgctgtcacatgtatgcttgtgtactgggggcattgttcagcttgaattccctgaggcctcaagcaggatatctctttgcttggaagcttacactgatgttccagcttctcccacccttctgttcctctacaaactatggttaa

SEQ ID NO: 46880 - DNA, 594 bp, Glycine max
  Peptide Sequence Number=SeqID_138565
gtagctgaagttggtagtaaattattcctattgcaggaagaaggatgggttgtgtgccgagcatttcgaaaacctagtccaagtcacaggcaaggttttgacccatggtgcagcactagtagtcaacaacaacactttttcagagatcaaattcaaagctatgcaagacccttatcaattgccgacattttgaatgaaacaaataatgtgcctcaccctgttgaaggtacaagttttagtcactccttcaactcggataatcagcaacacttgaataatattatatcaaaccaaactgctatcattatggacaaacaactccttgagcttccacagctagatagtcccactgcaagtttggcaatcaaagaatgtaaccaacaacaacacaatggcctaacaaatgaggagtattgcagtgatgaaagaagcaatagcagtgcacaaggcatcgattggaagagcttcgacaacttgtttgggtcacaattgagtgataatgcagcttatttttcacatccaaacttgcccttggtgatgccccataaccatgatcaagctagtcatatcctaggatgcttccctgattcataa

SEQ ID NO: 46881 - DNA, 1119 bp, Glycine max
  Peptide Sequence Number=SeqID_138566
atggaggataccaatgagttgttgcacctcttggtggatgctatgaataggggattgcgtgatgtcaatggtcggatgaagtggtttcgaaaccagtataacatgatgtcaacccttatgcgcaacaactctggctttggatgggacccaattggaaaaactttcactgctcatgaggatgtatggaaagattacttaaagtcccacccaagtcacagcaaacttcgaggaaaaagtatggttgattatgagtatttgaagatcgttgttgggggtggagtttctagcgggaataattctatatcagtcgatccagatgatactgatgcaacaacttttgagccagaaaatagaactgttgggatagaagaattttcatatgatcctaatagtgatacattcataacaccaaataactatgaaccagcatatcagcctccatcaccaaaccaaccaagtccaccatcccacccccctttagattcagaggttcccatagaaaaacaaaactgtcacaagcgaaggagatccgagtatggagggagttcaagcgctgttgggatcaacaatcaaggcaacgttctggaaaatctttctgttggcattgagactattgctgtgaattttgaaaaaatatccaacatgatggagaaaagagaaaaagatagagatagagatagagagctcgaggtcagggggccaagatttcccgtgccactgggaagaaaagatggcctaaccttcagcataaaccttccaggaacgtcttcccgaaccgggcagctcctggacagattcgccgccagaaagttcgacgccaccgacgtggtggcgctctccggcgcgcacaccttcgggcgggcccactgcgccacattcttcaacagaatgaaccagacggatccaaccatcgacccttccttgaacaacaacctcatgaaaacatggaaccagaaactgttctttgacaagtttgcaaatgcggttgttaagttgagtcagttggatgtgttgaccgggaaacaaggacagattcgcgccaaatgctccgtccccgacacgaagaaggtgctcacctctatggtggaagagggactggatttaagtgctcagatgtga

SEQ ID NO: 46882 - DNA, 1680 bp, Glycine max
  Peptide Sequence Number=SeqID_138567
atggctcagcagaggcaatcgggaatggagaggtttggggtgagagatctgcaccacgccaacggcgccggcgatcacgtcgccgtcgggattcgcggtggcgccgccctcaagcagccgcggctccggcgatcggcgcgatcggacagggccactcacctgtcggtggccgcaatcctcgttttcctcttcctcgtacttgtcgtcactgtgctcgtattctcttacatttctagagacgattgtaaatctgtggttgcagaaataagtaacaatggtggcgatagtgatgatttaaagagtgattctgattttcttacaaatgtaccacggatccagaggaagaaagtccttgactttgggcatggctctgggggacatggccgggattcgagatattgggatagggatgataggagaagggatggtgattacggcgaggatatgatggagcagacgagtaaggatcatggagatgaaaatgctgaagatgatgcttctgtaaagacggatcatgattcaaagtcttctcaggatggtttacagcggagaggtgatggcttgtataatgaagctggacgtcatgagttgaaaaggtatgaggcagaatatgaggcttctttgaagaatctgggacactccactgaagatgatgggaaagtgtcgcatgacactgatctggaaaagaagaatgcagcggatgacattgatgatgaatatgatgacttttttgattttcacgatgctcaaatggaagattctggtgatagcaaaaatatgaaagtaaaacattctaattctagtgtgctaagcttggacaatgaggttcagaaacagaaagaacctaatgattcttttgatgaggaaaacaacgatgatgttacttctgaagatgttgaagggacatcttcctttaataaaaaaaaatctcatgatggaaaaacaaatgctaaacatgcaaatccttctaatggacaatcaactagaaaatcacatcctgaaacaaagaagaaagccaaacgacgcaaattttcaggtcatcagagcttagaagagagagaaagttcatttttggcacgtgatcagcaaataaactgtggttttgttaaaggtcctgaagggtctcaaagcactggatttgacttgacagaagatgatgcaaattacatcagcagccaccaaaacagtaatgcttctactttatcttctatttcagtttgtggggttggagaggtgtttggagttgaaaaatcatctgctgggatccaattgcaaggtatgggatttgagttccatgttagaagtatgggattttggtgcgagtgcttgcccaaaactaatcaaagggcaagtgcacagctggcctgcataggtgccaaggttgcaatgcgtggtgggatgttaggatcccatttcaaggtcactcgattgtcaaggaagaatgtctgctttgtgatgtttactgatgaaattacaatacggacactttcttcagaaggtcatgtgcctgatagaatgggtttcattggcttttggaaattagtggtagtgaagaatctaccctatgatgatatgcggagagtgggcaaaattcctaagttattgccgcatcgactttttccttttgcaagtattgatttagatgatgctttaatcatggcaactgcttggtggcattaa

SEQ ID NO: 46883 - DNA, 2742 bp, Glycine max
  Peptide Sequence Number=SeqID_138568
atggcttccattgccgccatggcagaaaacaagaacccagaacaagaagaccaagccagattcccaattctgacggtgctcaagaacaacgcaattgtcaagagcatcttcatcgtactcgatgaccacaacgaggatcagatggtcttgattggccgacaccctaactgcaacatcgtcctcacgcaccctagcgtgagccgcttccacctcaggattcgctccaaccattcttcccgcactctttccctctttgatttggcttctgtgcatggtacgtgggtgcgtgggaggaagctcgaacccggtgtgagtgctgaattgaaggaaggtgacactttcactgttgggatatccactaggatttatcgtctcagctgggctcctcttacccaattggatgatgagaatctggaacttagagcagaggaagagattccgatgcctgaagacattgtttctctttgttgtgatgaagaaaggaagagccatgctgaagatgaggcattgggagttctcaatggaactgaaacatcatgtgctccaacaaactctggtggtgaaaacataatttgtgactgtcaattatcacccccatacatacaatcacccccttatgcacaaccggttgatgaacttcataacaccaagaaaattgaagcttgtgttgaagggaccaagatacagcaatttcaagccccacatgatacttttactggacaaccaccttccttggaaatgcattggtccagcttcccaatgaatattgatcccacgtctttccatggaaaagatgttgctgcagtggctgtagtacctacagaatctgaatttggatgcacacacgaagataatgacaatattgaaggtattttaaatactggatcaagaacattcaattctgagaacacgcgtttgatagttgacgaagatattcctgattctgaatttcatcaaatggaagtcgttgaagaagtttctgtggattcagtacctggtggagaaaaacaagatgaattgcattggtccagctcacctacaaatcttgatcatgcgtctttagatgaaaaatttgttgctgcagtggctataatacccacagaatctgaatttggatgcacacatggagctaatgataaggttgaagatattttaactactggatcaagaatattcaattctgagaacacatgtttgatagttgacaaagatattcctgattctgaatttcatcaaatggaagttgaagaaatttcagtggattcagtacctgatggagaaaaacaagatgaatgcaaggaagaggacctgaatgctaaatcttgccgtgaagaagggtactcactggatgaagtagttgaagataatggaaacaaatgcattaaaaccatagatcctgcatcttttgatggaaagggcttggctacagtgactgtaatacccacagaatctgaatttggatggacactcggagataatgaaaggattgaagatattttagaaatggagtcaagaactatcaattctgagaacacatccttgctagatgaagaagcgattcctgttgacaaatttcaactaatcaatattattgaagaagttgctatggattcaatatctgatggagaaaaagaagataaatgtgggatggagttggagtcaaagttgccggcttccctgaatgagaaatcctgtcacgaacaagaatcaccaaattcttcaatgccttgggaacagacccctcaatctctcactgctgtgacaggatgctctggagggaagtgtaagcctgctagtgcgccccaagttcgagccagaaagagtagatttgtgagcacagctaaggttggcactgaagttaaaaggagtaatgtaaagaatgttgtcataaataaatcaatgccaaaggatctttcctctgtttttgatgagaaagaagcattcactccaaataacgaaaacttgtgcccaaaatacctatcacttgcagtttatgaaaaagaaagcatctattcagccaaaaacataagcagtgtttctaacaaagtgaaccaaactccaaaagtagctcaagaatggaagtcacaaagaaagcctctccaatgtcgtatcaacttggtccatgagcaagatttgatgcagttaaaaaagaacagagtggaaagggtaccacccttccaatcactaatgaactctagaggcaatcataaatctgtgactgtttctgctgcaaaaagcattgatgatgcccatatttgtggacagatttcaaacaagtgcactaaaccttctcagtatactagtagagaacaaaagaggagctgggacatggttgtagacactgcttctcttctgaacaaggagtcaaggaaagctttgcagcttctacaaggtctcaaggggacccgtttaaccattccaagtttagtcataagggaactaggcagtatgaagcaacaatttagaattttgagaacaacttcagaggcttctttggcattagagtggattgaagaatgcttggagaaaacaaggtggtggattcatatccaaagctcaatggaggagttcaggctgacagctctaacccctcctgcttctcctcagactcgatttattgaagagagttgggctttgcctggtttcaatacctcgaagaaatgtgcttcacctaaagttgaagatcacatccttgactgtgcccttccactttttcaccatgattttggcagccggaattga

SEQ ID NO: 46884 - DNA, 1386 bp, Glycine max
  Peptide Sequence Number=SeqID_138569
atggatcaatattgcttaccagcagattcttcgaacgcttactggcttctcctccaagttctctctcttatccctctctggcactaccttctccttgcagccttcattctcttctccattctctacaacttcctcgagctctatttcctccaagacctcttctccggattctcaggctcccctgtgcttctctcctacaacacttcctctagcattctcaacgccgtcgtttccaagtgcaagattcttcacggcagatatttcgccacgccctggctctgcagccctcacctccagactcttttcttgaactacttcgggaggcctcctcctttgaaatacaccaagcaattatttagcactgctgatggcgaaaccattgccttggattggctatccacttctcatgtttctggtgatgttgcttctgaagatgaatctgttcccattgttgtagttattcctggcctcacaagtgactcttcgtctcaatatatcaaacatcttgcgtatcacactgcaaagcgtggatggaaggttgttatctgtaaccaccgaggttttggaggtgtttcaatcacgtctggtttttcctacaatgctggatggactgaggatatccgcgcagtggttaattatctccataaagagaaatccatggcacctctgtttgttgttggaactagtattggagctaatattctggttaaatatcttggtgaggatggtgagaatattcctgttgccggagctgttgctgtttgctctccttgggaccttttgataggggacagatatatacgccgtaggcgtgtgcagaaaatttatgacaaagcgattgcatttggacttcaagattatgcaaaattacaccagtctcacttttctcgcaatgctaattgggaaggaatagaaaagtcgtttactgttcgggattttgatgaccatgccacccgtgttgttgctaagtatgagagtgtggatacgttctatagacgctgcagtagttctacttatgtgcaatctgtttccgttccgcttctctgtattagtgctttggatgatccaatctgtacaacggaagccattccttgggatgaatgcaaggcaaataaaaatatagtgttggctactgtaaaacatggaggacatcttgccttttttgaagggataactgcatctcatctttggtgggtaagagctgtaaatgaattccttggtgtactgcatagtagcaattatatgcatgtacaggagaagatttctaaaccaaacataccattggactcgtcaattgatcatggccgttattttaatgtagctgaagatggaatggtggctgaattgaacaatgaccaactgacaatgtggaagaaacacatgtaa

SEQ ID NO: 46885 - DNA, 1081 bp, Glycine max
  Peptide Sequence Number=SeqID_138570
atgggctgtgttcaggccaagccattggatttggaagaaggtccagaatacaggaccctagacaggttgaagttggataatggctgtgtgccaagtaccgactttgttgctcatagaagatccaccggtcaaagacatcatgaacctaataaggagtatgaaaggctgcatcagagaagagaacaacccagaaagcaaactaatgaacttattgagtctggtgttgccaatgctgaagggcttcatcataagggcaaggtggttggaagacaggggaggagagtcacacgtcgtgatgataagaacttggcaaaccagtgttgctttgaggatgatatggttgatgggtggccaaagtggttggttgataatgttcctacacaagtgttggctggcttggttcccaggagtgctgaatcctacaaaatgattgataaggctttcgacagccaacgtaaaactttgtcgaatctctacgacatggatcaattacgtaataatgtgaatgctaggtcgttgcccggaagcaacgcgctgtatggctcgagtacagtgtcaaaagagcaagggccgctgcaacgccgcccggatgtagtgaaaagtaagcaagggttcccacattttcgtgaacgggtgtgggtaaagaagctaattcatgacagaaggattcgctttggtacatggaatataggcacacttactggaaaatctatggaaatagtggatgttatggtgaggaggaagatcaattttatgtgcctacaagaaactaagtggacaggtgaaaaaacgaaagaattagacaactcgggatttaagctgtggtatacgggaaaaatcatatcaagaaatggggtagggattattgtggacaaggagtggaagaaggatgtcgtggatgttgggttagcagaacactttaaggtaaaattttgggaggatctagaaggggtacttcaggatataccccaaggagagaaagttttcctaggaggggatctcaatggacatgtaggtagcgtggctagaggttttgagggggtgcatgggggttttggcctaggggagatgaatggggagg

SEQ ID NO: 46886 - DNA, 210 bp, Glycine max
  Peptide Sequence Number=SeqID_138571
atgcaaaaccaggactcccaaaaatgtgtttctgaaaaaaaacccttggtagtgctatggcgccaacttgatagtgctatggtggaaactgccaaatgggctatgtttggttttgctgttggattgctaacagagtatgcaacaggatcagattttgttgatcaagtaaagatccttctatcaaattttgggatagtagatttggaatga

SEQ ID NO: 46887 - DNA, 216 bp, Glycine max
  Peptide Sequence Number=SeqID_138572
atggctattacaaggggcattaaggaattgacctaccacacttattgcaaagagagtgacgacgatggccgaaggggcacactgacggaagtgtggcacagtggctgtcaaaccctaatcactaataccatgagaggttgtacagatgtgggaggggatcaaactgcaaagaaggtcgcacacagatgtgggaggggatcaaaccctaatcattga

SEQ ID NO: 46888 - DNA, 561 bp, Glycine max
  Peptide Sequence Number=SeqID_138573
atggatcttctcatggacagctatgatgtagttattgctatgatttgctccgcattcaacttcaaatatgttgatttggcacaaggatatatgtccaatgatgaccttgaatgggccatccaagaaattggacaaagatgcagcaacatttccaggatatacagtattggaaagagtgtaaatggttttccactgtgggtgatagaaatttctgacaagccaggagaagaagagactgaacctgcatttaaggagattattgggtttattggaaatgtgcacggtgatgaacctgtgggacgtgagctgcttatatttttggccaattggttatgtgataaccatttgaaggatcctttggcaacattgattgtggagaatgttcaccttcatttacttccatcaatgaatcctgatgggtttagtttaaaaaagcgtggtaatgctaataatattgatctgaatcgggattttcctgaccaggttgtggaggatgctttattcttctgctggacatggcttaagaatttggaaaaaggatttgataccccattccattag

SEQ ID NO: 46889 - DNA, 493 bp, Glycine max
  Peptide Sequence Number=SeqID_138574
atgccggaatcggagacagggacgccgacggcggcgtcggtgccggcgacgccggatactccgggaggacccttattcacgtcgctgcgagttgactcactgtcgcacgagcgagactcgttcgcaatggcacggtgcaagtgtttgccgaccaagggccatatctgcttcactgatttctcagttggtgttccacttcccaatgtttctctcactcaaaaggttggagcagagtttgtggggactttcatattgatatttgctgcaactgctggaccaatagtgaacaacaagtacaatggagtagagactctaatgggaaatgcagcttgtgcagggctaacagtgatgttcattattctctccattggccacatctcgggtgcacacctgaacccatccctcaccattgccttcgcggcctttcgccacttcccttgggcccatgtcccagcctacatagcagcacaagtctctgcctccatctgtgcct

SEQ ID NO: 46890 - DNA, 1665 bp, Glycine max
  Peptide Sequence Number=SeqID_138575
atgaagcaagggtcagcaaacaaccaacagctcttgtgggcaagagtggttatgcgcaaatggcttaacatggccagtaacgagcctgattacaccgctgaccctgatgatgataatgaggaggaccctgaaagtgactcagataatgaagacgctgcaactccttttcagtttcgctatttctgtgatctgcctcaatttgaatatgcagagtggggcaaacggacacggtttggggacagcagagaggaactagctccaattgagtcaaatgaatttcttccaaggttaaggaggcaaaagtcattaacttctaggtctcagtatataaacaagaaggaactgagagtatgtgttggaacgtggaatgttggaggaaaacttccacctgatgacctagatattgatgattggttaggcattaacgagccagctgatatctatgttcttggtcttcaggagattgtaccattaaatcctggtaacatttttggtgctgaagacactcggccagtactgaaatgggaaaacattattcgagatacactgaatagagctagaccaaaagcaccaaagatgaaatccttcagtgatcctccatcaccatcaaaatttaagccatcagatgatgcgccagatatagaacaagaaatattacttgaaagtgatggtgatattggtgaggaagtccatcctttggatgaagaatacaatgtttatgaaggaggcgcagataaaccaatcacagatgaagaagccctgaatactaatttgcaggcttcagttgctgctgatattgccaacacaggagagccagttggcaatgatttacagagacagttttctgatggaaagaggttgaataggctgaattgcttccgtgacgaaaattcgactgaaaaaacggacacatcatcttctcaacaggccagtaagctatccagaatgattagtagttctgataggattggtttaagctggccagagccaccactacatctgctatctcagcgaccattggatagaccaacttcttttaaatctgttagatccttttcagcatcaaagtctttcagaacatgtcagaccttcaagcaaaccatagatgacataggattgcttgctgaaattgacctcgaggctttaatgaagcggaaaaggagatcatcatatgtaaggatagtgagcaaacagatggttgggattttcatcaccatatgggttcgtcgttgcttgcgtaaacatattcagaatttgaaggtgtcaactgttggtgttggtgttatgggctatattggtaacaagcttacgaaagaacttgagaaaggtgtatttgatggatggtcagaaggcaagttaaactttccaccaacttataagtatgagattaattcagagaaatactatggagaggacccaaaggttgggaggcgcacaccgtcatggtgcgatcgtattctttcatatggcaccggaatgagattacttagatatggaaggactgaactcaggttttcagaccacagaccagtgactgccacatacatggctgaggttgaggtgttctctccaaggaaactgcagaaagccctgactttcactgatgcagagattgaaaatgaagaagtcatggcaactttaggtagttggaatttagccaaataa

SEQ ID NO: 46891 - DNA, 225 bp, Glycine max
  Peptide Sequence Number=SeqID_138576
atgcagactcgccagttgttctgcactcttgtagggataagctcatccctttcattcttaatcactatgaggcctgtcttcttaggaaccacttggactagactcacccactggctgttagaaatgggagtcgcaacctacccatttgtgggtgagcgaggcgaggctcaccggtgcgtcttccataagaggaaaatgcgcggagtcgccaccaacgtttattga

SEQ ID NO: 46892 - DNA, 495 bp, Glycine max
  Peptide Sequence Number=SeqID_138577
atgaattcattgcctagcgctgttcatgtgtcctccaccttcgagtctggagccccgcgattagattgcctagcgctgttcgccaattctcaattctccacttttattcatagccccatgaattcattgccaagcggtgttcatgcatcctccaccaacgagtatgaaggcccgcgaattgattgcctagcgctgttcgccagttctcgattctttacttttattctgagccccatgaattcattgcctagtgctgttcatgtgtcctccaccttcgagtctggaggccgacgaattgattgcctcgcgctgttcgccaatgctccattctccacttttattcagagccccatgaatttattgtctagcgttgttcatgtgttctccatcttcgagtctggagccccgcgaattgattgcctagcgctgttcgccaattctccattctccacttttattccgagccccatgaattcattgcatagcgctgttcat

SEQ ID NO: 46893 - DNA, 267 bp, Glycine max
  Peptide Sequence Number=SeqID_138578
atggaggattgccttgagggtccgcacttaggcaatcatgaaacacaactcccaaatctcgaaagtggaggacacatgaacagcctggcaaaacggaattcatggggctccgaaaaagggagagaatggaggacttgccttgaagggtccgcacttaggcaatcatgtgaaacacagctccaaactcgaaagtggggacacatgaacagccctaggcaaaacgttcatggggctccgaaaaagggtgagaatggaggattgccttga

SEQ ID NO: 46894 - DNA, 246 bp, Glycine max
  Peptide Sequence Number=SeqID_138579
atggtgaaagttggaacctcttacgtgccgatcaacgtctcattttcgccaaaagttggcccagggcttcccggtatcaacagggacaccaggatttatttattctgggaagtgatcttccgtcacagctgtccctcctgttcagctacgacggggtggtgcgtaacggcaaaagcaccgccggacatcagcgctggcaagtgtagcggtcacgctgcgcgtaaccaccacacccgccgcgcttaa

SEQ ID NO: 46895 - DNA, 682 bp, Glycine max
  Peptide Sequence Number=SeqID_138580
ggtccgctcttgacggtgaagaacaccttggagaatggaggaatccaatcgggaaaataacaaagatcacatttcccagtcaagagggttctgctcttgacggtgaagaacacattggagaatggaggaacccaatcgggaaaataacaaagatcacatttcccggtgaagaggggtccgctcttgacggtgaagaacacattggagaatggaggaatccagtcgggaaaataacaaagatcacatttcccagtcacgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46896 - DNA, 564 bp, Glycine max
  Peptide Sequence Number=SeqID_138581
atgatacgcggagataccttatggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaaggcggcgggcccgataatacgcggagataccttacggttatccgcacccttttgtcatccagaggcggcgggcccgatgatacgcggagataccttacggttatccgcacccttttgtcatccagaggcggcgggcccgatgacaagcagagaccaaatttggtcattctgcacccttgtatcatccagaggcgacgggcccgatgatacgcggagataccttacggttatccgcacccttgtgtcatccagaggcggcgggcccgatgatacgcggaaatacccgagtggttatccgtataaacattcttttgctatctgtaagacagaacgcttgatagcatgcagaggctga

SEQ ID NO: 46897 - DNA, 492 bp, Glycine max
  Peptide Sequence Number=SeqID_138582
atggataatgaagagggcgtgcaggaacagatgaaggccgatctatcggccttaaaagatcaaatggcttccatctcggaggtcatgttaaaactccagaaaaccatagaggataaagccaccgcaaccgcctccagtatagttagggaagcggagccggtgctgcagcccgccttgaatccgggcctagacagaaacacggccgtgttcggtcgaaggtatagtccgcaagcttatccttatggcctgcctccggacttcaccccccgtgccaccccggaagatttaagccaagcccctacttttgaggggcaactcccaccttatgaagactatcccgggcaagacgatggggaaggagatacccatcttggccccctgctccacctcaaagatccatccccgcatgaactaccccagccaaacatagtccgccatatcccggcctcacccacacccgtaaaagaatctgttccctttcgcggaagataa

SEQ ID NO: 46898 - DNA, 1191 bp, Glycine max
  Peptide Sequence Number=SeqID_138583
agcctagatgtcaccagccttaaggagttgggacggttgatgggacccctccaaaggcaagccttttgcaaagtgtacagaaagattttagatttgaccatagcggaggtatttacggaagccattgtatccctcgcccaatactatgaccagccgttgagatgcttcacgtttggggatttccaaatagtatcgactgttgaagaatttgaggagattttaggatgccctcttgggggaagaaaaccgtatcttttatccgggtttcttccctccttgagcaagattgcagctgcaaggcaagggatatggcgagtcaagaagagccccccctggtttgcggatatactagctttgctaatctttggggttgtcctctttccaaacgtggatggtttggtggacctagccacaattgatgctttccttgcatatcaccatagcaaggagagcccggtggtagctatcttggcggacttatttgataaatttgaccgaagagtcgattgggaccaatacttggctgggataggaggcagcacaatcaactggtttcctcgatggaaggatggaaaggagggagttcttttctcatgtggggactacccaaatgttccgttgatagggacgaggggttgtattaactataatcctgcacttgccataagacagctagggtaccccatgaggggagcaccaacggaagagagcctctcacctttccttgtgagagatttcggcacgcaaagtctgaaggttctacaaagagtccacaaggcgttgaaaagtccgttgaggaaagataaagaacttaggggcatccataatggcatcatcggtggttatcatgaatggctaagagttcatacacgagggttagattggctctccaagttgaaagttatcaacgaggagaacttcaaagctccgggagaggatgaagaagtccaagctctaaaattagagctagggaaggcaagactcaccaaagaaaaattcaagtcagccgctactaacatccggaaagagtgtgctgagttacaagaggaaaacgcggctactgcaagagcccttgaacaagaaaccaagagggcctgcaaggaagagcatggccgagataaattccgaggagctttgtggggcaacaacaatgagctcaagctccggagagaggaaagagaccagtcacga

SEQ ID NO: 46899 - DNA, 537 bp, Glycine max
  Peptide Sequence Number=SeqID_138584
atgaaaacgtttcagtttgctcatggaaaacggtgtaacaagggtgaacactatcccatatcgccagctcaccgtctttcattgccatacgaaattccggatgagcattcatcaggcgggcaagaatatcaacgtgtcattttcgccaaaagttggcccagggcttcccggtatcaacagggacaccaggatttatttattctgcgaagtgatcttccgtcacaggtgctccagtgggttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttattgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 46900 - DNA, 731 bp, Glycine max
  Peptide Sequence Number=SeqID_138585
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttacatcttgatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46901 - DNA, 683 bp, Glycine max
  Peptide Sequence Number=SeqID_138586
ctcctcctcctcctcctcctacttcggacgcatcggcttcgccgtctgccgtgaagcggacacgcaaagcctcacatctacgatcgttgtccactagaccacctggtgctaagagaccagtggtgcatgttgatcctgctaccgggaaggccgacggtccccacaagaagaaattaagaacatatttggggattgtggcacgtgataaggtggacatcacctacgagaactggaaagaggcggaatttgatatcccagaggcttctgacagtaggacgaaaggaagttactacagacagtgggggagagatggaggcagtttaaatcagacctcacgaggaaatggacccttgcagccgatcaggacggtgtcgaggacactgtttgtgacaaatacgacatcagcaaggaaaagtgggcccagttttgccagactcatagagacccttcttgggaggatgtgcgcatcaaggcacaggccatcaagaagcagaatattgccccccacgtttagtctcgtggggaccaagaagaagatgcaggaagctgcacagtccggaaacgttgatggcgtcatcgaccctccatccccagtcagacgccacgtgaagtggaagatggcccgcacgaagaagacaggggagatgacgactaaggccgcaaaggaaatcgctgagaagatt

SEQ ID NO: 46902 - DNA, 204 bp, Glycine max
  Peptide Sequence Number=SeqID_138587
atgatgacaacaaaagatgatgacaaaggtgatgaacaaaaagctcaaagatcaaagaacaactcaagtgaatcaaagaacatctcaagtgaatcaagaacaagtcaagagttcaagaatcaaggagaattcaagactcaagaagaaagcctagaatcaagattcaagactcaagattcaagaatgaagaaaagactcaattaa

SEQ ID NO: 46903 - DNA, 552 bp, Glycine max
  Peptide Sequence Number=SeqID_138588
atgctttcatacctaacaaagaatcaccaacgcggaaaaacagtggcatacagtaaatatccaacttcagatgaaattgacctgattatatcagtagagataccttcaaaggaagatgaccaagaactctatgcattggtgcaaaatcatatggttcatggcccatgtggaattatacgctctgaatctccatgtatgaaagaaggaaagtctagtagattttatcctaaaatgttccaacctcgcactcttttagatgcaaatggttatccagtatatcgtaggagaaatgatggtcgtacaatttcaaagaatggtgttatcattgataatagacacatcgtaccttataatccaaaattattgaaaaaataccaagcgcatgtcaatattgaatggtgtaatcaaagtacttcaatcaaatatttattcaagtacataaacaaagggtataacagagtcactgctgttatgctttatgatggcaatgatgaaatccaaaatgctaccaaccagaaagatgagattaaagaatatatagactgcaggtag

SEQ ID NO: 46904 - DNA, 234 bp, Glycine max
  Peptide Sequence Number=SeqID_138589
atgtttcctcatgggaagatgcctaagaaatgggttttcaaaccttaccttactccgacataccaatcaccactaatatatatgtttttcttctttttgcagggggaaggaacggtacaatcctacccactaagggcattggatagaagactccaagaagattggaccaaagatgcaagagaaggccctaggattctcatgagccttatggtagatttcgggcccatgggctaa

SEQ ID NO: 46905 - DNA, 765 bp, Glycine max
  Peptide Sequence Number=SeqID_138590
atgaccatccagaatatgcaatttcagcaagagacaaaagccttcattcagagtctaacaaatcagatggggcagatggctactcacttgaaccaagctcagtcccaaaattctgacaaattgccttcacaaactatgcaaaatccaaaaaatgtgagtgccatcaccttgaggtatggcaaccaaattcaagtgcctccattagtagcaacacctgcacctgaacctgtcaagcttcattctacacctgaaaaagaggatgagatagttgcagaaaagagaaagcttcctaacagaaattttcaggtaggtggaccttcttctagtaattctgacttgaagcagcctcctatccctctttcattcccacctagagcaattccaaacaaaaaaaatggaagaagcgaaaaaagagatcttggagaccttcaggaaagtagaggtaagtctcattactgttttcttgatggtttttatggttatttacaaattcaaattgctcctgagtgtagaagcgaagactttgcctttgatgttttgatgatgccatatgatcgtgatgttttgatgccttctgaaaacgcgcttctcaagtttaattcaagacaaaaatccaagaatacaagatacaagatcaagaagatctctagtgttttaggaagggaattccaaattaaaactgcaaaaggtttggccaagaaatttaagcaaaaatgtatttttcaagagatttactctctggtaatcaattaccagaggatgtaa

SEQ ID NO: 46906 - DNA, 310 bp, Glycine max
  Peptide Sequence Number=SeqID_138591
cggagtccccgtcgcacctagtaaggtgattcggcaacccatcacccaagcttttattgagaagtattgcacgcagagacaggcacagggtggcgaccctcaggccccagatgcgccgcctccacctcctcaggctgacccagctgggtcatttgacacggagcgggaagaggtcgcatggcccggagattggcctgaggcccaggctgcagaggcatccgcagaggctcccggcgagccagatgaggcccgcgaggatgaggagatgtcagatttgctcggcttcttgggagggagtggagccacatga

SEQ ID NO: 46907 - DNA, 528 bp, Glycine max
  Peptide Sequence Number=SeqID_138592
ggtgttccttttgagggcactctagttgatgactggaaacatgtttattctagtcttgatgctcgtaaaatgatatgcactgaccatgctgatatgatcggcagattgttggctgggtcatttacctttgagtgtcgcatcatgcactatgttctttatcgaattttgcttcctaggtccaccaatcttgctcaagcctctgaagaggatttaatcttgttatgggctcttcaaatcggtcatcaaattgactgggcccatcttcatttcaatgtccctttagatgatgaaccttttgttaaggtgtgtaagcaagacctgccaccacccattcccaatgagcgtacaccgtctccaccaccgcaacggggtgactcttcttccttattaactgaagtcctcactgagctacgggatcttagagcttttgtcggtgatcgctttgatgaaatggactcccgtatcacgcgtcttgaagatgatatgagcttcatccgacgttgctttgatccacctgccgattcttag

SEQ ID NO: 46908 - DNA, 288 bp, Glycine max
  Peptide Sequence Number=SeqID_138593
atggggacaaggggttgcatcagttacaatcccgttcttgctataaggcaacttggctaccctatgagaggggcaccgctaaaggaagagctcgcgcttgtcatttcacgaggttttaataagaccaacatggagacacttcagaaggtccgcaaggcatgggaggtggtgcaaaagaaggacaaagaactcaagggcagtaacaatggacccatcagtggctatcgaaagtggttgaaagcccatgtgcaaggtttggattggctcccggaaattgagaaccactaa

SEQ ID NO: 46909 - DNA, 120 bp, Glycine max
  Peptide Sequence Number=SeqID_138594
atggagaattggcgaatagcgctaggcaatgacattcgcggggctccacactcgaaggctatcatgaagcatagctccaatctcgaaggtggaggacacatgaacagcactaggcaatga

SEQ ID NO: 46910 - DNA, 187 bp, Glycine max
  Peptide Sequence Number=SeqID_138595
ggtgttacaagctacaccagtgtacaatcatacagaagcactgccagacgaaattattcctctattaaaagtttcaggcaaccaacaaaggcttgagagattctctcgctcttggatcttaagattcataggagtggtgacgtttgttgacaaaagcagaaaaagggtgccaatgagatatttgtaa

SEQ ID NO: 46911 - DNA, 279 bp, Glycine max
  Peptide Sequence Number=SeqID_138596
atggtgaaagttggaacctcttacgtgccgatcaacgtctcattttcgccaaaagttgttgcccagggcttccgtacttattcgcaataccgtgcgacctcgaggggtgatgctgccgaacttactgatttagttagtgaggcactacgaccggacatcagcgtggcaagtgtagccggggtgcgacgctgcgctaactcaccaccccgccggttaattgctgccgctacagggcgcgctttccattcgggaaacctgtcaggctgcgcaactgcttaa

SEQ ID NO: 46912 - DNA, 261 bp, Glycine max
  Peptide Sequence Number=SeqID_138597
atgtcgaactcagatagcagaacctgccaccgagcaatccgcctcgtaatagcaggcttctcaaaaatgtatttgaccgggtccatcttggataccaaccaagataagaggtctcctaggcaccgacggcataagcataagaggattcataaggcattgtttgattcttccgaatgcctcttgacagtcgtcattccaacagacggactagttcttgtgcaagagtttgaagagtggctcgcaagtagcggtgagctgtga

SEQ ID NO: 46913 - DNA, 597 bp, Glycine max
  Peptide Sequence Number=SeqID_138598
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatacccccacagccgtcacctggacgaccaacgcgtccccgacgcctgcgtcgagcaggtgctcacccgcgcccacctcgacgctgccaacgacctaagcgactggcgcgtcgaggaggtggccgccggacggttcctcgtcgcccatcaagcttatcgataccgtcgacctcgagggggggcccggtaccagcttttgttccctttagtgagggttaa

SEQ ID NO: 46914 - DNA, 357 bp, Glycine max
  Peptide Sequence Number=SeqID_138599
atgagaaccctagggccttctttagtagctctagcccaagcctcctggagtcttctatccaatgcccttggggggttggattgcatcaaagcccacgtgcaaggtttggattggctcccgagtttgagaaccactaaaagagaggaagttgaggcaccagaggaagacgaagaggtgcaggcccttagggcagaactcgagcaagcccaaacagtcaaagaagggttcaaattagcagctcttaaaatccgaaaggagaatgccgaactaagagatacaaatatagctaccaccaaggccttggaacaagaaatcaagagggctcgtagggaagagcacagtcgaaacaagttctga

SEQ ID NO: 46915 - DNA, 342 bp, Glycine max
  Peptide Sequence Number=SeqID_138600
atggctaggggcaatccaggtgatttacaaccctttgatcctgaaatagatagaacctttcatagattagttaggcatagtgtgcatcctggtcattgtagaagcaagcttcatgatgaatcaagattaattcaaagaagttttgatgataacaaaagtgatgacaaaaagctcaaagaatcaaagaataagttcaagatgctcaagattgaatcaagaacacttcaagtttcaagaggaaatttgatttcaagaatcaagaatcaagattcaaggttcaagcttccaagaatcaagatcaagattcaagactcaagattcaagaatcaagagaagaattaa

SEQ ID NO: 46916 - DNA, 582 bp, Glycine max
  Peptide Sequence Number=SeqID_138601
atgccgaagtgtcagctggtgtacgccgtcctgacacggatgagcatccatgtggctcagttgatcgccgatgccatctatatttttgcaggtatggcgcccactaggcaccctttggacccagataagtccaacagggccctgggattccccgcactgatcacaggactctgccagtcgttcggagtccccgttgcacctaccaagagacaggctcagggtgatgctccacaggccgcaggcgcgcccccaccacctcatcaggctggccaggctggggcatttgacatggagcagtatttacggcatttggttcgccagcaggcggccaaccaccgagcacatgtacggacccatgattgtctgtaccagatgagccttagcatgcagagccagggcttcgctcctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttgggagggagtggagacacgtga

SEQ ID NO: 46917 - DNA, 918 bp, Glycine max
  Peptide Sequence Number=SeqID_138602
atgacagatccaggttcatctcaggaagcttgggagagatatacagatattgtggtgcctaggaaactactaccggataggaatgtggtagtttattacactaagtttgatgagttcaaggaggaactcgagagaagacactgggatgagaagttgactgattttgctaacaacaacatggacattgctattgtcaaggaattttacgccaacctctatgaccccaaggataaaccacctaagcaggtgagggtgagaggtcatctagtgaaatttgatgaggataccttgaacacattcctgaagaccgtagtgattctagaagaaggggaaattttgtgttctttttccaggtttgcactcctgaggcctgatcctcaggagttggctgctaagctctatatcttagggaggggattcgagctaaatgctgatgggcagccattgaagatattgaggaagaacatgaccactctagctcagacatggaacgttctttacttttttaacctgattcctacctcccacacatctgatgtcaccttggacagagccaagttgatttatggtatcattatgaagatggatatgaatttggggtacctcatctcccaccagatctctctgactgcacaacatgatacatccagacttggattccctgccttgatcacaactatatgcaaggccagaggagtccaatcagattctagatccctggagaacttgagccttgctattaacttggcatatattaagaagaactgttggaatcttgatggtccaatagtgacatttagagggccaaggaaggccagggatgctgcactccatgctccagagcttacacagggggcagtccattatcatgcagagccttcagggcttgggcttgtaatccatcatgagcatggatga

SEQ ID NO: 46918 - DNA, 938 bp, Glycine max
  Peptide Sequence Number=SeqID_138603
atggtgaaagttggaacctcttacgtgccgatcaacgtctcatttttcgccaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccatagggagcttatagcttcattgcactgggtccagatgcatcctgttttgagaatgttaatggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46919 - DNA, 471 bp, Glycine max
  Peptide Sequence Number=SeqID_138604
atggtgaaagttggaacctcttacgtggccgatcaacggtcgtcatgccaaggcccggcgcgctccgacgtgctatcaagaccttatttttcgaatatccgtcgacaggatttttcgggcaaggcgtcgctgcgtcccattcgccattcggtgcgcaactgttgggaagggcctgatcggtgcgggcctttcgctattaatgacggccagctggcgaaaggggaggcgcaagttgcgattaagttgggtaacgccaggagtgtccagtcactggcttactatgttactctcatgtggcagggaatgaagctgccaccgcggtgcgtccgctctagaatagtgatcccccgggcgcaggatattcgcttcctcggcctcactgagcacgactcggtcgttcgactcgcggcgagcggaaatggcttacgaacggggcggagatttcctggaagatgccaggaagatacttaa

SEQ ID NO: 46920 - DNA, 471 bp, Glycine max
  Peptide Sequence Number=SeqID_138605
atgactagaggcaatccatctgacttacaaccctttgatcctgagatagataggacatttcatagattagttaggcatcattttataccttttgatcattctgagcactccattactggtgaagctgtgcattctgttattagtgattttgaacatcctgatcttgagcattataattttgagcattctaattctgagcattctgattttgcacattctgagaacatggcacaacctccaccccatgagaggactctaagggaaatgactgcacctgatttcacctacgaaagcttgtgcatccaataccctgatgaggatgtcccatatgttcttaaaactggactgattcatttgcttccaaagtttcatggccttgcaggtgaagacccacacaaacatttgaaagaatttcacattgtctgctccaccatgaacccccagatgtccaagaggatcacatatttatga

SEQ ID NO: 46921 - DNA, 630 bp, Glycine max
  Peptide Sequence Number=SeqID_138606
atggctggcagctcggccacggagcgcgcggccgtgttcaaacgcaccagtgcgatgctgacggaaatcattaatgaggaccgcaatcatctgtcgctgatccagcgtcacggctggcagggcacggaagagggcaagcataccggcgatccggctgatgagcctgagacgctggcggtggaccgcgttatcggtatggaaaatgccatgccgtggaacctgcctgccgatcttgcatggtttaaacgtactacgttaaacaagccggtagtgatgggccgcctgacctgggagtcgattggtcgtccattgccgggccggaagaatatcgttatcagtagccagccaggcactgacgatcgcgtcgaatgggtaaaatctgtcgacgaggcgattgctgcgtgtggcaatgccgaagagatcatggtgattggcggtgggcgtgtatatgaacagttcctgccaaaagcgcagaagctgtatctgacccacattgatgccgaagtggaaggggatacccatttcccggactacgatccggacgagtgggaatcagtattcagcgaattccacgacgcggatgctcagaactcccacagctactgcttcgagattctggaacgtcgttaa

SEQ ID NO: 46922 - DNA, 558 bp, Glycine max
  Peptide Sequence Number=SeqID_138607
atggctccacctaaagaaattgtgatcgtcatttaccacaatggtcacattgcagacgacccagttcagggatcggtgtacacatgtgcgaacccaatatttatttacgtcagtcgttctattacgttaacacaattgattcagaaaattaacaatcgtctccctactcgagcaactgcaaaagttgctcaattgttattttgtggccctatttcatttcatcagggtcaaacacgttatatttcatcacaactactcgacaatgacgatctcggaggcgcgatggaaataattctccaaaatccacaattaaattctgccgaattctatgttgttactgaccttattcctcaaccacaaccatcatctccacaaccgtcatgtccacaactacaactacctcctccacaacaattaacatacaacaacctgaacctcaatgatccaatgtcttcatacaacaacctgaaacacaagacacgtttgacatttatacttcatacacacaactattatttgaaaataattctttttttatgcccaacaaagctcctttga

SEQ ID NO: 46923 - DNA, 714 bp, Glycine max
  Peptide Sequence Number=SeqID_138608
atggcgtctggctgtttcgccaggttcagcagggtctgcgcgatacgaccagtgacgtccaggaaggcgaggttacccactttctcggatgtgacctgcagacgacgcgccatctgggaagaaagacgcatcaggatgtcaggccacttcacatgctgtctttgcacgaacccaggcgctacgttcctggccttcttcaaacaggcccagttcaccgataaaatcgccctggttcagataagaaaggatcatctctttcccttcctcatctttgatcagcactgccaccgagcctttgacgatgtaatacaacgtttccgctttttcaccctggtgaatcagcgtgctcttcgatgggtacttatgaatgtggcaatgagacaagaaccattcgagagtcgggtctgtttgcggtttgccaagcaccatgcgctgttatcctctgttataagctgtcaccagagtcatcagatgcatccggactctggggttgcaatcgaattcttacccataccctgggaagtcggctgtcgtaacgtttcgcagccacatcctgagtgttttagcatagctttcgccgcgtgtctcctggtgtctcgcttcagcatgatgcaggtcgccttccgttgcgagaaatgtaacgcacgcgtaatctgtcaccgaaaatgcaacgttggagttaaagaatatgcaagcgcgcgtgaaatgggttga

SEQ ID NO: 46924 - DNA, 799 bp, Glycine max
  Peptide Sequence Number=SeqID_138609
atggagacaggcaggtctgtaaagggtaaacaaaaagcactggttttgccaaacagatcacaaaagcagctcaaattacagaacgtcgatcgcgttcagttctttgaaagcctgctccagacgggtcaccatggacgtctgcgctgcgcgcagccatacgcgtggatcgtagtatttcttgttcggctggtcttcgcctttcgggttgcccagctggccctgcaggataccgtcccaggttgcccactgggtgtcggtatcgatgttcattttcacaacgccgtagcttacggagtctttgatttcctgagcagaagaaccggaaccgccgtggaagacgaagttcaggctgttgtgcggcaggttgaatttcttggacacgtagtcctgagaatcacgcaggatggtcggggtcagctagacgttgcctggcttgtacacgccgtgcacgttaccgaaggaggcagcgatggtgaagcgcgggctgatggcgttcagtttttcgtacgcgtaagccacgtcttccggctgggtgtacagtgcggaagcgtccatatggctgttgtccacgccatcttcttcaccgccggtgcagcccagttcgatttccagcgtcatgccgattttggccatgcgcttcaggtaggcggtgcagatctcgatgttttcttccagagattattcagacagatcgatcatgtgagaagagaacagcggtttgccggtagcggcgaagtgcttctcgccagcgtccagcaggccgtccagccatggcagcagtttcttcgcgcagtggtcg

SEQ ID NO: 46925 - DNA, 334 bp, Glycine max
  Peptide Sequence Number=SeqID_138610
atggtgggtggtctgaattccagaatggctctgacaaaaggggcttttcccactggtggggaaagtatcaaattctggactgatacttggttaggggatcaatacaatctgcagcagaagtatcatcagttattcctcataagcagacagcaaaaggatcatatttcccatatgggccatttcaatcataatacctggacatgggacctgaggtggaggaggaatctctttgatcatgaaagtctcttggctgttcagtttatggaggatatcagctctgttcctattcaaagacaggtgaaagataacatgttgtggctggctgaatctaatg

SEQ ID NO: 46926 - DNA, 432 bp, Glycine max
  Peptide Sequence Number=SeqID_138611
atggataacatatttaagaagcgctggcgaaacaagaaaatcctgacaggtgtcgcgcttctcctgattattatcaccgcttccatttcaatcgccctctctttaatcattgcccaaaaccaggctatctccaaagaaaaaaaacatctgaaagaaattacaaccggtgtgctcatgcgcatgagcgccacgcgcgcgcaatttagcgagatcgtcaatcatttttcgggcgtaaaagaggctgatgcttgcgcacctcatcacgttcagaaaatgcaggaatataacgtggcaggcttctttctgcaggcggttgcccatatccagaacaatcggatcatatgttcctccatctccgaactactcgacgggatgacccttggcactccctaccgggtcgagcctgatggatcatcatctggtggtgtttga

SEQ ID NO: 46927 - DNA, 834 bp, Glycine max
  Peptide Sequence Number=SeqID_138612
gtgagtgtggagcaggttaaagatgcagatgctccagttcctgtacccactgatgaggtttccttagtggggcaggcacttcacaccttccttgcttggccgacacatctggtagctgtgtctccgccaaaaccacctccgaagcccgatctggaggttagatgggatgccaccgtgttcgaggtcgttaatccagatttccccctgtacataaagcacgaagacctctccgaaatcgcacacggtggtcaatgtctcagcttatcagtgttacagttgtggattctgcatctcactgaaacatgtatgcgagcggagaattctgatatctatggattcctcgagccacagtccattcagaggtctgggcaatcacagtttgaatctgaaagttacataaagagttggatgcagagttcacaacgcgatgtgtatcttggagcctacctaaatgggttccactacagtggacattggcagatggtggtcatcgtgcccaaggaacacttagttgtctggttttgttcattgcataacaggccagacaactaccttaaggagattattaatagtgctatcaagggtcttgatgatgctccacagcctaaatcaaaggcttctgctaggtggattgttgtcaagtgtaatagacaaaaaggaactactgagtgcggctactatgtcatgcactggatgtccaccatcattttaggaagtcctagaaataattgggaagcgtattttaacgaccctagaccattggagcctgagagattaaaagcattgcggattcagtggcacagtttaaatctccgagttagagatcagccctag

SEQ ID NO: 46928 - DNA, 249 bp, Glycine max
  Peptide Sequence Number=SeqID_138613
atggccatcaagggtctatttatatgtgacttggaacacgaatttgctcagagtttttcagaacaaaaaagaacttgtaaagggcttttgcaagatagtggaactcttaagcgggttgcttggggactgggcgtaggcacaaggggttgcctatggagtcgaccgccaaatgatgatgaaaggttcatctttgtgggtgatggcaagaagatgcagtggaagctattggaacttttagattacagttaa

SEQ ID NO: 46929 - DNA, 426 bp, Glycine max
  Peptide Sequence Number=SeqID_138614
atgttgaatcaaaggattgagcttactcttccagatgagctaagtgacctgcaagagatctatgcatacaaaatactgacagcaatagcgaaagaaattccctggaagcggtgccaaaaacttgttcgacggccgacaagtgcaccagatcgcgcaagtagtataaaacgatggtcaatgtgttggtcttcctactgggcgactaatgctactaaagatgttctctacctaacaaagttcctatgttctatgttgtctgctggactactaaaccccgatgtctcgtgcatgtttagcctaatcctaatcaagtgtcgtcctcagatccctcatgttggactaaacttgaccagaactgcattaagacatacataccaacaactaggttaccgtaccacgatccctcatgcaaatatgctaaactag

SEQ ID NO: 46930 - DNA, 237 bp, Glycine max
  Peptide Sequence Number=SeqID_138615
atgtggcagttgcaccaaatgcaagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 46931 - DNA, 126 bp, Glycine max
  Peptide Sequence Number=SeqID_138616
atggaggagatacatggagaagaagcggaatggagaaggaggaaaggtgattggagacggtacttcaaggagaagatgagtcaagaacaagctcaccatcataggaagtcatggagaagagcttga

SEQ ID NO: 46932 - DNA, 275 bp, Glycine max
  Peptide Sequence Number=SeqID_138617
gatttacacgcgattctcctcaaatttcagctagcccacatcaattagaccttgcaccttacacttcagagccctacaatgctcaatggaatgccccggggcttctctgtgacaagcacacgttgtgttcgagtcgtattctcgaagtaatggaggttgatgaaccttggctagggttatggctaccattgaattatcaattagatatgggagcaaactttgtggttgatttaggaatggcctttgtggataactgggcggtgggtaaggagaag

SEQ ID NO: 46933 - DNA, 402 bp, Glycine max
  Peptide Sequence Number=SeqID_138618
atggaaaaatctgacaagagaaatttcaaagaaaagaaagcatacatcacttgggaagataatgacatggattcttcaagtgatttagaaaatgaaatcataaatctgggtctcatggccaaagactatgaaagcaaagaagaggtaatgtcttctaactatgactcatctatttcttttgataaacttcaagatgcattcaatgatttgcataaagaatctgttaaacttgccaaattagtttcatattctaagaaaactatttccagtttagaaaaggaaatttcgaatttgaaatttgaagatttaaaaattgttattgccaaatttactcttgttactagttctactttgttaacatgcttttactgtggtaagaaagatcatagtgcatcaacatga

SEQ ID NO: 46934 - DNA, 111 bp, Glycine max
  Peptide Sequence Number=SeqID_138619
atgtgggtgagtatcagagcacccccagaaaaagctcttttcaccactgagcctctacagccccattcatcttcgaccgataaggggtggagttatgatgctggatcttga

SEQ ID NO: 46935 - DNA, 264 bp, Glycine max
  Peptide Sequence Number=SeqID_138620
atgtgggtgcaagccattggtctgtttgctcaagcgacctgtgctcctgagtttggacttccaagaccgttcaatcagagattactcgtcttgcacgttggtgggggtgctgtaaaacaacgagaatcctttacaacaagagacccacggtctgttaatcccttttcagaaataagaagaagagaagaagaaatctctcttaaaagagatagattgtacaatgaagatcaatcaaaattccttattgaatatgcaagtggttga

SEQ ID NO: 46936 - DNA, 584 bp, Glycine max
  Peptide Sequence Number=SeqID_138621
accgtgaagagcatacgtacaccaacgtacagggagcgcctggaccgactccggattccaaatgtctgttggatcccatatggggagcaccgaccgagagggtcatgcagcagtttggatacacccagaccattcctgctccacctgccaattcatgggtgtcgtttgatgatatacacgataggtggatgcactattcagaccatatggctgcaacaggtgacaattgcgttgtgccagggcaatgtgccagtgactacatggactggttcttctgcattttgcattcgttcatgacaccgggccagccttcagatcctcgggcagatggtcatgctacgcagcctagagttgccactcaggatctagacacagatatccgtccggtcatggagccagcaacaccgtcgacatctgcaaggtccgatgtggccgagccgagacatgcagtggaagcttgccatgcgattgcggagaggttggagagccatctcaacctaggggtggtcacgccaggcacatcgacacatgagctgatcgaagaatgccttaggattgccaggagtgtcacacaagacgagcta

SEQ ID NO: 46937 - DNA, 219 bp, Glycine max
  Peptide Sequence Number=SeqID_138622
atgacgaggtgcggataccgtaaggtgtctccgcatgctaccggactctcgggtcgctggatagcaaagggtgtgtgtgggttaccatcgggtgtctctgcatgccaccggactcttgggtcacaggtaacaaaaggtggggtggtcaacaaaagcaaggcttttgctcctacgtatcctcaatttatgatgaggaactcagacctacgtagttcttga

SEQ ID NO: 46938 - DNA, 279 bp, Glycine max
  Peptide Sequence Number=SeqID_138623
atgtttgcacattcgattaaaggctgccgtcccttgggacgggcgtgtggggtgctaataccttccccatcacgtcttttccggtttttccgacgttttcctcaaataaacgttggtggcgactccgcgcgtattcctttcgtggaacacgcatcccgcgagtctcgcgtcgccctcccgccgaagggtaggttacgacagctattgtgcaagcaatcaatggggcaaaacacaccaaatgattataatgatggatggctcaaattctcacaaaggtaa

SEQ ID NO: 46939 - DNA, 240 bp, Glycine max
  Peptide Sequence Number=SeqID_138624
atgtcaggatttacacgcaattctcctcaaatttcagtcagcccgcatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcatgctttctcgctgcaaaattcacttcttggttga

SEQ ID NO: 46940 - DNA, 138 bp, Glycine max
  Peptide Sequence Number=SeqID_138625
atggaaaagaggacttgggaatgtttgaagcaaagtcagatgaagatactttggaagatacacatattcatgaagaagtccacaaaaacaaagaagaaggaaatagcaaagattctcaatccaaagaaaatcaaataa

SEQ ID NO: 46941 - DNA, 237 bp, Glycine max
  Peptide Sequence Number=SeqID_138626
atgactgcatgctcattcaaggcatatgatctacgcatttcaattcactcgcatcatacaattgatcaattcaaaccaatcacaaacattgaattccaaaatcaaggaaataaaaatcttgatcctgtcaatgatcctgtgcatgctcattcaggtccagtgctggtgcaaatgatggatcctgagaaagaggcaggtctgacactggtgcagatggctcaggctgaggagatatag

SEQ ID NO: 46942 - DNA, 705 bp, Glycine max
  Peptide Sequence Number=SeqID_138627
atggctgaaagttcgcatacgaggtttagattggctcgccaagacgaggaagtccaagctctcaaaagcgagttaggaaaggcaaaactcgccaaggagaagttcaagttggctgctacacacgttcggaaggagtgcgccgggttacgggaagagaatgcaattaccgcaagggcccttgaacgagagaccaagagggctcgcaaggaagagtatggccggaacaaatttcgcggagctctatggggtagcaatagtgaactcaagttgcgaagggaagaaaggaaccagtcgcgagcacatagcatggttctgaaagaggagttgattgcttgttcaaggtccaaaagaagcttatctcagcgtttatgcgagacagagaccaacatgttagctatcatcgccaagtacgaagaagagttgggtctagccacggcccacgagcatagaaccgcggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaagcgatggcagacacctactccacccccgaagagattcatgggcttctcggctattgtcagcatatgatagacttaatggcccacataattagaaatcgttag

SEQ ID NO: 46943 - DNA, 210 bp, Glycine max
  Peptide Sequence Number=SeqID_138628
atggtagccataaccccagccaaggttcatcaacctccatttctccgagagtacgactcgaatgcaacgtgtgcttgtcatggagaagccccagggcattccattgagcattgtagggccctgaagtgtaaggtgcaaggtctaactgatgcgggccggctgaaatttgaggagaatcgcatgattatcaagtttctaccattattgtaa

SEQ ID NO: 46944 - DNA, 108 bp, Glycine max
  Peptide Sequence Number=SeqID_138629
atggaagagggatatgctgcttctagtgaagttgggcaggttcatttgcagatgaggaagatgctactggttgaggtccttgacactgctttcccaacctcaatgtaa

SEQ ID NO: 46945 - DNA, 213 bp, Glycine max
  Peptide Sequence Number=SeqID_138630
gggttcccacggaccctaagagaataaaggtcattcttgatttgcccactccaccaacacctcacattgagttggtgaggaaccatgttccctcatgggaagatgtccatgaaaggagtgttgagggaaggagcccagagtatgaagaacctcaggatttgaggtcaaatcctttccaaggtggagggcatgatgcaatcctaccccccaagg

SEQ ID NO: 46946 - DNA, 301 bp, Glycine max
  Peptide Sequence Number=SeqID_138631
atgcctcctaaggtgtctagctcctccggcagaggaggaagatccagtaccaaaggaaaagatgttatgttggctctaccagagccaataaccaagaaggcaactacatcatcttctgggtcacctactcagactgggtcatcaacccagaaaggaaagcttgaaaggtcattgacccagataaaacctgagtcatcaactcaggaatccccaaaaccaacaacaacaaaacagactgtggctgactatgcctgggtcaatacaaactctcctggcttagaagacatagggcctcaccaga

SEQ ID NO: 46947 - DNA, 507 bp, Glycine max
  Peptide Sequence Number=SeqID_138632
atggaaggattagtggacctagcagtgattgacgcttccctcgcctttcatcatggcaaggaaagcccggtcgtcgccattttggccatgtatgacacgttcgaccgaggatgtgaaaagagtggcacaagaattgtttgttgtgcactggctctctatgtgtggctggtttcacacctttttctccaagaaggtaggcccgtctatccgctacaaggtcaccgctcgtgcgtcgaaaaaggaaaggcgaattgggaccaactcttggctagcatggaggggggttgtattaattataatcccgtcctcgccataagacagcttggctaccccatgagaggagtgccatcagacgaaagcatcacgcctttcatcgcacggggtttcagtgaccacaacgcgagggtactccaaggagttcgcaaggcatggatgcggcatgaagaaaggacagagagcttaggggaagcagtaatgggatcatcggcggctatcataagtggttga

SEQ ID NO: 46948 - DNA, 495 bp, Glycine max
  Peptide Sequence Number=SeqID_138633
atgaccggccctctcgatgagtcgatctcttgctttctcataagggtggacccttgggtacttctacctatcgccttcagagggctgcacgccctcacctccagaggactacacgtcctcgccttgagagggctacccgccctcgccttggagaggactacacgtcctcaccttgagaggactacacgtcctcaccttcagaggactgctgtcctcaccttcgtagaggactacacgccctcaccttcagagggctacacgccctcgccatcagaggactgcactgtcctcaccttcgtagggctacacgccctcaccttcagaggacttcacgcccttgccatcagaggattgcacgtcctcgccatcataggactacactccctcgccttcaaaagggacacgttctggacttcagagggctacacgccctcgcctttagaggagctatgcgtcctcagtttcagtgggctccatatccacaccttaagataa

SEQ ID NO: 46949 - DNA, 243 bp, Glycine max
  Peptide Sequence Number=SeqID_138634
atgttaggattcacaagcgattctcctcaaatttcagctagcccgcatcaattagaccttgcaccttatgcttcagggccctacaatgctcaatggaatgccccggggcttctccatgataagcacatgttgtgttcgagtcgtatcctcgaagaaatggaggttgaggaaccttggttgggattatggctaccattgaattatcgagtagatatgggagcaagtcagcataggacaccataa

SEQ ID NO: 46950 - DNA, 426 bp, Glycine max
  Peptide Sequence Number=SeqID_138635
atgagcattgttagtcccaagacgtgccgggaatcaaaaggaagcaggcttacgcgatccgtgaaattccgtaatgtgacggaaatcgaaaggaggtgtttttgcgcaatccgcccacttgggccttccagtttcttcctccagaaggtggttgcttctggaggaagcaaccttgctcgcctgggcgagctgggtggcaagctcctcccctattttgctataaataggggaaggagtgaagaacaaaagggttcagccttcttggcacttcttattctctcaaaattgctgaggaaaattgtttctgtgaagaaatccaagccgaggcacttccgtaacgtttccgtgagtaattacgcgaaggttttcaaccgttcttcgacattcatcgttcgttcttcattttcttcagtcttcaactggtaa

SEQ ID NO: 46951 - DNA, 366 bp, Glycine max
  Peptide Sequence Number=SeqID_138636
atgtcgcgggggtcaggagaccttggggatgtcaggtggggtgctattgcccaaaaccaagcttggctaatcccgacccaacccgagcatagtcagcaggcactggtaatcgattaccagttgtgtgtaattgattacatagtgttacctgctactggaaatcatgtgcaaaataaagtcatggtacagctatgctttggaattagggtgaaagaagccggtggaccattcggtcctgccaacgaatcttatccggagccccatgaattgattgtcattcatgcatcctccaccatcgagtctggagccccacaaattgattgcctagtgctgttcgtctatcctccaccctcaaatgttatctga

SEQ ID NO: 46952 - DNA, 231 bp, Glycine max
  Peptide Sequence Number=SeqID_138637
atgaaaggcaccatgcatgagcctcaagcgaacctaggggcagatcaaaatttctcaccgatcagcctgccatcaagtttcaggggggtccacagacccatggcatcactctataaccttaaatcaagaaagttccacttaagtgtgacaatctattaccatccttcaaacgatgcatgcgatcggtctgagccatctagctcgatccctaggggtgccacaagcgcttaa

SEQ ID NO: 46953 - DNA, 126 bp, Glycine max
  Peptide Sequence Number=SeqID_138638
atgactctaagacaacatggattaacggaatggagaagaagaagagttgagaggagatgccacttcaaggagaagatgagtcaagaagaagttcaccaccataggaagccatggataagagcttag

SEQ ID NO: 46954 - DNA, 362 bp, Glycine max
  Peptide Sequence Number=SeqID_138639
ctctgaagatccgaaaggagaatgccgaactaagagatataaatatagctaccaccaaggccttggaacaagagaccaagagggctcgtagggaagagcacggccggaacaagttccgagtggctctgtccaaaagaaacatgtctcagcggttatgcgagacagagaccaacatgttagccatcatcagcaagtaccaagaagaacaaaatcttgccacggcccacgagcatagagtggcggacgagtatgcccaagtgtacacggaaaaggaggctagaggaagggtgatcgactcgttgcagacacctactctgcccttgaggagatccacggacttctcggctattgtcagcatatga

SEQ ID NO: 46955 - DNA, 387 bp, Glycine max
  Peptide Sequence Number=SeqID_138640
atgggattcatccgcctcaccgggggatcctgtaggctcctcccctgcctgggcatcgggccagtctccaggccatgcaacctcagccccaaactgctccggggtagggcatacaaaacgggtggaaccctgcccctgctgactgaggctgaaccggtagagacactcatcgaaccaaatgctgcagataacgctccacgcccagtgacccagctggatcgccctgcagaggtggtggcgtacttctcgatgaaggctcgggtgatcggcggtcggattactttactgggggtgatgggaactccgtacgactggcagaggcccgtgatcagcgccggaaacccagggcccggttggacttatctgggtctagagggtgcctggtag

SEQ ID NO: 46956 - DNA, 246 bp, Glycine max
  Peptide Sequence Number=SeqID_138641
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcactactgacggggtggtgcgtaacggcaaaagcaccgccggacatcagcgctggcaagtgtagcggtcacgctgcgcgtaaccaccacacccgccgcgcttaa

SEQ ID NO: 46957 - DNA, 204 bp, Glycine max
  Peptide Sequence Number=SeqID_138642
atgacgcctcctctcacctcttctcctttgtctttcgctgcatctccatggtggaaaatcaccattaaagacctcattgaagctcaaagatccagcctccatagaagcctcacaagcaagcttccatcatctagattgtctttctgtctatacataagcatttctccagtggtcaatacctggatcactctgatatcttcctaa

SEQ ID NO: 46958 - DNA, 432 bp, Glycine max
  Peptide Sequence Number=SeqID_138643
atggcttacactcacattccggattcaacaagcgattctcctcaaatttcagccagcccgtatcaattagaccttgcaccttacgcttcagagccctacaatgctcaatggaacgccccggggcttctccgtgacaagcacacgttgcgttcgagtcgtattctcagagaaatggaggttgatgaaccttggctagggttatggctaccattgaattatcaagtagatatgggatcaagtttagcatatgacaacggaatttggggtgaaccctacaagctttttgctgcaaaattcctttttgttgggatggcctttgtggataactgggtggtgggtaaggaggaggaatggcagtcacagcatgggtttctccctcttttctcaccctcttcatttgccccagttttctcagtcgtcctagtaggatga

SEQ ID NO: 46959 - DNA, 762 bp, Glycine max
  Peptide Sequence Number=SeqID_138644
atgacggacgcgtggggtgctaataccttccccgtgcataaatacaactctcgaacctttcacttaaagttcgtagatcacgtcttttctgttggtggcgacttcgcttgtattcctttcttggaacacgctcccacgagtcacgcgtcgccctcccatcgaagggtagggtgcgacatcgctatattagccgacctatatgacaccttcggccgaagatgtgagaagagcagtacgaggattgtttgttgtactccagctctttatctatggttggtttcacacctttttcaccaagaggtgaggcatgcttgcccgctagaaggtcaccattcatgcatagagaaaggaggcgcaaattgggaccaactcttagcaaacaaagaaggagcgtctatcaactggttccctcgatggaaagaaggaagaaccggagttcttattttgtgtggaggatttccgaatgttcccttgatggggatgaggggttgcatcagttacaatcccgttcttgctataagacaacttggctatcctatgagaggggcaccactagaggaagagatcgcgcccgtcatttcacgaggtttcaataagaccaatgtggagatgcttcagaaggtccgcaaggcatgggaggtggtgcgaaagaaggacaaagaactcaggggcagtaacaatgggcccatcggtggctaccgtaagtggttgagagcccacgtgcaaggtttcgattggctcttgagtttgagaaccgcataa

SEQ ID NO: 46960 - DNA, 812 bp, Glycine max
  Peptide Sequence Number=SeqID_138645
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtgattctgtggtatgactgtagtctctactgtctagtgcctgaaaaatgcatcctaaccagtagcccacttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46961 - DNA, 291 bp, Glycine max
  Peptide Sequence Number=SeqID_138646
atgggaggtggatcatatcatgccaaaatgagtttgttggttacctcgttcacaggaaaaaatctcaaaaagtttgacattcccactggatgtaacatggatgaattgaaggatttgatcaagcaagttgcgcctactgggatttccccttatggtattcatgaaacacaaatggtgttgattgagtctaactactggaaaaagattgggccaatagaaattttagctgttttcagtaaaccctgtaccggaaatggaaaacgagttgtccttgtcgcaaaattagcgtga

SEQ ID NO: 46962 - DNA, 1038 bp, Glycine max
  Peptide Sequence Number=SeqID_138647
atgactaaaggcgctcaccttaagagggcgacacgccatcaccttcagaggactacacgtcctcaccttgggtactcatacccttaccttcagaggactacacgccctcgccttcatagggctactcgccctcgccttcagaggacaacacgtcctcacattggaggactacacgtcctcgccttcagagggttgcacgccctcgccttcatggggctgcactaccttgccttcgtagggatacacgccctcacctttagaggaccacacgtcctccccttcatagggctacatgccctcactttcagaggactatgcgtcctcacccttagagggctttaccccctcaccttcagaggactggatcccctctccttcgtaaggctacaagccctcacctttagaggagtacacatcttcggcttcatatggctgaacgccctctgcttcctagggttgcacgccctcgccttcagaagactacacgtcctcggcttcggaggactacatgtgctcaccttcagaggactagatgtcttcggcttcagagaactacacgttcttaccattagaggactacacgacctcatcttcagaggactacacgtcctcgtcttaagagggctacacgccctcgccttcgtagggctgcacgccctcacctttagaggactacacgtcctcgaattcatagggttgcacgccctctccttcagaggactacgcgtcctccagtttagaggactacatcttctcaccttcagaggactacaggtcgtcggcttcagaggactgcatatccccaccttcaggggactacacgtcctccccttcagaggaatacacgtcctcaccttcagaggattggaggtcctcaccttcagagggccacacgccctcgccttcagaggactacatgtcctcgcccataaagggccacaagccctcacctttgtagggaaacacaccctcacctttagaggacttcatgtcctcgccttcatacggctgcacgccctcgccttcagaggactacac

SEQ ID NO: 46963 - DNA, 474 bp, Glycine max
  Peptide Sequence Number=SeqID_138648
atgtttcacttttggggactttcagttagcaccaaccatagaggagttcgaagggatcttaggatgcccgctagggggaaggaagccataccttttttcctgattctatccttctatggaaagaatagcgaaagtggtcaagatctcggaacaaggataccaaggaaacgcttagaggagaaggcggaagctctagccaaccaaggagagtgggcaacattcatcgatctattagctctactagtgtttcggacagtactattcccaaatgtagacgggttagtagatctagcggtaatcgacgcctttcttgcttatcaccacagcaaggaaagcccgatcatcgctgttttggcagatgcatatgatacattctacttgagatgcgagaaagagcagtgcaagaatttgtctgttgtatgcctgttcgttatgtatggttggtatcccacgtttttttatcatgaagggtag

SEQ ID NO: 46964 - DNA, 568 bp, Glycine max
  Peptide Sequence Number=SeqID_138649
atgccttatgtggaatccgcagaagaatcgttagaaaccgctttccaatcttttgaggtggtcagcatttcctccatggactccctctctgggcagccttgtcagtccgatgcagcagtaatgatggcccgagttatgttggagaacggttatgaacccggaatgggtttaggcaaagacaacggcggcataactagcctgataaatgcccaaggaaatcgtgggaagtatggtttaggctataagccttctcaggcggacatgaaaagaagcatttgtgggaaggaagagcagtggtcaaagctcgcggttgaggcaagaaaatctgatgacgagtcccccgaaggtactaatatctgggacccacctatcgacttcgagcaagaagtgaatcaaacggaagatgaaggaaacgaggatgtgggacttcccccagaattagaaaggatggtcgcccatgaggaccaagaaatggggcctcatcaagaagaaacagaactagtagacttgggaattggcactggaaaaagggaagtaaagataggcacaggcattaccgcacctatcc

SEQ ID NO: 46965 - DNA, 924 bp, Glycine max
  Peptide Sequence Number=SeqID_138650
actcgccaaggagaagttcaaatcagctgctacacacatccggaaggagtgcaccgagttacaagaggaaaacgcggccattgcaaaagcccttgaacaagaaaccaaaagggcccgcaaggaggaatatggccgagagaaattccaaggagcattgtccagaaggagtttggctcaacacttggaagccacggaacaaagcatgctagctatcatagggaaatacaaggaagaattgaaccagtccatggcccatgaacaaaagctagtggaggattttgcacaagtgtatgccgaaaaagaagcaagagggagggtgattgatgcgttgcatcaagaagcgactatgtggatggataggttcgccttgaccttgaatggaagtcaagacctcccgcgtctgttagccaaagcaaaagccatggccgaagaacagatgaaggccgatctatcggccttaaaagatcaaatggcttccatctcggaggtcatgttaaaactccagaaaaccatagaggataaagccaccgcaaccgcctccagtacagttagggaagcggagccggtgctgcaacccgccttgaatccgggcctagggagaaacacggccgtgttcggtcgaacgtatagtccgcaagcttatccttatggcctgcctccagacttcaacccctgtgccaccccggaagatttaagccaagcccttacttttgaggggcaactcccaccttatgaagactatcccgggcaagacgatggggaaggagatacccatcttggccccctgctccacctcaaagatccatccccgcatgaactaccccagccaaacatagtccgccatatcccggcctcacccacacccgtaaaagaatctgttcccttcgcggaagataagggaaagattgaggtgcttgaagagag

SEQ ID NO: 46966 - DNA, 459 bp, Glycine max
  Peptide Sequence Number=SeqID_138651
ggtactccaaggagttcgcaaggcatgggatgcggcgtgaagaaaggatagagagcttaggggaagcaactgtgagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacgagctaaagggaatacgtgggccatcatcgataagtgcaaagagaagctaaatctagcggcgactcacgagcaaaggctagaggatgagtacgccaagatatcagcagaaagggaagcaaggaaaggtcaagaacttccccgattgttagccaaggccaaagcgatggcagacacctactccgcccccgaagagattcacgggcttctcggctatt

SEQ ID NO: 46967 - DNA, 342 bp, Glycine max
  Peptide Sequence Number=SeqID_138652
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggctcccccgggctgcagggaattcgatggtctgcttggtccagagctgggttcaagttctgaatatccttgttaa

SEQ ID NO: 46968 - DNA, 525 bp, Glycine max
  Peptide Sequence Number=SeqID_138653
atggtgaaagttggaacctcttacgtgccgatcaacgtctcattttcgccaaaagttggcccagggcttcccgctgtccttcctgttcagctactgacggggtggtccgcgtcacaattcggcacacaagcataccgaccggaacatcagcgtggcaaggcgcgctttcccattcggaaccatgtcaggtgcgcaactgcttatgaatcggccaacgcgcgggcgatcgagtgcgggcctttcgctattacgccagctggcgctagcggatgtgtgcatactggcgattactatgttggcactgataacgccagggtgttcccagtcagaacgtgctgtggcaaaaaaaagctgcaccggtgctcagtcagaatatgtgaatacagactcactataggtccgcgaattgtcactgagctcctaccgctcggtcgtcatgcggcagcgctcagaacatggcccttacaacgggcgcggaattcggaaattctcaaccgctcatggacagaactaacagggaagtga

SEQ ID NO: 46969 - DNA, 159 bp, Glycine max
  Peptide Sequence Number=SeqID_138654
atgcatattgttgtggtcaaacaggggcaggattatcttgagctaccttctggggtggggacaaaacatgaacagcagaaaccaaccaaggtacttaggaacggatgcaactggggatggggtcacgaccgactgatcgtcgccccttctctgcgctaa

SEQ ID NO: 46970 - DNA, 180 bp, Glycine max
  Peptide Sequence Number=SeqID_138655
atgggtgttgagggtagaagcccaaagtttcaagaacctctggatttgaggtcaaatgcttttcaagggggagggaatgatgcaatcctaccccctcaagggcattggatagaagactccaagaagattgggccagagatgcaagagaaggccctagggttctcacgagtcttagggtag

SEQ ID NO: 46971 - DNA, 549 bp, Glycine max
  Peptide Sequence Number=SeqID_138656
atgcagctaccgcaagagcccttgaacaagaaaccaagagggctcgcaaggaataacatggccgagaaaaatttcgtggagctttgtgggggcagcaacagtgagctcaagcttccaagggaagagagagaccaatcacgagcacatagcatggtcttggaagaggagttagctgcttgctcaaggtccaaaagaaacttgtctcagcatttatgcgagacaaggaccaacatgttagccatcgttagcaagtaccaagaagaactaaatctagccacgacccacgagcataaagtggcggacgagtatgcccaagtgtacgcggaaaaggagggtagaggaagggtgatcgactcgttacatcaagagacaacaatgtggatggaccaatttgctcttaccttgaacgggagtcaagaacttccccgattgctatccaaggccaaagcaatggcgaacacctactccgcccctgaggagatccacggacttctcagctattgtcagcatatgatagacttaatgacccatataattagaaaccgctag

SEQ ID NO: 46972 - DNA, 181 bp, Glycine max
  Peptide Sequence Number=SeqID_138657
atggcttctccacctgcctcacctcctcctcctcctcctcctcctccttccgacacatcgcctttttcgtctgcggtgaagcggacacgcaaagcctcatgtctacaatcattgtctactagaccacctggtgctgagagaccaatggtccatgttgatcttggtaccgacaaggccgacg

SEQ ID NO: 46973 - DNA, 415 bp, Glycine max
  Peptide Sequence Number=SeqID_138658
ggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatggtcttacggcttctatagttgaagattaa

SEQ ID NO: 46974 - DNA, 268 bp, Glycine max
  Peptide Sequence Number=SeqID_138659
atgatttctgatgctgacaatgaaagacacttgcttggatggaggcagggtgtgcacatgtgtgtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaggctgcaccg

SEQ ID NO: 46975 - DNA, 228 bp, Glycine max
  Peptide Sequence Number=SeqID_138660
atgtcagtgaaaaaccaccctggggcacttaggaatcatagggagaccagtcagggtcacgatgggtttgcgagaattctccaaccatatgggatcagcatagacttaaaggaacactcaaacccggtgacccccaaggcctacactccgaagagtccgtcagggcttctccctcctgattcaagtacaacccctaaaatcattttagcacacagacactgctcgtga

SEQ ID NO: 46976 - DNA, 357 bp, Glycine max
  Peptide Sequence Number=SeqID_138661
atggtgacttggtcggaatatagatctcgtatagatcatatggagatccatgagttttcttcggtcccatatagaggatttgaagaacacctaccaagacatgcatacaaagacagggagatttggactgcatgtactgcaattatttgttttccgattgtggaacgacatcaaacaaactgggtcaagctatggtttggactacaacaagatatccctgttgatcacttgaatcttgatcgacttcaccaaattgacatgctcgaggcaatcattacagtaactggatggttatcatgcggagtggattatatctggaaagacaacgcaatgatgtttttactggacaatgattga

SEQ ID NO: 46977 - DNA, 426 bp, Glycine max
  Peptide Sequence Number=SeqID_138662
atgactacgccaagctcaaaattaaacctcactaaagggaacaaaagcagagagggacaagaaaagccagctatgtcagtggctgcgaattttcttaagaacaaacttgagggggatccactagttcgagagcggccgccaccgaggtggagctcccattctcccgagagtgagtcctattacatgtcactggctttcgttttacaacgtcgtgactgggaagaccctggcgttacccaacttaatcgccctgcaccacatccccctttctggcgctggagtaaaaacgaacacgcccacaccgattccccttcccaacacttgcgcaacgggaaaggggaagggcacgcgccctgcaccgtcgcagtaagcggggcgggggtggtggttaccctgaccgtgaccgctacacttgctaacgctgag

SEQ ID NO: 46978 - DNA, 252 bp, Glycine max
  Peptide Sequence Number=SeqID_138663
atgaccaagagcaaaggcaaggatccacttgaaggacttggaggacctatgacaagggctagagcaaggaaagcaaaggaagatcttcaacaagtgttgtccatattatttgaatacaagcccaaacttcaaggagaaaagtccaaggttgcatcaacctttgggagaccaaatggtgattggctcgatggattttggggtgacttttggttgccacaatttctgttacactcagccattaagttcttttaa

SEQ ID NO: 46979 - DNA, 198 bp, Glycine max
  Peptide Sequence Number=SeqID_138664
atgattggtacctcaaagccttacactggggcaatgaggggtactatgcatgagcctcaagttcctagctacaaggtcatgatgaaagataacaattggtacctcaaagccttacactggggcaatgagggcatcgtgcatgagcctcaagtgaacataggggaagatcaaaagttctcacccgtcaatgttttttaa

SEQ ID NO: 46980 - DNA, 150 bp, Glycine max
  Peptide Sequence Number=SeqID_138665
atgacaatcaattcatggggctccggactcgatggtggaggatgcatgaatgaaaatctattcatggggctccgaataagattcgttggtggaggatgcacgaacaacgctaggcaatcaattcgtgggggctcaggactcgatggtgga

SEQ ID NO: 46981 - DNA, 1023 bp, Glycine max
  Peptide Sequence Number=SeqID_138666
atgtttgcacattcgattaaaggctgccgtcccttgggacggacgtgtggggtgctaataccttccccgttcgtaaatacaactcccgaacctttcaacttaaaagttcgtagatcgcgtcttttccggtttttccgacgttttcctcgaataaacgttggtggcgactccgcgcgtattcctttcgtggaacacgcatcccgcgagtcacgcgtcgccctcccgccgaagggtaggttgcgacatccggctctttatgtatggttggtttcgcaccttattcgccaagaggtgaggcatgcttgccaactagaaagccaccgttcatgcacagagaaaggaggggcaaattgggaccaactcttagcaaacaaagaagaagcgtctgtcaattggttccctcgatggaaagaaggaagaatagggattcttatttcgtgtcgaggatttccaaatgttcccttgatggggacaaggggttgcatcagttacaatctcgttcttgctataaggcaacttggctaccctatgagaggggcaccactagagaaagaacttgcgcctaaggttcacaaggcatgggaggtggtgcaaaagaaggacaaagaactcaagggcagtaacaatgggcccatcggtggctaccgtaagtggttgaaagcccacctgcaaggtttggattggctcccgagtttgagaatcgctataagggaggaagttgaggcactagaggaagacgaagaggtacagacccttaggacaaaactcgagcaaacccaaatagtcaaagaaaggttcaaatcagcaactcttaaaatccgaaaggagaatgccgaactgagagatataaatatagctaccaccaaggccttggaacaagagaccaagtgggctcgtagggaagagcacgaccggaacaagttccgaggggctctgtggggcagcaacagcgagcttaagctccggggagaggaaagagaccaatcacgagtagacaatttgatcttgaaagatgagttgaag

SEQ ID NO: 46982 - DNA, 306 bp, Glycine max
  Peptide Sequence Number=SeqID_138667
atggtatcaaggtacactttaaatgaaattgctgctgagtatgagcgtgtaccttatggaggcaaaaacccttcacgttgtggatgtgtcatgaggagtacccatagtcttccctgtgcattgaaacatagtgcatcatcatctgaggaaccaatacagagatggaatattccaatgctggatcaatttcatccgtgcatccaggattctattgaaaacattattggtgtcaaagcgaatggtaactgtggttatcgggcaatagctgccttattggtgtgggtgaagaatcatggtcattggtga

SEQ ID NO: 46983 - DNA, 375 bp, Glycine max
  Peptide Sequence Number=SeqID_138668
atggaagccatatccaaacggtttgaaaagcttgatgtcaaaacaaaaggttctcaaaagaaacagatgaccaaacaacaaagaccagcgaagcgtgattcgtcttaccgggagaatgtggatgcattacattctatgcaaaatagcaattatttagtgaaacattgtgcatcatcatctaaacaaccaaaacctaagagaaagatgccaatgctggatcaatttcatccatgcattcatgatttcattgaaaatattgtcgatgtaaaagttgatgctccatgtggagctggtaggccttggatcttcttcatcaatgaagtcctttgcttcttgaagatcaatgatagcagaatggagaaggaagaaagatga

SEQ ID NO: 46984 - DNA, 705 bp, Glycine max
  Peptide Sequence Number=SeqID_138669
atgaagcacttcactgacaccctcatcagtgccaacatactggtaccgggccccccctcgaggtcgacggtatcgataagcttgatagaaggagttgttatagggttcgttgacaccggcatagatccaacacatcctagttttgatgataacaaatatgaaaagccgtatcccgttcctgctcatttttctggcatctgtgaggttactcgcgactttccatctggttcttgcaataggaagcttgttggggcccgtcattttgcagcttctgccataaccagaggaatatttaattcgactcaggactatgcttctccctttgatggtgatggccatggaaccccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 46985 - DNA, 591 bp, Glycine max
  Peptide Sequence Number=SeqID_138670
atggaaccgattgcatccctttcccagtattatgaccagcccctaaggtgcttcacatttgaggacttccagctagtgccgactgtgaaagagtttgaagaaatcctgggatgcccactgggaggaaggaagctatatcttttctctgggttctatacctccacgacaagagttgccaagggagtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaaggattgtttgctgtactccagctctttatgtatggaaggaagaatcaggattctatcttcatgcgaaggatgtccaaatgtcccttgatggaacaaggggttgtattaattataatcccgtcctcgccataagacagcttggctaccccatgagaggagtgccatcagacgaaagcatcacgcctttcatcgcacggggtttcagtgaccacaacgcgagagtactccaaggagttcgcaaggcatgggatgcggcgtga

SEQ ID NO: 46986 - DNA, 477 bp, Glycine max
  Peptide Sequence Number=SeqID_138671
atgggaacaaatcaaactggaaaaacgtttcatcaattcaagattaagggcctagatatcaccagcattaaggagttggggcggttgatgggacctctccaaattcaagccttccgcaaggcgtacggaaaaattttagatttgaccatagcagagatatccacggaagccgttgtatcactcacccaatactatggccagcctttgagatgcttcacatttggagacttccaattagtaccggctattgaagaatttgaggagattctaggatgtcctcttgggggaaggaaaccgtatcttttctccgggtttcttccctccttgagcaagattgcagttgtggtcagggattcggcaaaagaattggatcgtgtaaagcaaactcgaaacggcgtagtgggcctaccacggaagtacttggaaggcaaggcaagggttatggcaaatcaagaggagtgggtcccgtttatggac

SEQ ID NO: 46987 - DNA, 582 bp, Glycine max
  Peptide Sequence Number=SeqID_138672
atgggtgaagcagaggaggtgcaagagaagatgaaggccgacatggaggccatgaaagagcaaatggccacaatgatgaaggccatgatgagcatgaagaagataatggaagccaatgcggttgcagttgccactaccaacgctgttgctaaggcaaagatttggaaagtacgggcggcccccattatgtgcaaattcaaaacaagcacgccttcccaccatatggcttgcctcccaactatacgccacccaatgtggcgtacactcccaatgagaatgtcaataactccactcctatactcattgagagccaacaacctcaatctgatcatgcatatgtctctcgacccatggggggggacacatgaaatgccccaccacaatctagccgacttcgagccttgcctcggatatgccaccgaagggcaagtagttggtggtatacccctgcaaaacactttggagggccctcaatttcgcccccaaccacaaccctcacattccacaacggttaaaaaccctcatgctatggcagaaatgggagaagttggatcatctagaggaaaggctcaaggccattga

SEQ ID NO: 46988 - DNA, 349 bp, Glycine max
  Peptide Sequence Number=SeqID_138673
agtggtacctggagatatgtcgcgggggtcaggagaccttggggacgtcaggcgagctcctggcagtcaacagataaaaggaacaaagaccacaaagcaaggaggcttgtgtggtggctggccagctgtgaatcttgaggctaagatggtctctggggatgtaatcgattaccaggcttcaaaagggaactggaagactgtggaggcctctggtaatcaattaccagtatttgtaatcgattacacagaggaatgggtcactggtaatcgattaccaaagatgaaaagcctaaagataccccttttacttgcatgtagtggttatgagacgcattgtgttgcggcgtag

SEQ ID NO: 46989 - DNA, 231 bp, Glycine max
  Peptide Sequence Number=SeqID_138674
atggcagcggaatggagaaggaagagagagagaagatgccacttcaaggagaagatgagtctagaagaagctcactaccataggaggccaaggataagagcttggaggaaaaaggagatgaatgaagggagaggaagagaggagcacgaaattttgtgctctaaaagagctctgaaatctgaacccactaatccgagatcaattccaagattctccactaagtgtgcttag

SEQ ID NO: 46990 - DNA, 414 bp, Glycine max
  Peptide Sequence Number=SeqID_138675
atgctgcgtgccgctttaaacactgccatacatgtagtcctaaatgtcatgtacgcctttgcttgtaattatttgtggatactgtcgtactttatgcatccccgtgttatgcttttgcgcgtctacatcatgtcgtcacgcacgcgttgtatgttggtctcatcttttgtcatgggaagccggaaggtccatattaccttcttaactacacacatggggaactgcgtccccgaatgtgcaatattggcgatcaaaattgccattccctgggttatggggttgaaccaagctcgtgcttttacgaaaaggttcatcaagtcaagtttaagtatggaagtaaccatcttgcaaaaaattggggcaagagatggatcaagttacgtcattgcttcgtctactgccaaacacgtttag

SEQ ID NO: 46991 - DNA, 485 bp, Glycine max
  Peptide Sequence Number=SeqID_138676
atgtcctttgccggttttcttttatatatagagagtgagagtttggttttatatccgttagcggtgaatttgtcggtgtcggcattgggagcgttgggagggtggagggtgcgcaatggagcaatgtttttgcttgagggagggggtaatggtttgggaatgggaagtgggagagtgtgcagtcagagtcggagtgaggctggatggacctgtgcccctaaaagacgacgttttggaaaaggaagtggttttcgagcagtgcgtgacgcggactctgtctccggcgcgttgacattggaggagggacttgagaaactgaaggaggctctccaaatcttgaattctccttccccttctccccctactgtcctaagaccttcactttgttttgctcccaaccccactcctcctcggactttcctctcatttatgtttccaagaacgacgccgactctaaatcactctatgtcaatttggatgataat

SEQ ID NO: 46992 - DNA, 347 bp, Glycine max
  Peptide Sequence Number=SeqID_138677
atgcaagctacaccaagtaacaatctgatggactcaagtctagcaacaggggcgaaagtttcatcaaagtttttctacaccttcaatctgagtgtagccttgagcaacaagtactggcacttgtttctggttataacactcttcttcacattggttctgttcttgctggatgtggttggagtcccttctaagtgtgactctgttgtggatatagcatgctgtgttcatggcttcagcccaaggatctatgagagaactcatgagtgtgcttcagatgtgcagaattcaactcaactctttgaatacttcaaaggtgtctgttttctctctgataaagttgaccccag

SEQ ID NO: 46993 - DNA, 444 bp, Glycine max
  Peptide Sequence Number=SeqID_138678
atgagcaagatactcataatgggggcaatttttgttaacatggggattttcgttgttcaagttgagctgcttaatagtaatcactgcgcgatccgtaaggtttcgcaacatttcggaaagaaaatgggcaagaaactcaagttaggggcaaaatggaaaagggtccctgatgtcccaaaggtccagaaagaagaagaaagaagagaaaggaagaagaaagaagagaaaacaaggcaaaaatgcttccgaatcacttccgtgatcgattcctacaccgtttgtcattcgttcttcggtcgttcttcgttcttcttccgattagtgcttgcttttaaggatttgaatttgatttatggacccttaggggacccctttattgtttgtgcatcttcatctccttctttgaccattaaagcgagttttgaccgatcgttcatattgtaa

SEQ ID NO: 46994 - DNA, 126 bp, Glycine max
  Peptide Sequence Number=SeqID_138679
atgtcaaggaagaaggagataacactttataggttcagggttcaatcaatcaataattcattcagctcaaactgggtacaagggataattcattcaagcacatgcttgaccaagacaattatataa

SEQ ID NO: 46995 - DNA, 291 bp, Glycine max
  Peptide Sequence Number=SeqID_138680
atgaaatttccgcatgtaaatgactttgttgttcccggaggaacaaaaggtgcagaagactgtgtcagcccctgcatgctatcaagcgttctggatgcaaaagaatgggtgcgaataaccgtaagaatgaccaaacttggtctctgcttgtcatctgctctggatgacaaaagggtgcggataaccgtaagggtcagtatgacaaagacttatggggcggccgacaaaagcaaagctcttgctcctacgtatcctccaatgaggaactcagacctacgtagttctggataa

SEQ ID NO: 46996 - DNA, 324 bp, Glycine max
  Peptide Sequence Number=SeqID_138681
atggcagtaatggtggcccgggtaatgttggggaacggttacgagcccaaaataagtttaggcaaggacaacggcgtcataactagcttgataagcggcaaaggaaatcgtgggaagtttggattgggctacaaacccacacaggcagatataaggaaaagcgttgcgggaaggaaaaacggaagtcaaggctcgcgattaagacaagaagacaaaggaatcccgccctgccacataagtaggagctttataagcgcaggtctaggggacgaaggccaagtcgttgcaatatgcgaagatgatgctccgagtgggtcggatttg

SEQ ID NO: 46997 - DNA, 630 bp, Glycine max
  Peptide Sequence Number=SeqID_138682
atgaaaatctatgtaataagcggacttggtgcagattttaaagtgctggaaaaattgcagtttcctgcgcatctggaagtggtgtttatagactggctcattccggggctgaacgaaagttttcctcaatacgttgagagaatggcgtcaaagattgatgattcggaaccattttatctgttggggtattcttttggaggaattatggtgcaggaaatcaataaaataaaaccggctgaaaaagtagtgattttaggaagtattaaatctgataaagaaaaatcgaggttaataagagccggacagattaccaggatccctaaaattttacctacccgtttttttaatgaaaaaaatacagcggcatattctgtgctcaggaagttctttgatccaaaaaatcctaaggttttacagtatttcagggtgaaagatccttattatctgaaatggtccatagaaaagatttcagattggaggtttgatgaaaatcctgaagtgatccagatattaggtgacagggatattgtatttcctgtgaaaaattcaaaaccgaactatattatacggggtggaacccatctttttcccgctactaaatcaaaagaagtatctaaaatttttaaatga

SEQ ID NO: 46998 - DNA, 579 bp, Glycine max
  Peptide Sequence Number=SeqID_138683
atgacatctgaggcagcaaaggaaattgctgacaagattgatgcatttgaggatcaagcctcacagggttcctttgtcgcccatggacgtcatgatgtactgactgctgccattgggcgactagaacaccctggtcatgtgcgtgctgtaggagctggtgtaaccatcaaacaatactttcgatcaacttcaaggatctcctacacgtcttcctccatggctcccaaagacctgcagcagttgatgcaacaaatcagggaccaactagaggattcgatcacagaaaaagtcactcgacagctaatgttatcctttagccaaatgcagtcccaatttcagtcgcagatgcaatcacaaggacttgcactgcctcctgaacctgaggttggtccttcagctgctcgtgtcagcacaaaggagagttgtgttgatccctcagggaacgatctagacataggtgactcagacaaatgcgggttgtacatcgaagaatatcctcctcgcctggttgccctaggaagagtttataaggaatccataactgttcacaatattcctttgttgcatgatcaagtcaag

SEQ ID NO: 46999 - DNA, 683 bp, Glycine max
  Peptide Sequence Number=SeqID_138684
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 47000 - DNA, 464 bp, Glycine max
  Peptide Sequence Number=SeqID_138685
atgccaatctccccctgcagatgtatcagttgggatcacgcccacaagacacccagtggatccgaagaagtccaacagggccctggggtttccagctctggttacgagcctctgtcagtcctacagggtgcccgttcccccagcgaggaatcgcacccacaaagacacccagtggacccgaagaagtccaacagggccctggggtttccagctctgggatcgcgcctgcaagacacccagtggacccgaagaagtccaacagggtcttggagttgtcaagctctaattacgggtctctgtcagttctacagagtgcatgccacctccagcaagggcatcaggccccctactaatcgagctttcatcaagaagtactgcgcccccaggcaggcacagggcgaaacaccgcagcagcctggggatggccggcagcgggcaacagacgcaccgccatcacctctaga

SEQ ID NO: 47001 - DNA, 813 bp, Glycine max
  Peptide Sequence Number=SeqID_138686
atgaaaaaactctacttcagtgtactttctacgtgcattatttccgggttatcggcccaggaagtggtttggcaaaaagatatcaaatcttctacccaggatttcttgagccaggtaaccacaacaatcgatcagcagtatctgataacaggaagtgtcatacaggcagcaaatcaaaagaaggatgctggaagcaatacccagcaaaataatggttacgactttcatctggtgaagctgaaccaacagggagaccaggtttgggaaaaatatttctccggaaataatcatgattatttgtcttcaaccgtagctacccaggaaggaggctttttaatttcaggaacctcatattccggaaagggaatagataaaaaagatgactccaaaggaggatctgatatctggctcattagaattaatgaatttggagatgaattgtggcagaaaactttaggaacaagtgctgatgaagaagccagatcagttattcaaaccacagatttaggatttgttgtagccggaaatgttcagaatgcatccaaaggctatggttcaaaagatatcctgattatcagactcgataaaaacggaaaagaaatctcacaacttattttaggaggaagaggattagacgaagtggaaaagatgatcccaacaagagacggaggagcacttttgggaatctattcaagaagttcagagtttcgtgtttccgattccgggaatcaaaactcagccacaggaacctcaggttccgtatcccgctatgtaaaaaccactgaaaactttggtgaaggagattactggatc

SEQ ID NO: 47002 - DNA, 583 bp, Glycine max
  Peptide Sequence Number=SeqID_138687
atggtgaaagttggaacctcttacggtgccgatgcaacgtctcattctctaccaaaagtcccaggcttcccggtatcaacagggacaccaggacttattttttgcgaagtgatccgtcacagtggcgtatctggtttctatcagctgttctcctgttcagctactgacggggtggtgtatccgctcacaattcggcacacaagcataccagccggaacatcagcgctggcaagtgtagcctggggtgcagacgctgacgctaaccactcacacgccgcgcttaattgcttgccgctcagggcgcgtccgctttccattcagggaaacctgcggcaactgcttaagacggccaacgcgcgggcgatcgaggcggatgtgctgcatactggcgattactatgttggcactgataacgccagggtgtcagtcgaatgcgttcatgtggaggagaaaaaagctgcaccggcgtttccccctggcggctccctcgtgcgctctcctgttcctgcctttcggtttaccggtgtcattccgctgttatggccgcgtttgtctcattccacgcctgacactcagttcccgg

SEQ ID NO: 47003 - DNA, 447 bp, Glycine max
  Peptide Sequence Number=SeqID_138688
atggcttcaagtgacattgctattctgagagatagagcccacattcctactaaaacgcgcttattggagctaacctcaccagatgcattgttggcacataacaagttgttggatgtaaaatttgtggtggagctcatgaatctggatgttctatccttaatgaagaacaaaaataattttagtgcaggtggattatttggattccagcatggacaacaatacaaccaacaatcgggacaatggaggaaccatcctgggaatcaattcaatagagaccaggggggatcacccataaagccacaaccacaaaagcctagtctctatgatcgcaccacgaagctggaagagactttagctcaatttatgcaggtttctatgtctaatcagaatagcacagagtcttccaaaaggaatctagaggttcaagtgggagagctcgcaaagtag

SEQ ID NO: 47004 - DNA, 216 bp, Glycine max
  Peptide Sequence Number=SeqID_138689
atggcagcccaagaaactgacaagaggaaacgaagcatagcactaaaagtctcctcatcaatgcaagaggaaaatgaagatgaagaatcagaagataaagaagacttctcactctttgtgaagaattttcaaatatttgtcaagaagagaagaatcgagaggcgtcaaaatttcaaccatggaaaaagattccaagaagactctccaactctttga

SEQ ID NO: 47005 - DNA, 320 bp, Glycine max
  Peptide Sequence Number=SeqID_138690
ggatcgcacccacaaagacacccagtggacctgaagaagtccaacagggccctggggtttccagctctggttacgggcctctatcagtcctacagggtgcccgtaccccccccggcaagggtcacgtcatcatagggatcgcgactgcaagacacctagtggacccgaagaagtccaacaggcgggcaatagacgcaccgccaccacctttagagttcacctctgctcatccacaaaaaggtttgagtattgcctacgacacatggccgaccaataggcaaccaagtccaaagccaaagggcgcacctagttgctcatga

SEQ ID NO: 47006 - DNA, 354 bp, Glycine max
  Peptide Sequence Number=SeqID_138691
atgaatcgagttacatcactgcttcatttactgccaaacacatttaggactgttgatatccttgttacttccagtttcaccttgacgaagataaaaggacacgctttacggcgcccttaccgaactcgtgctagagctagagcaatagatgaagcagaggaggtgcaagagaagatgaaggccgacatggaggccatcaaagagcaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatg

SEQ ID NO: 47007 - DNA, 138 bp, Glycine max
  Peptide Sequence Number=SeqID_138692
atgggttcatacttagtctatgggcccaaaatctaccctaaggctcataagaaccctaaggccttctgctgcatctctggcccaatcttcttggagtcttctatccaatacccttgggggatattcagtagaagatag

SEQ ID NO: 47008 - DNA, 306 bp, Glycine max
  Peptide Sequence Number=SeqID_138693
atggagtcaagagtgcattcatttacatggtctaatcaaaaggaagtatatgtagaacaacctcccgggttaaagaaagggctacttctatgggtaattccttacatagcacctaggttggatatgacaacaaaaattctttggaagatccacaatgaagaaagaaatctaaaaaggaagagagatgaagaaaacaaggatgatcaaaatgacacagcccaagaagatgatattcttcccaaagaatggaaaacttcaagagtcttcctcttgacaacatcatcggagatatctcaaaagtggtaa

SEQ ID NO: 47009 - DNA, 399 bp, Glycine max
  Peptide Sequence Number=SeqID_138694
atggagtacctagagggagcttgggagaccctagaaggcaacacgaggtgccgatttcggggcacgattcgatttacgaatacttcattggtgcatccagacgaacccgcgcgcacgcttcagcgtactgtggagtggatactacccacgcctacaccataccgtctagtggagccagcccaagtgatcgaggtgacgttatccgaggaagaccctgaggaggatcccgaggagctacctcctgagcctgctgtggatgctcttgactttctagagggtgatgaggacccactccttgaggtggattctcccgaggacgtcatgtcggcatctgaggtagactctacggaggatagtggtcctggagagatggcgatcaatgggggctcttcatcatag

SEQ ID NO: 47010 - DNA, 722 bp, Glycine max
  Peptide Sequence Number=SeqID_138695
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggatctttttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 47011 - DNA, 1548 bp, Glycine max
  Peptide Sequence Number=SeqID_138696
gctggcgcggcacctaaaggacgttacgcctatttcatcgatcgcgaccagggcggcaattttgccctgcatccgctgacctcaatctttaagccaggccagggcgattactatctgctgccgcagaaaagccagaaagatacgctgatcgaaccttatagctatgcctataacggtgtgccaacgctgctgacctcggtggccgcgccaattatcagccagggcaaactgtggggcgtggtgacgtccgatatctcactggcgtcactgcaggaaaaagtgaacagcatcaaaccgtgggaaggcagcggttacgccatgctgctctcgagcgcgggcaatgtggtgtcttatccggacaaaagccagaccagcaaagcctggaagggcgacacgcataatttcagcagcacggtcaccgaacagcatgacgctattctgggcgaggatgcgctggtggcctggcggccggtggtgatcggtaacagcgatcagaaatggtatctcggcgtggtggccccggtgagcaaggtgatggaagcggcgcaccgtcagctgattaacgcggtgattttaatggtgatcagtatcctggtggtgtgcgcactgcttgggctggtatttagtcgcaaagtgctgaagccgattggcggtgagccactgaccgcagccaccattgcgctggcggtggccgatggcaaactggataacgctatcccgctgaaagcgcgcgacagcagcagtctgttcttcgccttgcacaccatgcaaaaccagctgcgcgaaattgtcgggcagattcaggatgccagcgcgtcggtgcgccagggcgcgggtgaaatcgccagcggcaacctcaacctcgcgtcacgtaccgaagagcaggcggccgcactggaacaaactgccgccagcatggagcagattaccgcgacggtgaaacacaacgctgctaacgcgcatcaggcaacgacgctgaccgataacgccacgcacatcgccagccgcggtgagtcactggtgggccaggtagtgcagaccatggcgcaaatcgacgacagcgcgaagaaaatcggcgacatcaccgccattatcaacagcatcgccttccagaccaacattctggcgctcaacgccgcggttgaagcggcgcgcgccggggaacagggacgcggttttgccgtggtggcgtcggaagtgcgtaatctggcacagcgcagcgccaatgcggtgaaggatatcgctgcgctgattgaagagtccggccagcgcgtcggcagcggtgtgcagctggtgcaggatgccggtaaaactatgcaggagatgacgcaggcggtgaactcggtgcgcaccattatcggcgaaattgttaccgcgtcagacgagcaggcgcgcggcatcagccaggtaacgatcgcggtgaacgagatggatggcaccacccagcagaacgccgcgctggtccagcagatgtcagccgccgccagttcgctggaagaccaggcggcacagctggcgcataccgtgggacgttttcacctcagttaa

SEQ ID NO: 47012 - DNA, 897 bp, Glycine max
  Peptide Sequence Number=SeqID_138697
atgaaaaccattttaatcaccggctgctcttctggttttggtcatgctaccgcgctctggtttctggagcgcggctggaaagtcatcgccaccatgcgcaccccgcgcgccgaactgtttcctgaatccgcccatctgcgcctgctgccactggatgtcaccgatgccgagagcatcaggcaaacgctggctgaagcaggagagattgatgtgctggtcaacaatgccggcatcggattattaacctcgctggaaggcgcgccgatgtcctcggtgcgagaggtgttcgaaaccaacacgctgggcaccatcgccatgacgcaggcggtcatcccgcagttccgtgcgaaaaacagtggcatggtgatcaatgtgacctcgacggtgacgctgaaatccctgccgctgctggcggtttataccggcagcaaagcggcagtcaacgcctttaccgagtcgctggcgctggaactgcagccctttaatgttcaggtgagactggtattacccgggctggcacccaccaccgactttggcaaaaatgcccggccgcgcatggaaaacaccttgctcgagccttaccagccgatgtttgatggcatcatcgccggcatgcagcagccccagccaaccactaaagcacaggacgttgccgctgccgtgtggcgtgccgcgaccgatcccgccgcaccgatgcgcatcccggccggagaagatgccgaagcctcgatgaagcaatacgtgccgccagaccgtcgcgcgccagccagctttgcagcggggcaaacaacggttcaggcagcgcctcaggcgcgaaccagtgccagcctgcgcacttatccggttcccgcagctgcggctcgccgctggcgtccggcgccaccatcagcagcgtaa

SEQ ID NO: 47013 - DNA, 1017 bp, Glycine max
  Peptide Sequence Number=SeqID_138698
atgaagaaatcgccggcaaaaatcattttgctgaatttcgccaccaacgatgcacgccatttccatttccgcgatatagaaaaggattaccaggagccgcacccgatttgtggccgcgcggagaaatggcacgttgcgccttacgtcaccaaactggacgcgctggctaaagcggagtcggtgccgctggcgcgtcagtatcagcgcatcctgcagatgaaagactggcagtcgctgatgtcacccgattgtattcatccgtccgaacagctgtaccgcatgaaagcagaggaaacgttttcggtgctggtctcccactttaataccgagctggctgctgccgggcatggcaaaaacccggatggcgagcagtgtccgcagttgctggatacggtggcaacaatgcttcatcaggagtggtccgggttttctcactggcgcgaccggagcgccattcgtcagcgcctgctgatgcgcaacgcgcagccggcaaaaacgtttacgctggtcgcgttgaatgcagaaaatgaagtgcttgccaccgccagcacgattcttcacgagcttgatgacatccatgaacgccagttctggatgggcgaagtactgactgtcgcggcacaccgcggcattttaccgtcgctatggctggcaggaaatcgagcagcgcatcgtgtcgtcagaacagcgccttacgtgcacgccgtgaagcatggcgacacactttacgtttcgggtctgactgccttcgcaacaacggcgcagcaggcggatattactgcgcaggcagaagtgatttttcagcagctacatacactggctgcgcaggaaaacacatcactgaaaaacctgataaaagtgacaatctttgtcacctcattcaccgatataaatgctttgcgcgacgtgctttaccggcattatggcgaacacctgcccgccagttcactggtgcagattagccagctgttttgccccgatctgaaaatcgaaattgaagcaattattgctctgtga

SEQ ID NO: 47014 - DNA, 3264 bp, Glycine max
  Peptide Sequence Number=SeqID_138699
atgagcaccggtaattacgatgatgaagtggctgccgcactcggcgatcaggtggtgctgagtgccgatggcgcgaaagccagtgtgaaaatcaatcgcggcaaaacgctggaagtggctaatagcgccagcgccgtgatgcgcgccagcaacggtgcaacggcgattatcgccggaaaactggcgaccagtaacgcgccctcatccgaagcgggcgcactggagctgatcagcggcgcgcgtggtatcaataatggcgtcatcaacagtggcttttttaatgccgccaatgggcgcggcgtggcagaagactctctcggctatgcgggcacggcggtgtcagcgatttatgacagtgagttccgcaacaatggtgtgctcaatgtgcatattggcgatgcgccgtggggcaccgccggcttattcctcggcagcagcagtgcggtcaatcacggcaatattaacatcggcattcacgatgtggcgaacggctcctcagcagcggcggtgagtttcagcggcgagggtagcttcgtcaacgcgcgcgatggcacgatttatctcggtcgcacaccgcaaaatcacaagggcgacgtcacgcaggatgtcgcggtcagcctcggcggtggcatcagcgccatttccggcctgctcgactcgcgtgccatcaatgatggccgtattgttatcggctcaaaagtcgagaacgccgttggcatgcgcattgaggccgggcccaacgcggtgtcactgaataacggtgttatcgacgtcaatggtatggcgcaggcgctgccgcgcgaaaatatcgccatgctggcgatggattccggcagcggcggtcaggtgggcaaccgcggcaccctcaatctgaatggctataacagcaccggcctgaaagtgatcgccacggcgggcaaccaggcgcacgccttctccagcggggcgatcaacgtggcgggtgacgccgaccgctttggcggcaccaacaatacggcggtgtgggtaactggcgaaccgggcggtcacgccagtgccgatatcaccggcccaatccggctcagcggtaaagcgggcattgggattcgtgctgaaggccaggcaacggtcaacgttagcgccggcggcattcccacctccagcggcagcgacagcatgctggatagcggacagatcagtttctaccgtatcggcccggatgcgcgcattaatctgccggccaacggccgctacagcgcctccgtgtggaacggcacgatttttcgcgtcgagcagggagcggattttgacgggcgcggcctgactctgtcgatgaatagcccgtttgcgaccggtgtgtacggcagcggtgccggcaccgacattgatacccacggcgcgacgctgaacatcgccagctttgccagcgggctgactatcactgatggcgcccgcgccaccattgatgccgcaacgcgtattcacctcaacgggtctgatgcccgcgtcgccatcgctgacggtaatcgctatacgctgcagggtaacgttgttaaccctaatacgcagttcgacccgaacactttattgatcaatcaggcagcgatagacggccgcgccaataaccagcagccgtttaccgtgatgaatcatgcgcggctggtgaatcgtggcgctatctccctgcggggtgaaggcgtaacgggtatctacgcgcagtatggcgccacagtcgacaaccgcggcgatatcaacattttgcgtaatggccgggcgctgttcgccgatggttatccaggcgccggcgacggcaaaaccctgacggagattaacaatagcggcacgcttaatctctacagcggtcagagcacccagcaaaccaccaccttcggtgcggtctcgtatcaccagctggggcggattaaccagaacggcacaattaatctgtacggcgataacgtggtcggcgcgaaagcctttgccggcggccgtattacgctgggcgtgaacagccgtgtggtgttccacgatgcgcagcagatcggctatcaggcttttgatcccggctcacgcctgatcgtcaacggcagcccggttgatgtcagcagtcgtaactcgacgctgtatgaaatccgcaacggcgcgtggctgtacaaccagggctttggcaacgttacgctgagcggcagggacagcaccggcatcgtggtcagcgggacggatgcgctggtatccagcaccgatgtttatcaggtcaccggtaagggtgccaccgtgctgcgcgccagcgatcgcgcgcaggggatcattaccagccttatcgcgctgaacggcaaaaacaccctcggcgcgcaggcgacgggcgatggcaccgaggtctacgccgcctcgctcatcaccggcaccgggcgcaacgccacggcgtttgatgtcagcggcgacgcgcgcctgtttaatcagcagcagggcgtagtggatttgcgtggccgcaacagtaccggggctcgggtgcatgatggcggtaactttatcaaccgcggcacggttagcgtcgccagcggcaccggcgtggacgtcagcagcggttatggccagtatgtaccgctcgatagcaccttacgcgtgaatgacggcaccgccgcgctgcgcgtgggctccggcggcgcgatgaaaatttacggcgacgggcagggggccagcacgctggcggcttacggcaaagccgatggtttgctgctcgacagcggtgcgcagcgctttgaagccaacgacatcattatcggcgcttacggcagcggcactgcgctgaacaatcgcgccggcatcagtgacatttcgctgagtaatgtgcgcttcgaggccaacggtggcactggcatccgctctgccacctcgttcgatccggcgggcagcgcgcagattcacgtcggcgcaggcggtaccggctatcgctatgaaaacgcggatggatcgaccacgggcaacgatttagtgattgggcgcgactaccgcattgaagtcaatggcagcggcaccggcgtgcgtgccaacacccgtggacgggtgatcgctcagggcctgattgatatccgcgatgccgatggcggttcggcgattgtcacccgcagcgccagccaggtgatcaaccagggcaccatccgttcacaaagccgcgtcgcaccgctcatcgatttgcgcggcggcgagacggtgtttatcaaccagggcacgctggatgcgccgtacgccgatcaggtggtaagtggcgggcggcgcgacccgtga

SEQ ID NO: 47015 - DNA, 1544 bp, Glycine max
  Peptide Sequence Number=SeqID_138700
atgcctgaaatctctcttcctgccagcccggcgcgtcgccgctggcgctggacccggcttgctgagccatggtggtatctgtcaccgggcctgttgctgatcgccctgttcatcttcgtgccgatggcgatcggcatttcttacgcttttcagagcatgaacctgctcaatccgctggagagcggctgggttggctgggcgaactttgcgcagatgctcgacgatcgccgcttctttcgcgcgctcggccatacccttaactggacgctgagttcactgctgctgcagttctttttcggcctcgcgctggcgctgctgcttaaccgcgagtttcgctttcgccgctgggtgcaggcgctggtgtttttaccgtgggcggtgccggcgtttctttccggcctgacctggtcctggctgctcaacccggttgtaggtccgctgccacagtggctcagcgacgtgggcattctcagcgaaccttacaatattctttccgatccgcaactggcgatgtgggggccggtgattgctaacgtctggtttggcatcccgttttttgccatcactctactggcggcactacagtcgattcccaaagatttgtatgaagcggcagccatcgacggtgccagcggctggcagcagtttcgccgtgtcaccctgccgtttctcgccccgatgatcgccattaccgtgatgctgcgtaccatctggatcgctaactttgccgatttaattgtggtgatgaccgacggcggtccggccggttcaacctcgattctttccagttacatcttcaccaccgcttatcgcaaactggattttggttatgcctcggcgatggcgggcgtgacgctgttacctggcggtttcaccctgagccattttgcgaaggtattgaccgacagtgatttccccacgttttttattaacagtctcattgtctcctgcagcactgccgcgctcaccaccttgattgctgcgggtgccggctatgccttttcccgctttcagtttcgcggcaagatggtgatggcggccctgctgctgtttacgcagatgtttccgctggtgatgatcattgcgccgatttaccgggtgatggccccgctgggactgacgaatagtctgctggggctgattctgatttacagcgccttcaatgtcccgttcgccaccttcctgatgcagtcattttttgatgccatcccgaaagatctcgaagagtccgccatgctggaaggctgcacccgctttcaggcgctgtaccgcgtgctgatgccgctgacgctgcccggcatggcagcgacgctcggctttgttttcaccgccgcgtggagtgagttgctgttctcactgatgttaatcaacaaaaacgaagttatgacctttccggtcgggctgctcagtttcgtctccaaattcgccgtttcgtggggcgaaatgatggctgccgccgtgctggcgttaattccagcctgtctgttcttcgctttcattcaacgctatctggttcaggggctcaccgccggtgcggttaaggg

SEQ ID NO: 47016 - DNA, 351 bp, Glycine max
  Peptide Sequence Number=SeqID_138701
atggggatcgcacccacaagacacccagtggacccggaaaagtccaacagggcccaggggtttccaaatatggttacgggcctctatcagtcatatagggtgcccgtacccccccggcaaggttatgtcatcatagggatcgcgcctgcaagacacccagtggacccgaagaaagtgcatgccacctccagcaagggcatcaggccccctactaatcgatctttcatcaagaagtaccgcgtccccaggcaggcgcaaggcgaaacaccacagcagcctggggatggccggcagcgggcaacagacgcaccgccatcacctctagagttcacctcagctcatcgccaataa

SEQ ID NO: 47017 - DNA, 321 bp, Glycine max
  Peptide Sequence Number=SeqID_138702
atgtacatgatgaggttgtcggctctcaatgagtatgggagcggagttattgacattctcgctgggagtgtacgccacattgggtggtgtatagttgggaggcaaaccatatggcaggaagatgggggcatcgggttcatcttagcaatagcgctagtagcagcaactgcaaccacgttggcttcaattatcttcttcatgctcatcatggcctccatcattgtggccatttgctctttcatggtctccatgtcggccttcatctgcttttgcacctcatctacttcacccattactctagctctagcacgggttcagtaa

SEQ ID NO: 47018 - DNA, 783 bp, Glycine max
  Peptide Sequence Number=SeqID_138703
gactacacgtccctccccttgagaggactacacatcctcgccaacagaggggctggacgccctcaccttcagaggaccacatgtcctcgccttgagagggctacacgcccctcaccttgggtactagttaccctcaccgttgagaggactacacgtccctcgctttttagagggactacacatcctcgccaacagagggctggacgccctcaccttcagaggacacatgtcctcgccttgagagggctacacgccctcaccttgggactacacgtcctcaccatcagagggctgcacgccctcacctccagaggactacatgtcctcgccttgagagggctacaccgccctcaccttggaggactacacgtcctcaccatcagaggactgcacgtcctcacctcagaggactacatgttcctccttgaggggcataccgccctcaccttgggtactagttaccctcaccgtctgagaggactacactccctcgcttttagaggactacacgtcctcgcaacttcagagggctacacgccctcgccttcagaggacacgcgtcctcactttcagtgggctccatatccacaccttaagactaatttaaggtcctctgtgcttaaatgcttaaccgagacttgcactcccgggccaactgtgcgagcacaaccagagagggaggctatcacacagctactatgcatactggggcaagatttcacccgtgccgctgcaaagagacgagtgcggatcatgcgcaccaacatgaccactcttacatag

SEQ ID NO: 47019 - DNA, 899 bp, Glycine max
  Peptide Sequence Number=SeqID_138704
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattttcttatccaagctggaagttcaagatcaaggtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 47020 - DNA, 914 bp, Glycine max
  Peptide Sequence Number=SeqID_138705
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgcccaatccacgcactcggcgaccacggatttccagcagacgctgagcgtcaatcgtcaacccaacaatgcgccatcggtccaccgcagcgagctcggtcggcggagcgatgccaggaaccagcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 47021 - DNA, 336 bp, Glycine max
  Peptide Sequence Number=SeqID_138706
atgacaccggtaaaccgaaaggcaggaacaggagagcgcacgagggagccgccagggggaaacgcctgcagaaaagtccattcttccatcgaattccgcgcccgtggggataagccactagttctgagcgtcgccgccatcgacgcgagcgtaggagctcaggagcgaggaattgcccggaatagtgagtcctgtattcacatattcagctggccggtgcagttttttctcctgccacatgaagcacgttctgactgggaacaccctggcatcagtgtacccaacatagtaatcgccagtatgcagcacatccgccctttagcgccgctggcgtaa

SEQ ID NO: 47022 - DNA, 1146 bp, Glycine max
  Peptide Sequence Number=SeqID_138707
atgattaagggtctagatgtcaccagcctcaaggaattgggacgattgatgggacctctccaaaggcaagccttccgcaaaatgtacggaaagattttaaatttgaccgcagcggagccgttgaggtgctttacgtttggggacttccaaatggtaccaactgttgaagagtttgaggagatattaggatgccctcttgggggaaggaaaccgtatcttttctccgggtttcttccctccttgagtaagattgcagttgtggtcggagattcggcaaaagagttggatcgcatgaagcaaactcggaatggcgtagtaggcctgccacggaaatacttggaaggcaaggcaagggatatggcaagccaagagaaatgggtcccattttcggatatactagttttgctgatctttggggttgtcctctttccgaacgtggacagtttggtggacctagccgtgattgatgctttccttgcatatcaccacagcaaggagagtccaatggtggctatcttggcagacttatttgatacctttgaccgaaggtgcgagaagaacagcgcacagattgtctgttgcttacccgctctttgtgtgtggttggtttcgcacctattccaacaagacataaggcactcgtgtccgcttcaaagttatcgctcgtgtgtcgaaaagagaagagtagattgggaccaatacttggctgggataggaggcagcacaatcaactggtttcctcgatggaaggaaggaaaggaggaagttctcttcttatgtggggactacccaaacgttccattgatagggacaaggggttgtattaactataatcccgcacttgctataggacagttagggtaccccatgaggggagcaccgacggaagagagcctctcgcctttccttgtgagagatttcggcgcacaaagtttcaagatcgtacaaagagtccacacggcgtgggaaagcctgttaaggaaagataaagaacttaggggcatccgtaatggcatcattggtggttatcatgaatggctaagagttcatacacgagggttagattggctctccaagttgaaaattatcaaagaggagaacttcgaagctccggaagaggatgaagaagtccaagctctaaaataa

SEQ ID NO: 47023 - DNA, 312 bp, Glycine max
  Peptide Sequence Number=SeqID_138708
agacagttccagggtgatgctccgcaggccgcagatgcgccgccacctcatcaggccggtccagccggattgtttgatatggagcagtatttgcagcatttgatgagcctcagcttgcagagccaaggctttacttcttttccgtgccctactccggaccagttcagggcagaggtcgcatggcctgaagattggcctgaggcccgggcaggagaggcaccagcagaggctcccgacgaggcagatgaggcccgcgaggatgaggagatgaccgatttacttgatttcttaggaagaagcggggccacatga

SEQ ID NO: 47024 - DNA, 201 bp, Glycine max
  Peptide Sequence Number=SeqID_138709
atgccatatgctaacttactcccctatctgctcgataatgcaatggcagctataagcccgacaaagatttctcaacctccgtttcccagaggatacaaccccaacatgacatgtgcttatcataggggagttccggggcattccattcagcattgtatgaccctgaaacataaggtgcaaagtctgattgatgcaggctag

SEQ ID NO: 47025 - DNA, 321 bp, Glycine max
  Peptide Sequence Number=SeqID_138710
atggctccgaaaaagatttccaagaagagatctaggagagatgccgcggcgaaagggtccagtgtcgcccccaagtttgatagccaccgtttccggagcaccgagcaccagcagcgcttcgaggccatcaaaggatggtcgttccaccgagagaggcgcgtccagctcaaggagaacgatcaaacccaagaagatgtaccctctacttgtaccaccaaggatgtaccctccaatgggttgagacaaagatctcaggctgttaaacctttgatactttgtgaatggggatacaaaagaattctcaggcagttagtcctttga

SEQ ID NO: 47026 - DNA, 270 bp, Glycine max
  Peptide Sequence Number=SeqID_138711
atgatttttcactccccttttctccaaaacgtcacccaaacactaacacctccttttccaccacccacaaccaccagtggccgccacgagccgccgttgcttgccaccaaacccccccaccaagagaaacatcttaatcagagcggaatccttggaatcctcctcaaggattcgatggagagaattcccccaatcctccatttcaaagcttctatgagtgcctcttgtatgttgggtactgtcgcaacctacccttttgcgggcgagtga

SEQ ID NO: 47027 - DNA, 542 bp, Glycine max
  Peptide Sequence Number=SeqID_138712
aaggaaccagcacacagggtattgcttatttatcgaaaacggacagtcagggcagccacagtcactcattgtccggtacagccgtgagtgccggtgcacatgcgcatacagttggtattggtgcgcaccagcatccggttgttatcggtgctcatgcccattctttcagtattggttcacacggacacaccatcaccgttaacgctgcgggtgacgcatatattccgcctcataccggtctgcctgcaaacagtaccgatattgcaccgccagatattccggctggctttgtggctgttttcaacagtgatgaggcatcgtggcatctcgttgaagaccatcggggtaaaaccgtctatgacgtggcttccggcgacgcgttatttatttctgaactcggtccgttaccggaaaattttacctggttatcgccgggaggggaatatcagaagtggaacggcacagcctgggtgaaggatacggaagcagaaaaactgttccggatccgggaggcggaagaaacaaaaaaaagcctgatgcag

SEQ ID NO: 47028 - DNA, 291 bp, Glycine max
  Peptide Sequence Number=SeqID_138713
atgtcaggatttacacacgattctcctcaaatttcagccagcccgcatcaatttgaccttgcaccttacgcttcagagccctacaatgctcaatggaacgccccggggcttctccgtgacaagcacacgttgcgtttcgagtcgtattctcggagaaatggagggatggcctttgtgaataactgggcagtgggtaaggagaaggaatggcagtcacagcatgggtttctccctcatcctcaccctctttatttgccccagttttctcattcgtccaagcaggatgattaa

SEQ ID NO: 47029 - DNA, 730 bp, Glycine max
  Peptide Sequence Number=SeqID_138714
gaagaggggttcccgcagagcgtgcaggcgatcgcgaaacaaatccgcgaagcggatggcgtggtgatcgttactccggaatataactactcggtacccggcggtctgaagaacgctatcgactggctctcgcgtctgccggaacagccgctggccggtaagccggtgctgatccagaccagctccatgggcgccatcggcggggcccgctgccagtatcatctacgccagattctggtcttcctcgatgcgatggtcatgaacaagccggaatttatgggcggtgtgattcagaacaaagtcgatccgcaggcgggtgaagtggtcgatcagagcacactggaccatctgcgcggccagttgaccgcctttggcgattatattcagcggcacgaacagcagcgaaacgataatcacgcacgggctgagttcacgcagacggccggtaccaatcttcatcacgcagtaggaaataaagcccagggcgataccttcggtgatcgagaagctgaacggcatcatcaccgcggtgataaacgccggtaccgcttccgtcagcacgccaacgtaaatcagcgccccagcggcggcataggccggaaccatccccgccagcggcgacaggaagatgaccagcaggaacaggatacctacgacaacggcggtcaggccagtacgcccgccaaccgaaacgccggaggaggattcgatataggccgtaaccgaagag

SEQ ID NO: 47030 - DNA, 701 bp, Glycine max
  Peptide Sequence Number=SeqID_138715
atggatcgcctgatgcaggcgttaggcctgccggggaaatccttcgtgccgctgatcgttggtttcggctgtaacgtgccttccgttatgggcgcccgtacgctggatgcgccgcgtgaacggctgatgaccattatgatggcgccgtttatgtcctgcggcgcgcgactggcgattttcgcggtcttcgccgctgccttctttgggcagaacggcgcgctggcggtcttctcactgtacgtactgggcatcgtgatggcgatcctcaccggcctgatgctcaaatacaccattatgcgcggcgaagcctcgccgttcgtgatggagctgccggtgtatcacgtaccgcacatcaagagcctggttatccagacctggcagcgcctgaaaggcttcgtcctgcgcgccggtaaggtgattgtcatcgtcagtattttcctcagcgcgctgaacagcttctcgctcagcggcaaagtggtcgataacatcaatgactcggcgctggcttcggtcagtcgggtgattaccccggtgtttaagccgattggcgtgcatgaagataactggcaggcaaccgtcggcctgtttaccggcgcgatggcgaaagaagtggtggtcggtacgttgaacaccctctacaccgcggaagatatccagaatgaagagtttaacccacaggagtttagccttggcgacgagct

SEQ ID NO: 47031 - DNA, 303 bp, Glycine max
  Peptide Sequence Number=SeqID_138716
atgacatttatggggctccgaaaaaaagtggagaatagagaattggcgaacagcgctactgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 47032 - DNA, 424 bp, Glycine max
  Peptide Sequence Number=SeqID_138717
aggcggcgggcccgatgatacacggagataccttacggttatccgcacccttttgtcatcaagaggcggcgggcccgatgacaagcagagacaaaatttggtcattctgcacccttgtgtcatccagaggcggcggacccgatgatacgcggagataccttacggttatccgcacccttgtgtcatccataggcggcgggcccgatgatacgcggagataccttacggttatccgcacccttttgtcatccagaggcggcgggcccgatgacaagcagagacaaaatttggtcattctgctcccttgcggcgggcccgatgacagcagagactttggtcttctggtccttgtgaggctcatcattagggcgatttgtgaaattccggagatacgacaagtcgatgtgtcatcccgcggactctc

SEQ ID NO: 47033 - DNA, 336 bp, Glycine max
  Peptide Sequence Number=SeqID_138718
atgccactctccatgtgcagaagactgggagagttggagattatgcctcaacgagatgactcctcagccctcatgcatgaagttttttcggggttacgaggcctccgcacctatgttggtgaacgctttgattccttggatggtcgtattgatgccattgatgctcactttgaaggaatggatacccgcatcactcagcttgaggaggataaattaaattgtcatcatcaaaaagggggagattgtagaagcaaagactttgatgttttgatgatgtcaaaggatcatgtgcttctcaagtttaattcaagaggatcatgcgcttctcaagtttaa

SEQ ID NO: 47034 - DNA, 420 bp, Glycine max
  Peptide Sequence Number=SeqID_138719
atgaagcacttcactgacaccctcatcagtgccaacatagaattatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 47035 - DNA, 372 bp, Glycine max
  Peptide Sequence Number=SeqID_138720
atgtcctcgcctcatcttgggactgcagttaccctcaccgttgagaggactacacgtcctcgccttgagaggactacacgtcctcaccatcagagggttgcacgccctcaccgtcagaggactacatgtcctcgccttgagagggctacacgccctcaccttgggactacacgtcctcgccttgagagggactacacgtcctcaccaccaaggtgcacgccctcacctccgaggactactgtcctcgccttgaagggctacatgccctcaccttgggtactagttaccctcaccgttgagaggactacacgtcctcgccttgagaggactacacgtcctcaccatcagagggctgcacgccctcacctctag

SEQ ID NO: 47036 - DNA, 637 bp, Glycine max
  Peptide Sequence Number=SeqID_138721
cgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccactctggccctctacgtatggccaccgctcatgcacagagaaaaaaggaggcaagttgggaccgactcttggcaagcaaagaaggagcgtctgtcaactggttcccccgatggaaagaaggaagaaccgggattctcatttcgtgcggaggatttccaaatgttcccttgatggggacaaggggttgcatcaattacaatcccgtcctcgctataagacaacttggctaccctatgagaggggcaccactaaaggaagagctcacacctattattgcacgaggtttcaatagcaccaacgcggaggcacttcagaaggtccgcaaggcatgggagatggtgcaaaagaaggacaaggaactcaaaggtagtagcaacaagcccatcggcggctaccatagatggttgaaagcctacatgcaaggtctggattggctcccgaatttgagaaccactaagggggtggaagttgaagctccagagaaggacgaagag

SEQ ID NO: 47037 - DNA, 774 bp, Glycine max
  Peptide Sequence Number=SeqID_138722
atggatttgaaggaaggttgtacttatgtgatgcacaattttagagtcaccaagaatgatgaacagtacagagtttgtgatcatccatataaattgacatttattggagttatggttgtcagacagtgtgacttagatggccttcctttaaaaaagtatagatttatagatttttcagatatcattgttggccaattacagtttgacctattagtagacatcattggtgttgttgacgaggttgtctttcgtcatatttcacccaaaataatgaattggtgtcttgcactctatgggcctattattgtgttgttgaccaatgccagaattaaagagggccagggatcctatccatgctcggttagcaattctttgaaggcttctaaattgactattaatgagccactgacaccaattgaagaattcaatcagaagctttcagaattgggcattgagatccggtcaattttgacacgtcgttcccagtggagttcacagccttcaggttctgctcagttatcatcaagggagacattcatttccaagttagaggcaaagagcatttctgagataaacaacctttgtgaagtaattcacttatatatgtttacctgtttatcgcttctttggatgcctcctgctaaattttatagttggtacaatcacaaggattgttatggacaatcattcatggtgttatccatcttgcattcagtgctaaaagaaaatagatgtctatccagaaccatttgtgtgcccatgtggcaaacctaa

SEQ ID NO: 47038 - DNA, 414 bp, Glycine max
  Peptide Sequence Number=SeqID_138723
gataagcgctatccattgagtaaagggagggtttcctacactacagtgattcgggcggcggttggtggccccttcgagagttgcgggtccttgccgctgcatgagtggggtcagtcaagcggttcgggttctcggtcggttcccggcgcccgcctcctcttcagacgtgtcttcgacaacctggcggttgttcggtctccgcttttggaggcgggagtgcttggtcgctggggtttccttttcctcaaccaattcggttgtgtcagccctgagattggttggtctaacatttatgagctggctggacaaagatggatggaaggtaagatagattggagttcaagtggcacaggaccttcgatcgaccatggggcgtattctacccttaccgaattcattctattgaagcgtaac

SEQ ID NO: 47039 - DNA, 606 bp, Glycine max
  Peptide Sequence Number=SeqID_138724
atgaaaagagaaaaacatgtctcctatagtagtcataactcttgcaagagcctaagtgaagaacttcgtgactattgtgaaggaaggcataggtcacatcttagacctcactcccataggagagaaaatgaaagaaagcctcaagaggttaacattaaactcccatacttccatgggaaggacaatgtagaggctaatttagattgggaaataagggtagagcaacaacttaaaaggaagtctacttcaaaatcttatggctctcactcttatccaaagaaagaccaaggtcaaggaatcttagggaagactagctccatgaagtgctttaaatgtcttggaagaggacacattacttctcaatgccccaccaagaaaaccatgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtataaggagacacttgttagcattgccacatctcttaggcttgagtttattcctcaagtaaaggagttgttggat

SEQ ID NO: 47040 - DNA, 393 bp, Glycine max
  Peptide Sequence Number=SeqID_138725
atgtacgtgccggttcaacgaaggggacttggtgttgaagaaagtatcccaagctcagaaagacaacagagggaagtgggccctgaactacgaagggccattcgttgtaaaaagggttttctccggaggggccctggtgctcaccaacatggatggcaaggagctaccttcaccagtgaactccgatgttgtcaagcggtactatgcttaggatctggggcaattgaggaagtcactgcatgttcttttatttttgtgtgtccttcttggtttcccccagggattcctgtcctctgtaatttctcatcgcagtcttttaaaagaaaagaacatgggattgaggcaatggtcaaatgtcgggccgaatccaaaggtagagaccaatcaaggtaa

SEQ ID NO: 47041 - DNA, 467 bp, Glycine max
  Peptide Sequence Number=SeqID_138726
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccatcaattgcttgtcattcatgcatccttcatcatcgagtctggagccccacgaattgattgcctagggctcatcgagtttggagccccacgaatggatttcctagcgctgttcgtttatcctacaccctcaaatcttatccggagccccatgaattgcttgtcattcatgcatcctccgccatcgagtctcgagccccacgaattgattgcctag

SEQ ID NO: 47042 - DNA, 594 bp, Glycine max
  Peptide Sequence Number=SeqID_138727
atggccgactttcgtctctggtcgaccagtcggtctcacagtcaggcaggcttataccattacgctcacgagcagaatcttagcttgagcctaccttcgcacacctccgcatccttagacgaaaagagtggtctttcggattggtcgttctgtgtcatcacctcccacctatcctacacattcgatcaaggttgtcactgcgaagctatagttaaggtgcacggggtcttaccgtctagccgtcgctacttatgcgacaaggaatttcgctaccttaggacagttagagttactgccgccgtttaccggggcttccattcaaagcttataacacttctccttccgaccttccagcaccgggcaggtgtcagactctatacatcgtgttaccacttagcagagtcctgtgtttttaataaacagtcgctaccccctgttcaccgggaggatcgccctcccaattcgaagttttttcctggaagtttcaaccttgttgactatgacaacagtcgcgactataaacagactcgcgactatggcagggcgggcgaccgggccaggccgagtcagaaaggctttgatgactcaagcaag

SEQ ID NO: 47043 - DNA, 555 bp, Glycine max
  Peptide Sequence Number=SeqID_138728
atgtgccctcctccgtcaaaggtcaacactaaaggtgcaccgaagaaaccgattaaaagaagtcaaagatccacaaagcgtgatccgtcatactgggagtatgttgatgttttcgattgtgttcaaagcagcaactctccagtcaaacgtagtgcatcatgttctgaaccgcctcagccaacaaggatcatcccgatgttggatcaatttgcgccattcattcaaggtttcattcttgacgttgtggatgtgaaagcggacggtaactgtggatatcggtccattgccgctttattagagatgggatatgtcattgcatcacggtataacataatccttgtatcgttgtcccgacaacaaagcatgacattttttcctcttagaactcaaccaccacctgattcttttgggcaccgcatgatatgtgtcggtcacctgtttggaaatcattttgttcaggcaaagcagtcgacaactccatatattagtagaatgcaacaatacacaagcttgatgtcattcaaaagacactatgtcgacctaaatgaagactaa

SEQ ID NO: 47044 - DNA, 327 bp, Glycine max
  Peptide Sequence Number=SeqID_138729
atgcacctctcccttacccttaattggtcactctatttctccgtcattttcaaattccgcttgatgatgaatggtcaatggctgaagaaagatgcacttcctcctcaagatgagcgtactccttctcctcctcctcagcgagatgattcagccctcatgactgaagttctttccgaattacggggtcttcgtacttatgttggcgaacattttgattctctggatactcgctttgccggcatggatatccgtctcacacagcttgaaaaagatgtgggttatattcgtcagagcttcgaccttccaccaccacctccaccttcttag

SEQ ID NO: 47045 - DNA, 231 bp, Glycine max
  Peptide Sequence Number=SeqID_138730
atgaaggaaaacaacaaaggatccccagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 47046 - DNA, 186 bp, Glycine max
  Peptide Sequence Number=SeqID_138731
atggcttctaatctagctacgagtgcaaaggcgaggctcacgggtgcgctttccaaaggaggaaagatgcgcggagtcgccaccaacgaaggtattagcacctctcacgtcgacaaaagcggggatcttgctcctacgtaccctccatcgaagaggaaatcagacctacgtagttctttcttaagg

SEQ ID NO: 47047 - DNA, 884 bp, Glycine max
  Peptide Sequence Number=SeqID_138732
atggtgaaagttggaactcttacgtgcccgatcaacgtctcatttcgccaaaagttggcccagggctttcccggtatcaacagggacaccaggatttatttattctgcgaagtgatcttccgtcacaggtatttattcggcgcaaagtgccgtcgggtgctccagtggcttatgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatctgtgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 47048 - DNA, 444 bp, Glycine max
  Peptide Sequence Number=SeqID_138733
atgaccatgattacgccaagctcgaaattaaccctcactaaagggaacaaaagctgtccaaaccacagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 47049 - DNA, 194 bp, Glycine max
  Peptide Sequence Number=SeqID_138734
atgacttcctatggtggtgagcttgttcttgactcatcttctcctttaagtggtgtctccaattatctttcttgcttctccattccgttgccattgatcttcaagaagaaaatgactccattgttgaagaagatccaaggcctacaagctccacatggagctacatcatgtggtatcaagagcatatcatctag

SEQ ID NO: 47050 - DNA, 638 bp, Glycine max
  Peptide Sequence Number=SeqID_138735
atgccttatgtggaggccgcagaggagtcgttagaaaccgctttccagtctttcgaggtggtaagcatttcctcggtggattccctctctaggcaagcttgcatgtccgatgcagcagtaatgatggcccgagtgatgttggggagtggttacgagcccggaataggtttaggcaaggacaacggcggcataactagcctgagaaacgccaaaggaaatcgtgggaagtatgggttaggctataaacccactcaggcagatataaagagaagcattgcgaaaaggaaaagcgaaagtcaaggttcgcggttgagacaagaaggcgaaggaatcccaccctgtcacataagtaggagctttataagcgcgggtctaggggacgaaggtcaagttgttgcaatatacaaagatgatgttccgagtgcattgaatttggtacgaccgtgccctcctgatttccgactaggaaattggcaagtagaggagcgcccggacatttacgcaacaagcataatatccaacgatgagtccctcgaaggtactaatacctgggacccgcctatcgacttcaagcaagaaacgagtcaaacagaggatgaagaaaacaaggatgtgggacttcccccggagttagaaag

SEQ ID NO: 47051 - DNA, 229 bp, Glycine max
  Peptide Sequence Number=SeqID_138736
atggaaggagttcaacttatccctcacttccatattaagcccactaaggaacctagctatgcttgttctttcctcctccctaagtctagctctttaaaaagaggaaatgtgcctcttcctaagggcactcttaagatcattccaatactctactggaggatccccatgaatccttcgttccctaacaagggaagtccaccaatagagggcatacccttgaaagctaagg

SEQ ID NO: 47052 - DNA, 543 bp, Glycine max
  Peptide Sequence Number=SeqID_138737
atggccccaaggaatcttgcctcaaagagatccaggaaggataaagcggctgaaggaaccagttccgctcccgaatatgacagccaccgttttaggagcactgagcaccagcagcgcttcgaggccatcaagggatggtcatttctccgggagcgacgagtccagctcagggacgacgagtataccgacttccaggaggagatagttcgtcggcggtgggcatcactggttacccccatggccaagttcgacccagacatagtcctcgagttttatgccaatgcttggcctacagtggagggtgtacgagatatgcgatcctgggtgaggggtcagtggatcccattcgatgcggatgctctcagccagttcctgggatatcctttagtgctggaggagggccaggagtgcgagtatggccagaggaggaaccgggctgatgggtttgatgaggaggccatcgcccagctactgtgtataccggggcaggatttgcccggactgctgctgggagacgagtgtggatcatgcgcaccaacatga

SEQ ID NO: 47053 - DNA, 582 bp, Glycine max
  Peptide Sequence Number=SeqID_138738
atggcaggccctctcaatgagtcacatcctcttgcctcaaaaggactacacgtgaacccttcagggactacaagtcctcagccttcgagagggctgggccgccctcgcctttcagaggactacacgtctttgccttcagatgactacatgcctcactttcagaggctgacacgtcctcgcacttcagagagctacactgcccgaccttcaaaggactacacgtcctcgccttcagagggctacacgccctcgcctctagagggttgcacgtcctcaccttcaaaggactacacgtcctcaccttcagagggctacacatcctcgccttcagaggactacacgtcctcaccttcaaaagaatacacgtcctcgccttcagagggctacacgccctcgatatcagaggactacaagtcctcaccttcagagggctgcacgccctcaccttcagaggactacaattcttcgcctttagaggactacacatcctcacctttagagggttgcacgccctcgccttcagaggactgcacatcctcgccttcagagggctacatgcccttcgccttcagaggactacac

SEQ ID NO: 47054 - DNA, 315 bp, Glycine max
  Peptide Sequence Number=SeqID_138739
atgaggagcgccaaccgaaagcggaaagtctttcagttccttcgtgaggaatgcgctaggcgcgcaaagtcaaggcgatcacaaagggagtatctcacaaggcgactttggatgaagtaccgtcagaagataagacaagcgccagccttcagaggacatccgaaatggctcattgatacggaagattggctctccaagttgatcaaagttatcgatgaagagaatcttgaagctccggaggaagatgaagaagccgagccaaaattagagctagggaaggcaagactcgcaaaggagaagttgcaaatcagctga

SEQ ID NO: 47055 - DNA, 225 bp, Glycine max
  Peptide Sequence Number=SeqID_138740
atggagttgtgcacccataaaaggaagctcaaaggcaatgaaaggattagcatgggcagaaatgtgtcagcattgataggtaaatctgttcctcacattcctgagaaatgtaaggacccaggaagtccgtatacttctgacttgctttatgaggtacaggctgaggaaccttcttcttctcctaccctggttcctcccactgttcagccaccacccacaccatag

SEQ ID NO: 47056 - DNA, 234 bp, Glycine max
  Peptide Sequence Number=SeqID_138741
atgtgtgcacaagtttgttctaagtcgaaaagattagaaatggctccgaaaaagctttccgcgaacaggtctaggagagacgccgcggctgaagggtccagtgccacccccgagtttgatagccaccgtttccagagcgccgagcaccagcagcgctttgaggccatcaaaggatggtcgttccacagagagaggcgcatccagcttagggaggatgagtatacagatttttag

SEQ ID NO: 47057 - DNA, 174 bp, Glycine max
  Peptide Sequence Number=SeqID_138742
atgaatgatggttttgttggtcaaaggaggatgaaggatgattttgttggtcaaaagaggttgttgtatgaagatattggattattaaggtctatgttattgtacggtaactgttgtggaggcagtagttgtagttgtggacatgaaggttgtggagatgatgattgtggttga

SEQ ID NO: 47058 - DNA, 216 bp, Glycine max
  Peptide Sequence Number=SeqID_138743
atgtgggtgcaagccattggtctgtttgctcaagcgacctgtgctcctgagtttggacttccaagaccgttcaatcagagattactcgtcttgcgcattggtggggctgccgtaaaacaacaaattcatgatgcacacagggacaacccttcccttgtgttcaagaatcccctacaacaagagacccacggtctcttaatcccttttcaaaaataa

SEQ ID NO: 47059 - DNA, 393 bp, Glycine max
  Peptide Sequence Number=SeqID_138744
atgtacccaccacttgaactgatccacaagatatgtaccctctcttgttctcagtattacaacccaagtagatgtaccttttacttgtaccacaaaggatgtaccctccaaggagttaagacaaagaattctcaggcggttagtcccttgaatctttgtaaggggaaacaaaagatatctcaggcgaaaaacaaaattttgaagacaaagtttagaaagctttttggcaaagaaaagcaatgggcaatggttattttgatgatgccaaagaatcaagagttaagcaaagtttcaagcaaagattcaagaatcaagttccaagattcaagattcaagaataatcaagatcaagattcaggaatcaagagaagactcaatcaaaataagtattaa

SEQ ID NO: 47060 - DNA, 258 bp, Glycine max
  Peptide Sequence Number=SeqID_138745
atgtcacctgacttcacgagtcaggatgacaaaggtgcagaagacgatgtaagtctccgcgtgtcaacaggattaacagaaatcgtttgtgcggataaccacttgggtatctctgcatgtcatcggacttcacgggtcacgatagcaaaaggtggggcggtcgacaaaagcgaggctctttctcccacgtatcctcaatttgtgatgaggaactcagacctacgcagttcttgcaaaaatggtgtgagactaaaatag

SEQ ID NO: 47061 - DNA, 648 bp, Glycine max
  Peptide Sequence Number=SeqID_138746
atgtttggcttagtgggaacttgccagctaagccaattatgcagaagctacagttgtacaacttccactaagcaacttcacctgtcactaagcgaaagtgtgtattttgtgaagatggcctctaggaaacatataagtagtgattctaggccacaggatcagtatgataccaggagattccaatcaatggatgccaggaaccgatatatcgataacattttggaccgaaggatccttccggaaaggaatgttcaaatttatcattttgagttcgacgagtttaaaacagagttggagaggcgtaaccttcacaaatgcctcaccaaccttcaggaagggagcatagatgtggcagtggttaaagaattttatgccaatttctatagtccagaagatcaagctcccaagtgtgctagagtaagaggtcatttaatcaagatggatgcagacaacctaaatgagtttcttcaaactccagtgttattagaggtgggggaatctttacccacttattatagattttacagattaaggtctgatcccaaagagatggtggctagtctatgcattccgtgcaagggctttattttgaaagctgagggccatccatggaagctcctcaaaaaggattttactaccttggcttag

SEQ ID NO: 47062 - DNA, 225 bp, Glycine max
  Peptide Sequence Number=SeqID_138747
atgactcgaacgcaacatgtgcatatcgtgggggagccctggggcattccattgagcactgattttcaagtgcaagccattggtcagtttgctcaagcgacctgtgttcctgagtttggacttccaagaccgttcaatcagagattactcgtcttgcacgttggtggggttgccgtaaaacaacgagtaaagttcaaaacaaataagtttcaaaataaaaaataa

SEQ ID NO: 47063 - DNA, 1239 bp, Glycine max
  Peptide Sequence Number=SeqID_138748
atggcgagccaagagaagtggggcccgtttgcagatattttagctttgctgatttttggggttgtccttttcccgaacgtcgacggtttggtagacttagccgccaatgatgctttcctcgcatatcaccatagcaaggaaagtccagtggtggctatcttggcagatttgtttgacacctttgaccggaggtgtgagaaaaatagtgtgcggattgtctgttgtttacccgctctctgtgtgtggttgatttcacacctattccaacaagacacgagacacccgtgttcgcttcaaagctatcgctcatgcgccgaaaaaggaagagtcgattgggaccaacatttggctgggatagggggcaacgcgatcaattggtttccttgttggaaggaaggcaaggaaggagttcttttctcgtgtggggactaccctaatattccattgatagggactaggggggtaccccatgaggggagcgccaaccgaagaaagctctcgcctttccttgtgaggaatctagacgcacaaagtctcaaggcgatacaaagagtccacaaggcgtggagaagtccgttgaggaaagacaaggagcttaagggcatccgtaatggcatcatcggaggttatcatggatggctaagaattcacacgcgggggttagattggctctccaagttgaaagttatcgatgaggaggacttcgaagctccgaaggaagatgaagaagtccgagctctaaaattagagttagggaaggcaagactcgccaaggagaagttcaagtcagctgctacacatatccggaaggagtgcaccgagttacaagaggaaaacgcggccactgcaaaagcccttgaacaagaaaccaaaagggcccgcaaggaggaacatggccgagagaaattccgaggagcattgtggggtagcaacaatgagctcaagctccgaagagaggagagagatcggtcacgggtgcatggcatgatcttaaaagaagagttagttgcctgcgcgaggtccaaaagaagtttggctcaacacttggaagccacggagcaaagcatgctagctatcatagggcaatacaaggaagaattgaaccagtctatggcccatgaagaaaagctagtggaggattttgcacaagtgtacgccgaaaaagaagcaagagggagggtgattgatgcgttgcatcaagaagcgactatgtggatggatagattcgccttgacctga

SEQ ID NO: 47064 - DNA, 126 bp, Glycine max
  Peptide Sequence Number=SeqID_138749
atggaagtgcaatctttcaacaacaggttttctgccatgtattggaaacccaaagattctccaagtagattcacagggacatatgtatctgtcgggaagatagatgtaggtgttaaaacaataatg

SEQ ID NO: 47065 - DNA, 588 bp, Glycine max
  Peptide Sequence Number=SeqID_138750
atgattgcacaaatagagcttctgctaagctacagcaaccggttttataagcgacagtttattacccgaaaagcagtgaaccacggtatacttgaaaaatttgaagaagttcttgatcaatccttcaataattctagcctattggaacatggaattcccacagttcattccctagcagaaaaactaagtatttcccccagttacctgagcgatcttttacggtcgctaaccagacagaatacccaacaatatattcatcagaaactcagcaatcttgcaaaggaaaaactgtcaaccacccaattatcaatcagtgaaattgcttatgagcttggatttgagcatccgcagtcttttagtaagttttttaagaaaatggaaaaggaaatgaaagtatttgtaacaggagctacaggatttataggctctgcaacagtaaaagaattacaatccggcggacatcaggttataggattagcccgttctgaggaatccgcggaaaaactaaggaagtccggtgtagaagtatattacggagatctcagtcaaccagagacactaatagaagcagttgaaaaagctgatgca

SEQ ID NO: 47066 - DNA, 339 bp, Glycine max
  Peptide Sequence Number=SeqID_138751
atggatgattttactgaggatgaggatcaacagttctttgatcacaccaatcaccaaagcgatgaccaaactgatgacgagggtgttggcaaaccacgacacctccgtcacctccgttgcaatatcagcaacctaggtgtccaaacaatttactctgaccagagaagactaaacttcgtctacaagttacatgaaaatggttgtacatggagcttgggcgcatacaattcaaggaggcataacaaatggattgtcaagagtatcagaggtcatcacacatgtctcgtgccgatgctcagacaagatcatctccaactcgacaaacacgtcatagcatag

SEQ ID NO: 47067 - DNA, 123 bp, Glycine max
  Peptide Sequence Number=SeqID_138752
atgcgtttaccggggaaggagagtatgttgatgaaaatagaagaaatccactcaaagcgtatcaatctcgcacagtgcggggcgaaaaagtcgctagcgcacaagattttggttggcaattaa

SEQ ID NO: 47068 - DNA, 582 bp, Glycine max
  Peptide Sequence Number=SeqID_138753
atggccgcgcgtggaacgcctgcgcctgcccccgcacgaggtggaggacatcgccatcgcccggctgcgctgggggctgcactttggcgactgccgtgccgtgcgcgatgccatcgcccccttgctggccgatgcgcaactgcgcggacgccgccaccgcagcctcaagctgcaggtgctgtgcgcgctggccgaggcgggctgcgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 47069 - DNA, 1278 bp, Glycine max
  Peptide Sequence Number=SeqID_138754
cctcaaggaattgggacgattgatgggacctctccaaaggcaagccttccgcaaagtgtacaggaagattctagatttgaccgcagcggaggtatttacggaagctgtcgtatccctcgcccaatactgtgaccaggcgttgaggtgtttcacgtttggggacttccaaatggtaccaactattgaagagtttgaggaaatattaggatgccctcttggggggagaaaaccgtatcttttctccggctttcttccttccttgagcaagattgtagctgtggttggagattcggcaaaagagatggatcgcatgaagcaaactcggaacggcgtagtgggcctgcctcggaaatacttggaaggcaaggcaagggatatggcgagccaagagaagtggggcccgtttgcggatatattagctttgttgatttttggggttgtcctcttttcgaacgttgacggtttggtggacttagccgccattgatgctttcctcgcatatcaccatagcaaggagagtccagtggtggctatcttggcagatttgtttgacacctttgaccggagttatcgctcatgtgccgaaaagggaagagtcgattgggaccaacatttggctgggataggaggcaacgcaatcaattggtttcctcgttggatggaaggcaaggaaggagttcttttctcgtgtggggactaccctaatgttccattgataacgactaggggttgtattaattataatcccgcactcgccataagacagctagggtaccccatgaggggagcgccaacagaagaaagtctctcgcctttccttgtgagggatctaggcgcgcaaagtctcaaggtgatacaaagagtccacaaggcatggagaagttcgttgaggaaagacaaggagcttagaggcatccgaaatggcgtcatcggtggttatcatggatggctaagagtttacatgcgagggttagattggctctccaaattgaaagttatcaatgaggagaacttcaaagctctactcgccaaggagaagttcaaatcagccgctacacacatccggaaagagtataccgagttacaagaggaaaacgcggccactgcaagagcccttgaacaagaaaccaaaagggcccgcaaggaggaacatggccgaaataaattccgaggagcattgtggggtagcaacaatgagctcacactccgaagagaggaaagagaccgatcatgggtgcatggcatgatcttaaaagaagagttagccgcgtgcgcaag

SEQ ID NO: 47070 - DNA, 762 bp, Glycine max
  Peptide Sequence Number=SeqID_138755
gtggccgtcaatcaacagttggctttgcatagggttatccttttatcagaggtcggcgccgaggatcggcagcatggtcaacagcattaccgacagcgccaccacgttggtaatcggcacatcgcgcgggcgaccgagctggttcagcagccacagcggcagcgtgcgctcgtggccggcggtaaaggtggtcacgatgatttcatcgaacgacagcgcgaacgccagcatgcccccggccagcagcgccgagccgaggttcggcaagatcacgtaacggaaggtttgccagccgtcggcgccgagatccatcgacgcttcgatcaggctgtacgaggtgcggcggaaccgggcgatgacgttgttgaacacgatcaccacgcagaacgtcgcatggccgacgacgatggtcaggatgcccggctcgatgttcagcgccttgaacgccgccagcagcgccagaccggtgacgatccccggcagcgcgatcggcagcagcaacagcagcgaaatgctgtccttgccgaagaaatcgcgccgatacagcgccgccgccgccagggtgccgagcaccagcgcgatggcggtcgccaggcaggcgatctgcgccgacagcagcaccgcatcgaggatatcctgccgcccggcggcaacgttgaaccagtgcagcgtgaaccccttcggcgggaagctgaaagcggcatcctcggtgttgaaggcgtaaatggcgatgatcgccaacgggaaatgcaggaagattag

SEQ ID NO: 47071 - DNA, 231 bp, Glycine max
  Peptide Sequence Number=SeqID_138756
atggacaagcatatttgtagaagcaagcttcatgatgaatcaagattgattcaaagaagttttgatgataacaaaggtgatgacaaaaagctcaaagaatcaaagaatgagttcaagattgaatcaagaacacttcaaggttcaagaggaaatttgatttcaagaatcaagtttcaagaatcaagcttccaagaattaagatcaagattcaagaatcaagagaagacttaa

SEQ ID NO: 47072 - DNA, 126 bp, Glycine max
  Peptide Sequence Number=SeqID_138757
atgggggtgcaaatagcacccaggcccacttgggctctccagaatattcctccagaaggcggttgcttctggaggaagcaacctggctcgcctgggcgagctgagctcgcctgggggaggaagtga

SEQ ID NO: 47073 - DNA, 387 bp, Glycine max
  Peptide Sequence Number=SeqID_138758
atgaacttgggacatatcatctcaagtcagatttccttgattgcacaacatgactcctctagactgggtttccctacacttatcactactctgtgcaaggccagaggagtcacttctgactcattgacttttgagagcctcagtccagccattaatgtggcatatgtgaagaaaaattgctggaacctcgatgatcccactgttactttcagagggccacacaaggccaaggggaagaggtctgaggctccttcatcttctcatattcctcctattccagctccttccacctctacagctccatcagttccagctcctcctacaggaacatcctctatcacatcaaagacattattttctatgttgcaaagccttcataaaggctag

SEQ ID NO: 47074 - DNA, 549 bp, Glycine max
  Peptide Sequence Number=SeqID_138759
atggcttctatcacggaggccatgctaaagcttcaaaaaactatagaagataatgctacggtggtcgcttccaatacagctagggaagtggaaccggtgctacagcccgcaataaacttgggccgagacagaaacgcaacgggttttaatcggaggtacagtcctcaagcctacccttatggtttgcctctagacttcactcccggtaccgctctagacgatttgagccaagcccctaccttcgaggggcagctccctcctcatgccgactatcctctacaggaagatgatgaaggagatgcccattcaggccctctacttcccctccaagaaccgggcccccatgagttgccccaaccaaacatagtctgccacatcccgtctccatccgtacccattaaggaactcgttcccattgcaaaagacaagggaaagatcgatctacttgaagaaaggctgagagcggtagaaggcctcggcaactatccgttctcggatttagcggatcagtgtctagtacctgacatcatcattcctcccaagtttaaa

SEQ ID NO: 47075 - DNA, 557 bp, Glycine max
  Peptide Sequence Number=SeqID_138760
atggccttcaaacacaaggtccaaagtttgatagaagccggatggctgacgtttcaagaggaccggcccaacgtaaagacaaacccacttgccaatcatggagggggagctgttaatgccgtcgagtcgggtaggccgcgtaggtccaaacccccagaaggatgtatcgacccccagaaggattcctgtttgatgcatcccggcgcgccacatagcatggaagcatgtttagcagtaggagacctgttgcaacaaatgatagaccaaggccggctggaaatcggcgatgagggggggacgcagctccctaaacgccgcgacaccccttggtacacgcctccaagcgaaaggaaggaaggagccaccgacatcagctcgctatcagccaaagtaaccaatatcacggggctgagcagcatgacccgcagcggtcacgtattcgcaccccctgacctgccgacacagcccgcaaatgctaaagggatggcaaggatgaaggaaggacaaaatgtcaaagtgatcctcgctctggacgagatggctgtgactagagagag

SEQ ID NO: 47076 - DNA, 833 bp, Glycine max
  Peptide Sequence Number=SeqID_138761
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgttgttgcatgccgccggagagctgcgcggggtacttgtccagggcgtggccgaggccgactttgtgcagcagcgcggcagcctgttcgcgggcgtccttcctggctttaccgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 47077 - DNA, 132 bp, Glycine max
  Peptide Sequence Number=SeqID_138762
atggcagaaatcagccaaggggtatttcaattcactccaacaagaattaatgaaacattgggcttaatccggattttggttgtggacttgaagagggcaaataaagcagcgcttatcttagttaatttctaa

SEQ ID NO: 47078 - DNA, 277 bp, Glycine max
  Peptide Sequence Number=SeqID_138763
atggctatggttgaatatgcagccaagtttgaggagttggtgaagcaagctatgaattaccaaggtgttcgtcagtttccacttttggtgaacatgtgtcggatttgggatgaagactctcgagacaaagcagcatattataggagtacaggccaaatgaagaacaaaaagaatagacctcaacatcggggaaaaccgtactcgaccctttctaaggaatatggtaatcgctctaacaatcagaggactgttgctatagggttggttggtggtagtg

SEQ ID NO: 47079 - DNA, 507 bp, Glycine max
  Peptide Sequence Number=SeqID_138764
atgtcaggatttacacgcaattctcctcaaatttcagccagcccgcatcaattagaccttgcaccttacgcttcagagccctacaatgctcaatggaacgcctcagggcttctccgtgacaagcacacgttgcgttcgagtcgtattctcggagaaatggaggttgatgaaccttggctagggttatggctaccattgaattatcaagtagatatgggagcaagtcagcataggacactggaattgggggtgaaattctacaggctttctcgctgcaaaattcacttcttggtggtgtttttgtgcggtagacagacttttgtggtagatttagggatggcctttgtggataactgggtggtgggtaaggagaaagtttgttattggctgagtaaagatattgttgggttggtgggaaatttggccgtacaggaatggcagtcacagcatgggtttctccctcatcctcaccctctttatttgccccagttttctcagtcgtcctag

SEQ ID NO: 47080 - DNA, 708 bp, Glycine max
  Peptide Sequence Number=SeqID_138765
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcagttggaaacacagaaagtcttcattcaacatctgtggaattaaatggaattctggtggaagcaagtcttcagggaaagagattgaatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 47081 - DNA, 393 bp, Glycine max
  Peptide Sequence Number=SeqID_138766
atgggaacaaatcaaactggaaaaaggttctatcaagtcaagattaagggcctagatgtcaccatccttaaggagttggggcggttgatgggacctctccaaatgcaagccttccgcaaggcgtacagaaagattttagatttgaccatagccatagcagagatattcacggaagccgttgtatcactcacccaatactatgaccagcctttgagatgcttcacatttggagacttccaatcagtaccgactattgaagaatttgaggagattctaggatgtcctcttgggggaagaaaaccatatcttttctctgggtttcttccctccttgagcaagattgcaattgtgcaaagaaagcctggtggtagctatgttggcaaacttatttga

SEQ ID NO: 47082 - DNA, 318 bp, Glycine max
  Peptide Sequence Number=SeqID_138767
atggcctccaggaaacataagagcattggggcaaggccagctgctcagtatgatactagacggttccattcgcttgatgcgaggaaccgttatacagataatgccttgggaaggagcattttgccagagaagaaggttgagatataccacacggagtttgatgacttcaagacagagttggagaggtgtaatcttcacaaatgcctcaccaacttggctaatgggactattgatgttgctttgatgaaggaattttatgccaatctctacagctctgaggacccttcaccaaagcaagccagagttagaggccacctg

SEQ ID NO: 47083 - DNA, 324 bp, Glycine max
  Peptide Sequence Number=SeqID_138768
atggggtataaaaacaaaataggggagaagcttgccacccagctcgcccaggcgagtaaggttgcttcctccagaagcaacagccttctggaggaaggatctggaaggcccaactttcgaagaagttacggaaactcacggattgcgaaaaaacacatcttttcgttttccgccatattacggaatttcacggaccgcgcaagcctgcttccttttgattttcggcacgtctcggaacttcacatattgtgcaacaaagggtgccaagtacctcgaagcggtcaaacaaaggttgcatgccatcaaacaatggtccccggatga

SEQ ID NO: 47084 - DNA, 322 bp, Glycine max
  Peptide Sequence Number=SeqID_138769
atggataaggtagttggtggtcgcggtatggtgatatggtcggtggttgtggcggttgacagtgggtgtggtgatatggtcgccaacatgagggtacacattgcaagaactggatggtttgcagcagccttggtgccaacaccaattgcattcattttgctggccatatctggcagtggagcagcattacacataggcactgccttgatagggctaagttcaggctttgtgttttctgcagcagtatctattacttcagagctttttggcccaaacagtgttggtgtgaaccacaacatcctcatcactaacattcccttag

SEQ ID NO: 47085 - DNA, 273 bp, Glycine max
  Peptide Sequence Number=SeqID_138770
atgaataggtggatgactatgaagaacctcatgctagaggatacaggaacacaacgttctgataggattatatatgtgaggggtagagggtgtcacaatgctgagagaccagtggtgcatgttgatcctgctaccgagaaggccgacgatccccacaagaagaaattaagaacatatttggggattgtggcacgtgataaggtggacatcacctacgaaaactggaaggaggttcctactgctcagaatgaccttgtttgggaggatattcag

SEQ ID NO: 47086 - DNA, 267 bp, Glycine max
  Peptide Sequence Number=SeqID_138771
atggtgaaagttggaacctcttacgtgccgatcaagcgcctgctcttttcgccaaaagttggcccagggcttcctggcgcgtacaacgagagcaccagcaccggcacgcgcgtcccattcgcttcggtgcgcaactgttcgggaagacctgatcggtgcgggcctcttcgctattatgcgccaacgcggcgaaaggggatgtgctgcaagttgcgattaagttgggagaaggaagctgccaccgcggtggcggccgctctagaatag

SEQ ID NO: 47087 - DNA, 438 bp, Glycine max
  Peptide Sequence Number=SeqID_138772
atgggtaaagcggaggaggtacaagagaagatgaaggccgacatggaggccatgaaagagcaaatggccacgatgatggccatgatgagcatgaggaagataatggaagccaatgcagttgcagttgccgctaccaacactattgctaaggtgaacccgatgcccccatctggcctcaaccaaatgaatcatccaacctcagatatggtaggcaaagatttgggaagtacggacggccccatgatgtgcaaattcaaaacgagcacgccttcccgctatatggcttgcctcccaactatacaccacccgatgtggcgtacactcccaatgaggatgtcaataactccactcccatgctcattgagagctgacaacctcatcatatacatgtctctcaacccatgggggagacacatgaaataccccaccacaatctag

SEQ ID NO: 47088 - DNA, 110 bp, Glycine max
  Peptide Sequence Number=SeqID_138773
atggatgccttagagccctacactggggcaatgaggggcaccatgcataaacctcaagcaaacctaagggcagatttgaagttctcacccaataggttccttgctacaag

SEQ ID NO: 47089 - DNA, 666 bp, Glycine max
  Peptide Sequence Number=SeqID_138774
atggccaatcaaggagactgggtcccgtttatggatgtgttagctttgctaatttttggggccgtcctctttccaaacgtggatggtttgatagacctagcagcaatcgacgctttccttgcctaccaccatagcaaggaaagtccggtggtagctgtcttggcagatctattcgacacatttgaccgaagatacccaaacattccgttggtaggaacgaggggttgtattaactacaatcccgcgctcgctataagacaactagggtaccctatgaggggagcaccgacggaagaaagcatgtctcctttccttgtgagggatttcggcgcacaaaattccaagactatacaaagaatccataaggcgtgggaaaccccgttaaagaaagatcaagagcttagaggcattcgtaatggcatcattggtgggtaccacgaatggctgaaagttcatatacgaggtttagattggctcgccaagttaaaagtcgtcagcaaagagagttttgaagcattggaagaggacgaagaagtccaaatctctcaaaagcgatttaggaaaggcaaaatttgccaaggagaagttcaatttggccgttacacactttcggaaggattgtgccgggttacgggaagagaatgcaattaccgcaaaagcccttga

SEQ ID NO: 47090 - DNA, 306 bp, Glycine max
  Peptide Sequence Number=SeqID_138775
atgcccttgcggggtaggattgcatcaggatcgcacccgcaagacaaccagtggactcgaagaagtccaacagggtcttggagttgccaagctctaattatgggcctctgtcagttctacggagtgtctgtcgcccccagcaaggtcatcaggccccctactaatcgagctttcatcaagaagtactgcgtccccaggcaggcacagggcgaaacaccacaacagcctggggatggccggcagcgagcatcagacgcaccgccatcacctctagagttcaccttagctcatccacaaaaaggttag

SEQ ID NO: 47091 - DNA, 371 bp, Glycine max
  Peptide Sequence Number=SeqID_138776
ggacaccaggatttattatctgcgaagtgatctccgtcacaggtatttattcggcgcaaagtgcgtcggctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccaggtccaagttggttaaaggtatcagttgacctttgcgataggtggtttggagagtttaag

SEQ ID NO: 47092 - DNA, 448 bp, Glycine max
  Peptide Sequence Number=SeqID_138777
tcaaggtgcaccttttgagggcactattgttgatgactggaaatttgattattctagtcatgatgctcgccgtatggtctgcaatgaccaagctgaaatgacggcccacttggttcggtaccgaatgcttaaggcattacgggccaatgcacctctcccttacccacaattgataactttgtttctgcgtcattttcaaattccgcttgatgatgaaccatttgttcaagtcaagtgttcatttgcaataggtgctggtgcagtgacttcctttggataccgtaaggatcgaaatggtcaatggctgaagaaagacgcactccctccccaagatgagcgtactccttcacctcctcctcacatggatattcgcctcacacagcttgaagaggatgtgggttacatacgtcagagtttcgatcttccatcaccacctccaccttcttag

SEQ ID NO: 47093 - DNA, 440 bp, Glycine max
  Peptide Sequence Number=SeqID_138778
atggtggcccgggtgatgttggggaatggctacgagcccggaatgggtttaggcaagaacaacggcggcagaagcagcctggtaagcaccagaggaaatcgtgggaagtttggattaggctataaacccacgcaagcgaacataaggaaaagtgtcgcggaaaggaagagcggaagccaaggtctaggacacgaatgccaagtcgttgcaatatgcaaggatgattctacgagtgggtcagatttggtacgaccatgccctcctggtttccgactaggaaattggcgattggaggagcgcccggacatttatgggacaagcataatatccgacgacgagtccctcgaaggtactaatacctgggacccgactagcgatttcaagcaagaaatggatcagacggagagtgaagaggacgaggatgtgggacttcccccaga

SEQ ID NO: 47094 - DNA, 564 bp, Glycine max
  Peptide Sequence Number=SeqID_138779
atgcataaggcattacgatcatatgctccactcccatatccccatctgattactttgtttctacaacattttaatgtcccttttgactctgagccctttgtcaaagtcaagagatccttctctataggtgcaaatgtagtctcttccttcggttaccgcaaagagagggatggctcttgggtaaagaaggatgctctagtacaggtcgttgaagaccgctctccatcaccacattctcagagagatgactcttcatctcttatgcacaacattctagaaaggtttgatggacttcaaacctatgttgatgagaggattgtcatcatcaaaaagggggatattgtggaagcaatgccttccaagattattttgatgatgccaaagaatcaagagtcaagcaagttccaaagaatcaagagtcaagtaagtttcaagaatcaagatcaagattcaagattcaagaataatcaagattcaagtaaagaatcaagactcaagattcaagaatcaagagaagactcaatcaagataagtattaaaagagtttttcaaaacattgaatag

SEQ ID NO: 47095 - DNA, 486 bp, Glycine max
  Peptide Sequence Number=SeqID_138780
atggcgcctaccatgcaccctctggacccggataagtccaacagggccctgggagttcctgctttgatcacaggactctaccagtcgttcggagtccccgtcgcacctagcaaggtgattcggccgcccatcacccgagcttttattgagaagtattgcacgcagagacaggcccagggggatgctccgcaggccgcagacgcgccgtcacctcatcaggctagcccaactggatcatttgatatggagcagtatttacggcatttggttcgccacctgcagagccagggttttacttcttttccgtgccctactctggatcagttcagggcagaggtcgcatggcccggagattggcctgaggccctggcaggagaggcaccagcagaggcactagcagaggctcccgacgaggcagatgaggtccacgaggacgaggagatgaccgatttacttgatttcttaggagggagcggagccacgtga

SEQ ID NO: 47096 - DNA, 468 bp, Glycine max
  Peptide Sequence Number=SeqID_138781
atgaccatgattacgccaagctcgaaattaaccctcactaaagggaacaaaagctggtaccgggccccccctcgaggtcgacgagtcgggagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 47097 - DNA, 878 bp, Glycine max
  Peptide Sequence Number=SeqID_138782
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgaaaggccttgttggtcaagagttgagcagagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 47098 - DNA, 658 bp, Glycine max
  Peptide Sequence Number=SeqID_138783
gcagcagcttgcccggagctggaaggcggctggcgcgataaaaacgtgcgcatgctgtttatcgcttctacgctgatgtggacctgcaacacgatgtatatcatcgatatgccgttgtggatcagtagcgatcttggcctgccggatagtctggcggggatactgatgggcacggctgccggtcttgaaattccggcgatgatcctggccggctactacgttaagcgttggggtaaacgcaaaatgatggtggcggcagtcgccgccggcgtgctgttctatgtggggctgattatgttccatggccgcacggcgctgctggcgctgcagctattcaatgctattttcatcggtattatcgccgggatcggcatgttgtggttccaggatctgatgccggggcgcgccggggcggcgaccacgctgtttaccaatagtatctccaccggagttattctggccggagtgattcagggagcgctgtcgcaaagctatggtcacggtagtgtgtactggacaatcgcggcgatttctctgctgacgctgtttttgaccagccggtacgattcgcttgatgtcgccgataataaagatgtaggcaatcaccccgatcagcgcggtcacgccaacgtaaatgagggcgtaaaagaagttaccg

SEQ ID NO: 47099 - DNA, 369 bp, Glycine max
  Peptide Sequence Number=SeqID_138784
agggtacatctacttgggaattgttatactgagaacaagagagggtacatctcttgtggatcagttcaaggggaggatacatccacttggttattcaaagagaacaagggagggtacatcccttgtggatctttggcttgtaaaggattttacaaggatgaaagaaatctcaagaaccgcaggttgcttgggggactggatgtattccgaggccacttgatccaacaatcaaatccaatcagaccatataaagtaaggccttcatctattgtaccaccacctcctcccgctcaaatagagctatctaccatctccaactccacgccaccccatgattgttggcctccgttgacatctcccctacactag

SEQ ID NO: 47100 - DNA, 816 bp, Glycine max
  Peptide Sequence Number=SeqID_138785
atgacatctggtgttgaacttgctgaagcatgtattgcggaagcaacacaaggagaaaatgaaggaaacagaaaagggaagaaccaaaatggacacgattggtgccaaggccaatacatcaaagggactggatcaaattcatcatatgtcaatatagccatagccacaggtgcaacaaccttcgtaggttcaagacctagaagcaaaaatgctccgggaaataagactgatattgggtggaaacatggtacaaattttttagggaatggtaagaaagttaagtgtaactattgctcaaagaccaacaatggggaaatttttagattcaagcatcatcttgttgagattagatgggattttgaaccttgcccttggatgctgaaagaagttaaaatgcttatgatgaaagttgttgcaaaggtttctaatgcatcaaagaagaaaagaaaattgaatagtattcatgaagaaggtatacatactgagggggtggagacaaataccactcaaaatggaatagaagggaaaatgatgtttgctttcaaaggaagagaaaaagaaaaatttgttcaagctagtggtgagggagttcaagcaactttaaatcaattgtacaaaaaaggtgacaaagataaagttgatgaccaatgtgctcaattttggtacacaagtttcattccattcaatgttattaaaaatccaacttttacaaaattttgtgacatggttgcaagatatgaggttggctataaacctccatcttatcttgatatcaaagagaagcttttgaaaagagtagtgggaaaactgatttaa

SEQ ID NO: 47101 - DNA, 597 bp, Glycine max
  Peptide Sequence Number=SeqID_138786
atgaatcttgatcgacttcaccaaattgacatgcgaggcaatcattacatagactggatggaataccatgcagagtggattaatatctggaaaaacaaacacaatgatgttttagctaggcaatgggttgaaggaatagtgacacatacaccagcgtacatggaatggtataggaaaaacactactctattcttgtctgttgcacaacagctacatgatccacacacaaaaattaccataatgctgcagggacaatcaatgtattgtattccttcacttgttcatcaaacttttggtcaaactggcgagtcagtcaccgcaaccagccatgaatggatgagcgatttatttgacgttgatttcaatacaccaaatttaacgacatcatatttagcttctttacaacagttcaatgcaccacattcgtttggagaacaaggacaaagttcttctgctacaacaaccaacattggatatactaacatagaacaacaacatcatcatgacatgggagaaccagtcatacaggaaagaagaaatccacgacgtaatcggcgtccaccaccttgtgggactggtcatcgtcttggtcattga

SEQ ID NO: 47102 - DNA, 132 bp, Glycine max
  Peptide Sequence Number=SeqID_138787
atggcagcgcatttggaagaaagtcaaatgacatttgaagaaagattagaaaaacaaattgaagaaaaaatgacatatatttttaaaaatgcgtactgtttcggttggataatcttccccgacaatggataa

SEQ ID NO: 47103 - DNA, 264 bp, Glycine max
  Peptide Sequence Number=SeqID_138788
atgtttacggatcacttgatccgtaaagctcatagcgacttttcgacagcgatttctaccatcgccggcaacactggaccaaaaaaggtaaggttcacggtgcttacctcgacggtggacactaacctcctcaatgacagcgttgctcttcgcggaagcttcctcgcagcaccaccggaacaatggcggcaacctcctcaacgaagaagaagaagaggcacaaagaagggctctaacgtgaagaagaagacgcgcaaagaatga

SEQ ID NO: 47104 - DNA, 216 bp, Glycine max
  Peptide Sequence Number=SeqID_138789
atggagaagcagtggacaccaccatctgaaggttttctgaagtgtaatgttgataccggttttttccaacctcaaaactgcactggagtaggtatggtatgcgcttgtgtgatgctggaggaaggtgaggcgtggggcttgtttcaagctctagaattcgtggcttcttatggctataaatgggttgtgtttgagatagacagtaaatgtgtgtga

SEQ ID NO: 47105 - DNA, 1269 bp, Glycine max
  Peptide Sequence Number=SeqID_138790
atggttaggactcgaggattaggtcgtgccttaggccaggttactgacagaggtgtgggcagaggagatcgtgatgatttcgatgatgctccgcagcgtcgacggcctactgcatctacacggaggcaacgagtcgctgtgactgcggcgcacgatgagccagatgttcaggatgacccgatggaggcatcagctgctgtagaggacattgtggcaaacattcctgcggacacaggcgcagaggctattgaggatgagcatgagagatttccgggtggtccgagcgacccatctgtgttgacccagtatgcggatcacgttgcttgcagcgtatggacgggagaggagcgtcttgaattgaaactatcctctcatgggaggaaggtccacaatttaggcaggcctgtccctaccattgagggacttgttgctggtacaggactaagtcctctgatcgcgtgttcgcggtggcaccgggagacatctagtttccatctcccggtgggagagctcaccatcacattggacgacgtctcctcgcttcttcatcttcccgtgattggtgacttacacgtgtttgagcccttgcacgtggacgatgcggttcagatgctggtggacttattgatggtctctgcagagtttgcaaggacaggtcattggacagctgtggctcgcgcatatcttcttcatcttttgggttgcactctgtttgctaacaagagtgcaaccaatgtccatgttgtctacttggaggccgttcgtaacctcagtatgacggagaggtacgcctggggagtgactgctttggtgcatatgtacgaccagctgaacgattgctggatttacgagcactttccatcggtcgcggactccactgctgatcaggagtacgtcgaggattctccgcgtgcgtgtaggtggattgcgaccaagaagaccgtgaagaacattcgtatgccgacgtacagggagcgcctggatcgactccggattccggatatctgttggatcccttatggggagcaccgggaggtccgggacttccataccattcctactcctcctgtcgattcatgggtctcgtatgatgatatacacgacaggtggatgcactacgaggatcatatcattccagtaggtgagacggatatccctcacgtgtcagagccaggagcatcgtcgacatctgcggaggagcctagacatgcagtggttggagtgccatctgagtctaggggtggtcacgcctggctcatcgacacatga

SEQ ID NO: 47106 - DNA, 354 bp, Glycine max
  Peptide Sequence Number=SeqID_138791
atggagtttatttctatttcagaccatacttctctagttgtcaccactaagttggtagtgcctagaggtaattctccatttaaattcaacaatgctattgtggatcatccaaatttctcaagaattgttggagatggttggaagcaaaatattcatggctgtagcatgttcaaggtctgtaagaaattgaaagctcttaaagctccattgaagaatctttttaagcaggagttcaacaacatctccaaccgagtggagctagttgaggctgaatataacagtgtgcttaattctctaaagcaaaatcctcaggatccttcccttcttgctctgacaaaccgcattagagggtag

SEQ ID NO: 47107 - DNA, 1671 bp, Glycine max
  Peptide Sequence Number=SeqID_138792
atgggtgatccagctgatgaaaatcttgaaaggaaagagatggacgtgagaaatttgtcatcttcacatggccaagaaccatatgtccacaaggttggaattcctccaagacaaaaccttttcaaggaattccaatccactgtaaaagaaacacttttcgcggatgatcctctaaggtccttcaaggatcaatctaagtcccgaaagctcatcctcggaattgaagccattttccccatagttagctgggggagaacttataatctcacaaaatttagaggggatcttattgctggtctaactatcgcaagtctctgcattcctcaggacattggatatgcaaagcttgcaaatttagatccacagtatggattgtactccagctttattccaccactgatttatgctgtcatgggtagttctcgtgacattgcaataggaccggtggcagtggtttctctcttgttggggactttacttcagagcgagattgatcccattgcaaatccagtagactatcgacgacttgcatttactgccactttctttgctgggattactcaagcaacgctaggggttttaaggttaggatttttgattgatttcctatctcatgctgcaattgtcggttttatggggggagctgccatcacaattgcccttcaacagctcaagggcttccttgggattgcaaagttttcaaagaaaactgatgttatctctgtgatgcattcagtgctgtcatcagcccatcatggatggaattggcaaactatagtaattggagcttcctttctgggttttcttctgtttgctaagtatattggaaagaagaacccgaaattcttttgggtgccagcaattgccccgttggtatctgttgttctctctaccctttttgtattcttaacccgagcagacaagcatggtgttgcaattgtaaaacatttagagaaagggctcaatccttcatctgtcaaggaaatttattttactggtgactaccttgggaaaggtttcagaattggcatcgtggcaggcatgatagcattgactgaagccacagcaattggaagaacatttgcttctatgaaggattatcaactggatggaaacaaagaaatggtggcattaggagctatgaatgttgttggttcaatgacttcttgttatgtagcaactggttctttctctcgttcagcagtaaatttcatggctggctgtgaaaccgcagtatctaatattgtcatgtctgttgtggtgttcttaaccttacaattcctcacgcctcttttcaaatacactccaaatgccattcttgctacaatcatcatttctgctgtcatcaaccttgtggactataaggcagcaattttgatatggaagattgataaatttgactttgttgcttgcatgggagcattttttggggttgtttttgcctcggttgagataggacttttaattgcagtctctatctcctttgcaaagattctattacaagtcacaaggccacgaactgcaattctggggaaaatccctaggactactgtctacagaaacatccaacaataccctgaagccacaagggttcctggtgtacttattattagagttgattctgcaatatacttttccaactccaactatgttaaagaaagggatcactag

SEQ ID NO: 47108 - DNA, 864 bp, Glycine max
  Peptide Sequence Number=SeqID_138793
atgcccttacattacaataagactaatggtatgcaatttatgattgcagatttctttggtgcactcagggctagagtatatgatgatgaggtgaggaagtggatttctgttgttggtgttcacttcattgggaagaagcttgtgaacttgaatgatgaggcacttgatcttattcatgtcaggttcttccgcgagaaggataggaagcctgcggaagatggttccgcaggttcttctgcgagcagaaaatgtagcctgcggaagaaggttccgaaggttcttccgctggatcccgtggaagaacctgcagaagcttctttcgctggatcaagcggaagaaccttcttcaccttctttcgctggaacttgcggaagaaccatttcatctttcttccgcaagagcccgcggaagaacaccttcttccgctacaatacccaacgtccactttcacacgcacggaagaaggttcttctcgcggaagaaccttcgtcttcaacctcaagcaccaaacatcaccaatgtcgtctatcctacggccatttaagcgattcaaactgataggagacaaggacgaattgtggttccctatcatatcacagatgcactcaggatccattgacgcagcatattcaaatgcagaacaacataattcatctggttgtgattgctcattcgagaaaaaaaatggtgtacaatccactatttcctctgagaataatctacactctttagatattggtgaagaaggtgcaactctgaggggaccaattgtccttatagacattgaattggagatcaatgctagcagagcagaaagaataatgaagaattttgccatcattcttcaatcttcactcaattag

SEQ ID NO: 47109 - DNA, 300 bp, Glycine max
  Peptide Sequence Number=SeqID_138794
atgcaatcaacattatgttctgaatggaaaacctggaagcaggatgtaatgaaatggttttctgcaccaccttccttatcgagcagcaaagacacccagcaacagagttatgatgatttgtaccaagcaaaccttcaagaccaaactatagctcttgaggctgaccctgacttctttaagaaccaggacacgttgagcacaatagcagctcagtcttgcaaacatgaaggtgttagggaggtgtttgtgacaacttcacctagtaatttggccaataaatggaatgaaattgtagtttag

SEQ ID NO: 47110 - DNA, 1504 bp, Glycine max
  Peptide Sequence Number=SeqID_138795
atgacgagttgtgtcaacctcaaaatatggcttcttaactttgttatcttgtttagtatggtttccttgtcccatggaagactaaatgctcaatttcaagtgaaagcagttaatctaggtggttggctcgttactgaaggttggatgaaaccgtctctgttcgatggcattccaaataaagacttcttggatggaactggtcttcagttcaagtctgtgatgacagggaagtatctttgtgctgagtccggaggaggaacaatcctagttgcaaattgcacagatgcttcgggttgggaaacatttagattgtggaggataaacgaggatactttcagattgagggtgtttaacaaacagtttgttgggttagatgggattaacgttgttgctgtttccaatatttgcacttattctgagacatttcatatagttaaggaaagtgacaattcaagtcgaattcgaatcaaagcttctaatggatacttcttgcaggctaagacccaggagctggtgactgcagatgtttcagaggtgagagaatgggaagatgatgacccaaccatttttgtgatgacaatagctgcaaggttgcaaggggaattccaagtcacaaacggttatgggcccacaaaagctccccaagttatgaaggaacattggagtacttttattgtggaaaatgattttaaattcatagccagtaatggattaaacgctgccagaattccagtaggctggtggatagcaagtgatccaaatccaccctggccatatgtgggaggttccttgcatgcactagacaatgccttcttgtgggcacagaaatatggattgaaaatcatcattgatcttcacgcagcacccggttcacaaaatggctttcagcatggtggttcaagagatggttctcaagaatggggaaaaacaaacaaaaacattctccaaacagttcgtgttatagaattcctaactgcaaggtatgcgaagaggccaagcttttatgcagttgagctcttgaacgagcctctctcgcctggtgtgacactagagatgttgaacaagtattacaaggctggctacgatgctgtgagaagacactcccccacagcttttgtggtgttgtcaaataggataggaccctcaaagcccaaggaactctttcctcttgccaatggccttatgcgatctgtgattgatgttcactactacaacatctttgatgatgtatttgaaaacatgtctgcccaacaaaacattgatttcatctacaccaaccgatcatcacagttgaataatattacaacctcaaacggaaatggtcctcttacttttgttggtgaatgggttgctgattggcgggttaagaatgctaccaaagaggacttccaaagatttgctaaggcccaattagatgtttttgggcgagctacatttgggtgggcttattgggctctcaaaaatgccaacaagtattggaatttggagtggatgatcgagaatg

SEQ ID NO: 47111 - DNA, 1557 bp, Glycine max
  Peptide Sequence Number=SeqID_138796
atgatgaccagttatgtcaacctcaaaatatggcttcttaactttgttaccttgtttagtattctttctttgtcccatggaagaagagcaaatgcaaattttcgagtgagagcagttaatctaggtggttggttggttactgaaggttggatgaaaccttctctcttcgatggcattccaaataaagacttcttggatggaactggtcttcagttcaagtccgtgacaacacgaaaatatctttgtgctgagtctggtggaggaaccatcatagttgcaaatcgcacctctgcttcgggttgggaaacatttgcattgtggaggctaaatgaggacactttcagattcagggtgttcaacaaacagtttgtggggttggatgggattaacgtcgttgctgtttccaatatttccactgattctttaacatttcatgtcgtaaaagaaagtgataattctaaccgtgttcgaatcaaagcttccaatggatacttcctgcaggccaagacagaggatttggtcactgctgatggatcagaggtcaacggatggggagatgatgatccatctgtttttgtaatgacaattggtaaaaggatgcaaggagaataccaagtaacaagtggttatggtcccacaaaagctcaccaagttatgaagttgctttgtttcttacatttatgcacgcatgaaaaggaacattggaaaacttttatagttgaagatgatttcaagttcatagcaagtaatggactgaatgctgttagaattccaatcggctggtggatagcaagtgatccaactccgcccccaccatatgttggaggttccttgaatgcattagacaaagcctttttgtgggcacagaaatatggattgaaaatcatccttgatcttcatgctgcacccggttctcaaaatggttttgagcacagctcttcaagagatggttcacaagaatggggaaaaacagatgaaaccattcaacaaacagttcatgttatagacttcctaactgcaaggtacgcaaaatgccaaagcctttatgctgttgagctaataaatgagcctctctcacctggtgtgacactagaggccttgaacaagtactataaggctggttatgaagcagtgcgcaagcactcttccacagcttatgtggtgttatcaaataggataggaccctcaaatcctagggaactcttccctcttgcaaatggccttatgcgatctgtgattgatgttcactactacaacctctttcaagatgtatttaatgacatgactgtccaacagaacattgatttcatctacaacaatcgctcatcacagttgagttttgttacaacctccaatggccctcttacttttgttggcgaatgggttgctgaatggcaagtcaacggagctacaaaagaagattatcaaaggttcgccaaggctcaattagacgtttatgggcgagcaacatttgggtgggcttattgggctttcaaaaacgtcaacaatcactggagtttggagtggatggtcaagaatggttatatcaaactgtag

SEQ ID NO: 47112 - DNA, 1324 bp, Glycine max
  Peptide Sequence Number=SeqID_138797
atggcaattaaacgacccatggaaattgtgcccccagcttctttcatctatgatctctctcaacgcaaaattataggaggagccctggagggagaagataatcgtgatttagatgaagctctccaacgacgaaggcccacaacatccgcacataggcaacgggaagctgatgtcgcagctgctgaggatgttcatcacatggatgacaaagctgaagaggaacatcctgaattgaagctaaccttccatggaaggaaggttcagaaatttgggaggtctgttgttgagattaaagggttagttgctgccacaagattaagtcctctgagtgcatgttcattggacactggtgatcaaggacttatatcgacttttgcagagaggtggtataaggaaactagcaatttctatcttctagtaggagaggtccccatcaccctcgatgatgtggcctctttgcttcattttcccatcacaggcgccttccatagtttcgagactctttatgtcaatgaagcggtgttgatgttagtgaaattacttgaagtcagtgcagatgaagccagagctaagatagtacagtgtcatggggcatatgtacgactatcatggcgacgagacatttattgtagcaaatgtgatgttgcacactggactgtagtagctcgagcttatctactacatttgctaggttgcattctttttgctaacaagagtgcaacacacgtgcatctggctattactgttgaaaactatcatgaaaggaatccatgtgcctaccgctggacctctacgaaggcattaccagtgtcgatgtatcgaaagcgtctagatcaactgacgactagtgatgttggttggatgccttacggtgaccatcgtgcaacgattcctccacactctttgggttcaagattatgcttagaagatattgatgacagatggatgcacttctccgactatcttgcactggtgggccagatttttcttatgcctagacaatgcacaccatactatatgaagtggttctacatgatttcgcatccattcatgaggccggtacaactcggggatccagtcagatatccacctatcgtgcaagatgacacatatgtcgaattagatatgcctcagtacctggtggcggcggcagctatggaggaagcacctgtaaatgcatcttctcatgcgaagcaacctagacatgcagtggatgtttgtcaagcaatatctgaaaggttggagcggttgctcaacctaaggatagcgactgaaagcacaaaaacatacgatgtcatgcaagactacctaaggatcgctagag

SEQ ID NO: 47113 - DNA, 480 bp, Glycine max
  Peptide Sequence Number=SeqID_138798
accttcattcttctcagctcttcattcctgcgtcagattctgctctgtttttctccaccttcttcttcttcatcttcccaccccatgcctactgtatcctgcacctctaacgttgcttaccaaaacgtaaatgcacacccttctttaacagcgtcgcggctccaagatggaaagatcttggtccttgattccattgccttttttgcctcgggttttgctgcttgtagctccttcaaggacgagggtgcttctgctgcaaatgtgtctttttggtctgttggagtgagtgagaacaaaaatgatgactatgattgtgaaagtgagggtccatatggcactaggagtagtgctgcgttaattgtaacatcaagtgaggaagtaagtttctttgaggcatatcttgacgagggcatgtggaaggagcatgttattgatttccatattcagaaattgaagaagttgacaaaagggcatacatga

SEQ ID NO: 47114 - DNA, 274 bp, Glycine max
  Peptide Sequence Number=SeqID_138799
atgactgattatgtcttacacggtctcgacgacggctatagagcaatcattaatgtcgtgaatgcaagggacaccccaatcaattttgatgacctccatgaacggcttctgattcaggaactttcaattggtgctgcccaaagacaaactcctgccccgctgacagccttgaatgctcaggctcgacccaattccaatgacaaatctcggcatggacaaaaccctgcacaatcaactcaacgcactggcactcgcaaaccttttctcggccgct

SEQ ID NO: 47115 - DNA, 162 bp, Glycine max
  Peptide Sequence Number=SeqID_138800
atgaatgaagaacagttgatgtataataatatcatgtctgaagaagttgatatgaatgttgaaaataaggaagatgttggtgtgaaagtaaaacacgttgattgctctgatgtctttaatacttctcagttctttgctactcgtgatgaagttttacattag

SEQ ID NO: 47116 - DNA, 807 bp, Glycine max
  Peptide Sequence Number=SeqID_138801
atggaactgattgagaacatggcggccaatgaccatgttgttttcggtgacagaacgcacatccccacaaaaagaagtctgttggagctttcctcacaagatgcattgttggtccaaaacaagctattagctaaacaacttgattcactcaaaaaaacattaagcaaactgccaacacagctacaagcaactcaaccgactcactcagcagttatgcaagttgggggttgtagtatctatggatgggctcacgaatctggttgttgtatggcccaagatgatgcagctaaagaagttaattacatggcaaaccagaacagacaaggatttcacataggtggtttttcagggtaccagcaaggaggaaactttaatcagaaccaggggcaggggtggagatcacatccaggcaatcagttcaacacggaccgaggaagtggcgtctcctctccctcttctttctccattccgctgccattcatcttccaagaagcaaaggaatccattgatgaagaagatcctaggcctacaagctccaatggagcttgcatcagaaggtcttctaatctacctcctaaccaagggcccaagctatatgaacgaaccaccaagctggagggaaccttgactcagtttatacaggtctcaatgtccaatcacaagagtactgagttagcaattaagagcctggaaatccaagtggggcagctggccaagcaaatagcagaaaattccttagggagttttggagcaaatactgaaaaaaatcccaaggaggaatacaaagctatagtcactagaagctaa

SEQ ID NO: 47117 - DNA, 501 bp, Glycine max
  Peptide Sequence Number=SeqID_138802
atgttgcaccaaaaattctatttgaagacttatcaaattttgccacttgtttttgttgtttttcaggttgtgcctacagtatacactgatgtgagtgggcatactatccagtcaaaccagttctctgttacagaacacttcaggactggagacatgggccgtctgcagtcccttcccggagttttctttttctatgacctctctccaattaaggttacttttacggaagaaaatgtctcattcttacattttcttactaatgtttgtgccatagttggaggtagatatggatcttccaccataacttttcactcttgcataatttggcatgaatatcatttcatttgtgtgaatcctgaccgagtcatacttgatgtctattgcatacagtccaacctcaaccttatctctcaaagtgcgatgtgtcctattaacttcataatcgtctctgccacccttcagcccagatatttcatcaaagattctaagtttctaacatag

SEQ ID NO: 47118 - DNA, 981 bp, Glycine max
  Peptide Sequence Number=SeqID_138803
atggagagcataataagcaagctccgcaacctagacgcctaccctaaaatcaacgaggatttctacagccgcacgctctccggcggtgtcatcactctcgcttcctccattctcatgctcttgctcttctactccgagctccgtacgacacctttctctcgtcgttttcattcttttaaaacttctaatcgaaactcattgtcgtttttgccactgcctccagggttgtatcttcacgctgtcaccgagaccaagcttgtcgtcgacacttccagagccgaaacgctgcgtatcaattttgatgttacgtttcctgcgcttccatgttccatactcagtcttgatgccatggacatcagcggagagcagcgtctagatgttaaacacgatataatcaagaagagattagactctcgtggcaatgtgatagaaacaaggcaagaaggaattggtgctcccaagattgaaaagccattgcagaggcatggaggcaggctcgagcacaatgagacttattgtggttcctgttatggttctgaagtgtcagatgatgattgttgtaattcctgtgaggatgttcgtgaagcataccgtaagaaaggttgggcactttcaaatcctgatttaattgaccaggattgcagctgggttaaccttgctttagatgggttgttcacctcagttggagatgggtctgttcaccttgttggaactgggttcaccaagtctgcatattggcttcattgtaggcttgtaacaatgacttcattagagcagagttcaccactttgttgcagctgggttgagtcattgcaggcttgcatcttcatttgccacatccattgtaaatgggttcagtccatgatgttggatgcagctctggagttaagtttgtgtcactatgaggttgaagccatacattcaaatttcatgatgctgctttttgggggttctaaaagcagtaaaacagtgttgttttga

SEQ ID NO: 47119 - DNA, 315 bp, Glycine max
  Peptide Sequence Number=SeqID_138804
atggagctcaccggcgagatgaacgacaaagctacgggcaaaaacaagagaaaaaagaagaaaaaaagagagaaagatgtagaagaagaagaaaggaaggagaagaagaacgtgagagagaatgagggagcgaggacgttgagtcctatgaatcataaagacgaggacattgagtcctatgaaaacataaagcaaaggacgttgagtcttgtgaaacataaaggtgaggatgttgagtcctatgaaaacataaagcaaaggacgttgagtcctatgaaacataaaggcgaggaccttgagtcatatgaaacataa

SEQ ID NO: 47120 - DNA, 306 bp, Glycine max
  Peptide Sequence Number=SeqID_138805
atgtcagaattgtgcttggtactcgacgtggttattcctccaaagttcaaggtgccagactttgataaatacaaggggaccacttgcccaaagaatcacctgaagatgtatgatctagtgtttgctagcgagagaacagaagcaggtccgaggaaaggaaaatttaattatgttgcttctgcaaatcttggtagtgggggacccaagaggaagaaggtgggaaaaccttatgttgtggctgcacttcccgcatggccaaactttccactagccgcttataatcccatgtaccaatatcctccctaa

SEQ ID NO: 47121 - DNA, 1119 bp, Glycine max
  Peptide Sequence Number=SeqID_138806
atgacgaaccgtaatgtgaataacacccttgtggagttggcaatgtcgatttcaaacacaagtgctctacctagagctacggtgcctggaataatggccttgcttggtggggttttgggcctaccccagaagaagctcttaatgaaaactttggaagatggaagtgttaataaaggagggaccaaagttattaacacatggattgattcaatgagagcctcttctcccacacgagtcaaatccacacaaaaccaagacccaacaagtccttggacactttaccacccttcggcactgagcatgtttgatcagattgtatgtgagtccaaaggaaagcagattgtgacttttcttgactatgatggaactctctccccaattgttgcagatccagataaagcatacatgagtaaaaagatgaggaccacattgaaggacttagcaaggcatttccccactgccatcgtgagtggaaggtgcctggacaaggtgtataactttgtaagattggcagaactgtactatgctgggagccatggaatggacatcaagggaccaacaaataagcgaagtactaagaaggaaaatgaacaagtgctcttccaacccgctagtgaattcttgcccatgatcaatgaggtgtacaacatcttggtggaaaaaacaaagtctgtccctggggctaaggtagaaaataacaagttttgcttgtccgtgcactttcgctgtgttgacgaaaagagttgggtgtcattggctgaacaagtgagcttcgtgctcaacgagtacccaaaacttaagctaactcaagggagaaaagtgcttgagattcgaccaaccataaaatgggacaagggcaaggctcttgaattcttgctagagtcactgggatatgctaattctgataatgtatttccaatctatattggggatgatcgaactgatgaagatgcttttaaggttttacggaggaggggtcatggggttgggattctagtttctaaaattccaaaagaaactgatgcttcctacactttgcaagatccaacagaggttgggcagtttttgaggcatttggtggagtggaaaagaacgagttcccaataccacaagttgtag

SEQ ID NO: 47122 - DNA, 1074 bp, Glycine max
  Peptide Sequence Number=SeqID_138807
atgggtatatatgacccattccatcaagtgaacatgtggggggacagctttaaaattgatggaagcttgaactcaattgctccccaaatgttaatgattaagcctagcatgcagaacaagtctgaatgtactcctcacgaatcaagggaaccttctggagatgatcaagagactaatgaaaaagctgatactaaggcactaagacgtcaagctcaaaatcgcgaggctgctcggaaatgtcggctgcggaagaaggcttatgttcaacaattagaaacaagccgtgtgaagctcatgcaattggagttggagattgagaaagcaagaaagcagcagggtatgtacatacgtagtgcactagatgtcagctatatgggatcatccggaacaattaacccagggataactttgtttgaacttgaatatgcacaatggattgaagagcaagatagacagaatcaagaactgagaaatacattacaaactcaagcatctgaaatgcagcttcatctacttgttgagagttgcttgagccactactcaaatcttttcagaatgaaagcagaagctgcaaaggctgatgtcttctatttaatctctggtgcatggaaagcatcagtggaacgcctttttctttggattggaggatcccgtccatcacaacttctaaatatcattgcaccacagcttgagcctttgactgatcaacaaattgtgagcattaacaacctccggctttcatctcagcaagctgaagatgctctttcactaggattggacaaactccagcagagtctggtccacaacataccatcagatccattggctgtaggacactacgggtttgagatagctgctgccatggaaaaaggtgaagcactagaacgttttgtaaaccaggcagatcaccttaggcaacaaactctgattcacatgtctcggatcctgacaactgctcaagctgctaaaggcttgctggctatgggagaatactttcatcgtcttcgcacccttagttctttatggactgctcgttcatgtgatccttcctttcccactcaactctcaaactga

SEQ ID NO: 47123 - DNA, 315 bp, Glycine max
  Peptide Sequence Number=SeqID_138808
atgtcgacgaaaaagagcggcgtgggcatgaggattgtcgatgggaaaggtgtgaacgacgaagaaaagatcaaaccatcgcgagctgacgaaagagatgacttagctgtagtagatcttctaagggagctcaaggagacatattgtagcggtttcagcgactttgaccaggtcgaaagcatgctcgatttgaaaacagacttgacccatagatcggtatgtccgagccggcttttaaacctatgcgtgcgacattggggagaaaaggatctaaatgacgacttagaggataagaataacaatgaagaggaatag

SEQ ID NO: 47124 - DNA, 72 bp, Glycine max
  Peptide Sequence Number=SeqID_138809
atggaggcgattctgaagcagttgtctgaaaagagaaggaggaataggattaacgagaaaatgaaagcctag

SEQ ID NO: 47125 - DNA, 492 bp, Glycine max
  Peptide Sequence Number=SeqID_138810
atggtgtttttgtggacaggtggcagtactggtcagttagggttaaaacagagtagtagcgtggtgagtgtgaatcagttctgtgaggatttgttgcacatttgggagaaagggtgggagcgagaaactcagggatacagaaagaggttttggggcacttttctgagagcagtagggcataacagcaacacacgcatcatgattcatgaggctgcattcaagaagatgcactgggggagtcaacgatcaagtcctggctcaacgccgtcaagactgtcattggcactctgtttcatggcgagagaacgttgtgactacttctccggttcgccggagaggaagatcgcggagtcctatttctctatgatttgcagagaaggtctgcgactccaacccagggttgatcctcgaggaggatggttgacgaagcatgaattgaaggtgaaagagagtgtttcgaagtacggcgcatgggtcggaaacaacttttaa

SEQ ID NO: 47126 - DNA, 2436 bp, Glycine max
  Peptide Sequence Number=SeqID_138811
atgcagaagaagctaggattcccaatctccaagagcctcgaccagttcaaatcactatacggttcaatttcggcaacaccgaagccattatcttcgcgtccttccgcggattccgtttcatcggggagtttcgcgaacctcaagctcaccgcagagaaattggtgaaagagcaagcttcggtgaagactgatcttgaaaatgcgaatgctaagctcaagaagtcgcaggagtatgtccatgcattagaagaaaagttgcagaatgcgttgaacgaaaatgctaagctcaaggtcaagcagaaggaagatgagaaaatgtggaagggattggagtctaagttttcttctactaagaccttatgtgatcaacttactgagacgttgcagcagttggctggtttggttcaggacgccgaaaaagataaggaaacattggaatataaactgtcagcaagttcagaagctcttgatagcttgaataaacagatggatggtttgtctttgaagattgattctgcacaggaagcaattagatcccgtgataatgagctagagaagctcaaatttggtacagaagaacgggagaaatttcacagagatgaacagtgcagagttgccaatgttatacaagagaaggatactatgataaggaatttagaagaaatgttaacatctagtagattggctacagagaatttgaattcaaagttggaagaggttcacctacagttaaaagttaaagaagatgaaattatgcatcacttaaccagtcaagagaaattggagaaagaaaataatgatcttcaattgtgcaatgctgggcttgcagaaaagcttgacatgtcacttcaggaaatcaaaaaccttgaagaatcacttcagtcattggctgcacatttgtcaaatttagacaaagaaagcctgaatcttttgaccaagtttgatgaaatgaatttgctctatgcttcttgtttccagttggttcagcaggagagacaaactttctcaaagcatgctcaataccagtatagtgagcttaataataaatttgttgtcttggaattagaaaagaatgcaactcaaatgaaaaatcatgagttaagcaaaactgtggatgaacttcagaaagttcatgaatctactctagcccagcttacggagggctctcgattagctgctgagaaaattcgaagtttggagtcagaagcggaaactttaatctcaaaaaagaaagatgcagaggtattaattttcaaattagaagagaaagctgaatttctgttagaaagttctagatcatcagagaaccaagtgcaaggtttactgctgaaggtttcagccttagagactgaaagcaaagaaaatacagaaagactgcacgcagaaatatcgaagaaatcagaggaaatagatactttgcaaaacgagagaatgaaactagagcagcatgctgattcccttgataaagaagtcatccagcttcagaatgccttggaggaaaaagaaaagtgtattttacattataaggaacaggaaaagaatctggaagatcagatcacagagaatctatcattattgactgctgctgaaagcaaactttcagaggctaaaaagcaatatgatcaaatggtagagaataaacagttagaactatcaaggcatttgaaagaaatatctcagagaaatgatcaggctattaatgatattaagaggaagtatgagttggagaagatggaaattgtgaacaaggaaaaagaaaaggctgacaaagccattgcagaaattgagggaaagtgtggccaaaaaattgaagaatgcaaagaagaacaaaggcagcagttgatgcgcattcaagatgaacacacgttgctcgagcatgacaagaggcaagcaagcctcatagctgaacacaacgaacagctaaagcgtacccaactgcaagctgaaaatgaattgagagagaaaacaatgtttatgaggaatgatcatgaagctcagattaaagcattgaggtgtgaacttgaagatgagtgtcggaagctggaagaggagttgcatcttcaaaaatccaaagaagacaggcaaagggctttgttgcagttgcagtggaaagtgatgagtgacaagcccaaagaggaccaagaagtgaattcaaaacaggattactccatttcatccattaagagaagaagttcttttggtggcaaaagaaatcagcatgacctggactctccttacattgatgcaacacaaacaccagtaccaaagttgttgaaaaaaatggagaacgttaaaacaggaagtgcagtgagcattcctaagcatcataggaagagcatcaaaggaggaggccatcctcatcctttaaacattggtgatttgttttcagaagggtctcttaatccatatgcagaggatccctatgcatttgattag

SEQ ID NO: 47127 - DNA, 312 bp, Glycine max
  Peptide Sequence Number=SeqID_138812
atgacgtctgattcactatcagttaatgttgattcttcaattaagtctgaattctccactgatgaaggacacaaaactatccatgagactaaacactttccatctaacatccaaaaggctattgctgaggttgttagtacatacattcttatatttgcaggatgtggagcagctcttgtaaacgagaagtttccacttacaatagtaggcatagcaattgtttcgggtctagctctcacggtggctacatattctattggctatgtctttggtcccaattgctttggctgctgtcagaaaagttcaatttaa

SEQ ID NO: 47128 - DNA, 87 bp, Glycine max
  Peptide Sequence Number=SeqID_138813
atggggcaatttcatcaagttcttgacccagttcttgacggtggtgactctgttgctaccatcgcggagctcgctttccgacaatga

SEQ ID NO: 47129 - DNA, 1347 bp, Glycine max
  Peptide Sequence Number=SeqID_138814
atggcgagaaaaactagtaactgtgccatatgcgagaattctaatcaagcttccatttgttccatctgtgtcaactacaggttgaatgagtataatacttcattaaagttactgaaagaccgtcgagattcgttgtactcaaaattgagcgaagttcttgtccgcaagggaaagggagatgatcaagcaaattggagagtgcttcaacatgaaaagcttgcaaggttgaaggagaagcttcgtcagggtaaagaacaagttactcaaggaagagctaagatagagactaagtctgccgatctgaaacttaaatatgggttgcttgaatctgccctttctacgctggaaaagaatcgagtggaacaattggagaaattctatcctaatcttatttgcacccagagcttagggcatgtggctattacctctgagcgtcttcataaacagtccgtggtcataaaacagatatgcaagttgttcccacaacgccggggtgcatggatggtggcggtaatggcagtagggtgcatggatggtggcggtaatagcagtaggatcatgaaatcagttgcatcattgatcttctctctctctgctggtttcgaaccgaagactcgttgcttgggaaatgcattccaaaccatcaaatcgttcgggaaaccggcttgcatcattgatcttcatgtgctgggagatccaaaactcttacaggtggtcatagagggagagagaggggatggctgttgtggtcaatttgatcaaatttgcaatgcgcgattaccccgagctcttgatccccgctctgttccatcagaagagctttccacttctttgggggttcttgctctcggatatggcaacgagattcttattgggatgcacgtccttcctcaaggagaaaactcatggtctgagagaagctcaagcaattttggagttgcttcgatggaatctgagaggaggcatcgcctagattcatctgggagtagtagctttaattattctttagcttcttcacattctgttcaaacacacaaagatttgcagaaaggaatttcacttttaaagaaaagcgtagcctgcatcacagcttactgttacaactccctatgtttggatgtcccttctgaggcatctacatttgaggcttttgcaaagttattggcaacactgtcatcatccaaggaagacatgcaagcaagttcaacaattgaacaagtctgtttggaatatgaattctgctatttcatcaactactttgctggaaagtgcgcattctgtgcccacaacggtaaaggttctcttgtcacttctaatttggaagaaaatgctggcagtgttaattga

SEQ ID NO: 47130 - DNA, 897 bp, Glycine max
  Peptide Sequence Number=SeqID_138815
atggttgcgactcgcgcatctcttcttcaccttctgggttgcactctgtttgctaacaagagtgcaaccaatgtccatgttttctacttggaggcccttcgtgacctcagtatgacgaagaggtacgcttggggagtggctgctttggtgcatatgtacgaccagctgaacgatgcatctatgagccacagccgacagtgctggatttacgagcactttccgtcggtcgtggactccactgctgaacaggagtacgacgaggattctccgtgtgcgtgtaggtggattgcaaccaagaagaccctgaagagcattcgtacgccggcgtacagggagcgcctggatcgactccagattttggatgtttgttggatcccttatggggaccaccgggaggtccgggactttcacgtcagatcatgttattccggtttcttgcgctgggggcctgttgctgtttattaccgaccggagagggtcgtgcggcagtttggctacacgcagaccattccttctcctcctatcgattcatgggtctcgtatgatgatatacacgacaggtggatgcactacgaggatcatattgttccagcaggtgaggtatgcgttgtgccaggccagtgttctagtgactacatggactggttcttccgcatctcccatcttttcattacactaggccacgcattagatcctctgcctcattgtcacgccctgcagccccaagtcatccctcaggccccgcagacggatatccctcacgtgccagagccaggagcattgtcgacatctgcggaggagcctagacatgcagtggaagtttgtgatgacattgctgagaggttggagtgccatctgagtccaggggtggtcacgcctggctcatcgacacatgag

SEQ ID NO: 47131 - DNA, 342 bp, Glycine max
  Peptide Sequence Number=SeqID_138816
atgaagaagaagcaggaagaagaagagttgatccgaaagaagaagaagcagaagcagaaacgcggggagagagagagaccaacactcccatgctattctcccggagatcgacatcgacaaagaataatggatgcagcccatagtttcttaaaaagtggaggccttttaatagattttattgcaaaggttgcatatgcaaatttgggtaagaatgaggttgaggtcttgaagcatgtgtcaaactacttagatccagttgactcagaattattattagacctacttgccacttctgagttgaaggtgacatatcagtcttatgattggggtttgaactgctag

SEQ ID NO: 47132 - DNA, 211 bp, Glycine max
  Peptide Sequence Number=SeqID_138817
atggctccaaactctttgggtggaggacgcatgaacgaaaacgcaattcatggggctccgaaaaaaaggcgaggatggaggattgcactagagggtcctcactactcaatcatgaagcatagctccaaactctttgggtggaggatgcatgaacgaaaacgcaattcatggggctccgaaaaaaagagaggatggaggattgcactagagg

SEQ ID NO: 47133 - DNA, 788 bp, Glycine max
  Peptide Sequence Number=SeqID_138818
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatccaatctcaatcagcagacaggagtcggagcgcctttgagaaacggtggtgatcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 47134 - DNA, 615 bp, Glycine max
  Peptide Sequence Number=SeqID_138819
atgccttggttagcctggtacaatcccgggtggaggaatcatcccaaccttagatggtcgagtccttcacaacagcagcaacaacaacagccttattttcagaatattgctggcccaagcagaccatacgttcctccaccaatccagcagcatcaacaacaacaacatcaacagcaacaaccccagaaacaacaaatagttgaggctcctccgcaaccttcccttgaagaactcgtgaggcaaatgactatgcaaaacatgcagtttcaacaagagaccagagcctccattcagagcttaactaatcagatgggacaattggctacacagttaaatcaacaacagtcccagaattttgacagattaccttctcaatctttccagaatcccgaaaatgtgagtgccattacattgaggtcgggaaagcagtgtcaaggacctcaaccagcaacatcttcctcatccgcaaatgaacctgcccaacttcactctactccagaaaaagatgatgagaaaaatttaaagaaagcagcatatccctcttccattccctccaagagcaatttccaacaaaaaaatggaagaggcagagaaggagatcttggaaacatttag

SEQ ID NO: 47135 - DNA, 213 bp, Glycine max
  Peptide Sequence Number=SeqID_138820
atgagattcaaatacactccagcacaaatatttgatcctgagataccctttggagcatggtggcgtatgaagctgaaaaaaattctagacattgagagacaaagagaaatctcagaagatcacataagagaactagtttctattgtgattattcaccgtccttactttatggagcaaggacaactctggtctagaaatgaagctcaaatttag

SEQ ID NO: 47136 - DNA, 687 bp, Glycine max
  Peptide Sequence Number=SeqID_138821
atgtggatggataggttcaccttgaccttgaatggaagtcaagacctccggcgtctgttagccaaagcaaaagccatggccgaagtgtgtactgcccccgaggagattcatgggctaatcaattactggcgtgtaggaacagatgaaggccgatctatcggccttaaaagatcaaatggcttccatctcggaggtcatgttaaaactccagaaaaccatgaggataaagccaccgcaactgcctccagtacagttagggaagcggagccggtgctgcagcctgccttgaatccgggcctagacagaaacacggccgtgttcggtcgaaggtatagtccgcaagcttatccttatggtttgcctccggacttcaccccccgtgccactccagaagatttaagccaagcccctacttttgaggggcaactcccaccttatgaagactatcccggacaagacgatggggaaggagatacccatcttggccccctgctccacctcaaagatccatccccgcatgaactaccccagccgaacatagtccgccatatcccggcctcacccacgcccgtaaaagaatctgttcccttcgcggaagataggggaaagattgaggcgcttgaagagaggttgagggcagtcgagggcctcgacaattactccattctcggatttgggcagatttat

SEQ ID NO: 47137 - DNA, 558 bp, Glycine max
  Peptide Sequence Number=SeqID_138822
atgtccgaatcttgtggatttgggatgaccggccctctcgatgagtcgatctcttgctttctcataagggtggaccctcgggtacttgtacctatcaccttcagagggctacacgccctcgccatcagaggactgcatgtcctcaccttcagagggctacacgccctcgccatcagaggactgcatgtcctcaccttcagagggctacacgccctcgccatcagaggaccacacgtcctcaccttcagagggctacacgtcctcaccatagagggctgcacgccctcaccttcagagggctacacgccctcgccatcagaggactgcatgtcctcaccttcagagggctacacgccctcgccatcagaggactgcatgtcctcaccttcagagggctacacgccctcgtcatcagaggactgcatgtcctcaccttcagagggctacacgccctcgccatcagaggactgcatgtcctcaccttcagagggctacacgccctcgccatcagaggaccacacgtcctcaccttcagagggctacacgtcctcgccatag

SEQ ID NO: 47138 - DNA, 135 bp, Glycine max
  Peptide Sequence Number=SeqID_138823
atggagaatatgatgaagaataaattaatggcaatagaatggagaaggaagaaagatgattggagacgccacctcaaggagaagatgagtcaagaacaagctcaccaccataggaagccatggataagagcttaa

SEQ ID NO: 47139 - DNA, 255 bp, Glycine max
  Peptide Sequence Number=SeqID_138824
atgtattgtactccttcacctgttcatcaaaattttggccagactggcgagtcagttaacacaaccaactgtgaatggatgaccaatttatttggcgtcgatttgaatacaccaaattttgcggcatcatatttagcttctttgcaacagttcaatgcaccacattcgtttggagaacaaggacaaagaaagaagaaatctgcgacatatcggcatccgccgccttatggaactggtcatcgtcttggtcattga

SEQ ID NO: 47140 - DNA, 558 bp, Glycine max
  Peptide Sequence Number=SeqID_138825
atggcgaatcaagaggagtgggtcccgtttgcagatgtattagctttgctaatctttggggttgtcctctttgcaaacgtggacggtttggtggacctagccgcgattgatgctttccttgcatatcaccatagcaaggagagtccggtggtagctatcttggcggacttatttgatacatttgaccaaagggtaccccatgaggggagcaccgaggaagagagcctctcgcctttccttgtgagagatttcggcgcccaaagtttcaagattgtacaaagagtccacaaggcgtgggaaagcccgttaaggaaagataaagaacttaggggcatccgtaatggcatcatcgatggttatcatgaatggctaagagttcatacacaagggttagattggctctccaaattgaaaattatcaacgaggagaacttcgaagctccggaagaggatgaagaagtccaatctctaaaatcaaagctaggaaaggcaagactcaccaaagaaaaattcaagttagtcgctacagacatccggaaagagtgtgctgaattatga

SEQ ID NO: 47141 - DNA, 539 bp, Glycine max
  Peptide Sequence Number=SeqID_138826
atgatgtagtaagggtttgtgttgagacaatttacgatggtgacgccagtgtcccgtttcccactgcagagattcagtatgtcagggacacgagtagcacattcattgcatggcccaaacatctagtgaagcctatagctgatgattcaaatcataatgtgcatttgccacttagacgtcttggtgaggctgaggttgcagctgaagctgatccgttgggcgaattgatgaagacattgttttgcgtgtacaagaatccagtggaagtgtcgtgggaggcgacgcaatttggacttcctaatgttggggcaaaatttttcatcacacatgctgatctagcagaaataatatcaggtgacaagtgtttgaacatctctatcctgcagctgtggaccatttttgtggtagaagcaaagcttatcagtcactgtatggtctgttcgagcctcaatctatacacaatgctaaggacagacgtgaacaatgctaacaatacattcaatcatgggtcaaggaatcacaaaggcagttgtacttag

SEQ ID NO: 47142 - DNA, 195 bp, Glycine max
  Peptide Sequence Number=SeqID_138827
atgccactctttatcctggacgttatggagaattcgtccctaacagcaaccgacttatggcgggctaaccacagaaggctgcagctattaatattcacgaaatgggatactagtgaagggaaaactgtaaaacacattacgaacgaaacaaagaggggttcagctcaaaaggaaacaacaccagaactactataa

SEQ ID NO: 47143 - DNA, 474 bp, Glycine max
  Peptide Sequence Number=SeqID_138828
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccacatgctatcgaactcgattgtctctgcctag

SEQ ID NO: 47144 - DNA, 332 bp, Glycine max
  Peptide Sequence Number=SeqID_138829
atggggaccaccacgggtacatataatgaattgaaaaactcggtttggggtacttaccgattgaagactgaagaaaacgaagaacgaacgatgaatgtcaaagaacgaaacgttacggaagcgcctcggcttggattttcctcacagaaacaattttcctcagcaatttcaagagaatacgaagtgccaagaaggctgaacctttccttcttcattcctccccctatttatagcaaaataggggaggagcttgccacccagctcgcccaggcgagccaggttgcttcctccaaaagcaacctccttctggaggaagaatctagaaggcccaa

SEQ ID NO: 47145 - DNA, 765 bp, Glycine max
  Peptide Sequence Number=SeqID_138830
atggtgaatcaagaggagtgggtcccgtttatggacgtattagcattgctaatctttggggttgtcctctttccaaacgtggatgttttggtggacctagccgcaattgatgctttccttgcatatcaccatagcaaagagagcccggtggtagccatcttggcggacttatttgatacatttgaacgaaggtgcgagaagagtagtgcacgaatcatctgctgcttgcccgctctttgtgtatggttggtttcgcacctattccaacaagacataaggcatccatgtccgctccgaagccatcgctcgtgtgtcgaaaagagaagagtagattgggaccaacacttggttgggataggaggtagaacaatcagctggtttcctcgatggaaggaaggaaaggagggagtcctcttctcatgtggggactacccaaacgtcctattgatagggacgaggggttgtattaactacaatcttgcacttgctataagacagttagggtaccccatgaggccggcggaagagagcctctctcctttctttgtgagagatttcagtgcgcaaagtttcaagattatacaaagagtccataaggcgtgggaaagcccgttaaggaaagataaagaacttaggggcattcgtaatggcatcatcggtggttatcatgaatggttgaaagttcgtacacgagggttagattggctctccaagttgataattatcaacgaggagaacttcgaagctccggaagaggatgaagaa

SEQ ID NO: 47146 - DNA, 210 bp, Glycine max
  Peptide Sequence Number=SeqID_138831
atggatgttaaaagtgccttcttaaatggtttaatccaagaaagagatagatctaaaaagagagaactgaaaagtacgtgttcaaggattacaagctcaagaaactcaagaaggtatattcaagaaatcatcgacatccaagatatctcaaggaactatcaaaagatttggagatgtgcaaaacacatgtctatcaccgatagagactaa

SEQ ID NO: 47147 - DNA, 270 bp, Glycine max
  Peptide Sequence Number=SeqID_138832
atggtgggttacacaccttcaagctttgcggatttggtcttcgctggcgaaatgatcaaagtgggtctgaaaagaggcaaatttaatcatcatgcttggacgaatgagaaaactggggcaaatgaagagggtgagaatgaaggagaaacccatgttgcgactgccgttcctacatggaaactcccccaccagctcaacaatatcattactcagccaatatcaacccttctcattacccaccacccagttatccataaaggccatccctaa

SEQ ID NO: 47148 - DNA, 399 bp, Glycine max
  Peptide Sequence Number=SeqID_138833
atggcgaatcaagaggagtgggtcctgtttatggacgtattagcattgctaatctttggggttgtcctctttccaaacatggacggtttggtggacctagccgcaattgatgctttccttgcatatcaccatagcaaagaaagcacggtggtagctatcttggcagacttatttgacacgtttgaccgaaggtgcgagaagagtagcgcacgaatcatctgttgtttacccactctttgtgtatggttggtttcgcacctattccaacaagacataaggcatccatgtccgctccgaagccatcgctcgtgtgtcgaaaaaagaagagtagattgggaccaacacttggccaggataagaggcagaacaatcaactggtttcctcgatggaaggaatga

SEQ ID NO: 47149 - DNA, 315 bp, Glycine max
  Peptide Sequence Number=SeqID_138834
atgggtgccaagcacctcacgaggaccaaagaatggtcgcacgtcatcgagcaaaggtccccggacgaaattaggcaaaagaatgtttatacggataaccactcgggtattttccgcgtatcatcgggcccgccgcctctggatgatacaagggtgcagaatgtccaaactttggttctctgcttgtcatcgggcccgtcgcttctggatgacaaaaagggtgcgaataaccataaggtattctccgcgtatcttgggtgcagaatgactaaacttgggtttctgcttgtcttcgggcctgccgcctctggatga

SEQ ID NO: 47150 - DNA, 150 bp, Glycine max
  Peptide Sequence Number=SeqID_138835
atgagaaaaatgcaaggattatgtatgagtgaacataacatgcgaacgataaaaatagaatggactattagtgacaatgcatcacgaaaagaggaaatgaggcttcactgttatcaagcgagtcggagacccagcatgatcacagattga

SEQ ID NO: 47151 - DNA, 384 bp, Glycine max
  Peptide Sequence Number=SeqID_138836
atgtctcacatggatccacgcgctaggagtggtcccctcgacgcttcgccagaaattgaaattcgcagttggtggactcttggtgatagtgtcgggcgaagaggatatgttggtaagcttcccctcctcggcaccgtatgtagaggcagcggaggaatcattggaaacagctttccaatccttcgaggtggcacggttatgagcccggaatgggtctgggcaaggacagccacgggaatgccgatgtggttgacattaggggtaacccgcacaaatatgggtatgagcccgggaaaactggaagaaggaatgcaccgtcaagacttcgggcagatagggcatggcccaatcatgttagccagtgtttcacaagtgctaggataa

SEQ ID NO: 47152 - DNA, 361 bp, Glycine max
  Peptide Sequence Number=SeqID_138837
tgtttcaagtgccaaggcctacggacactatgcttatgagtgccctaacaaaaggtccaggaacggttacttggatggtcaattgaagcatgaggaggagagcgagaaaactatgctttcacgcttagatggagggctaagtgaggagtcaagtggaagtggttcttctagttggaaagacaaaggtgaaagatggggctgctacttctgtgagtgttcctcatggagtcccatcaaaactcgtcttttggggagaccatggcaatttgataaaagagccaatcatgacggttacaccaacaagatctctttcatgcaccaagacaaaaagattgtgctcaagccattgagtccacaagaa

SEQ ID NO: 47153 - DNA, 357 bp, Glycine max
  Peptide Sequence Number=SeqID_138838
atgagattttgtagtaaacaatttgtcttgcaggccaagtttgatatctcagaagccctagatgcaaagaaaaagatatgggaggaatttgcggcaacccgcaaaacccctagttggcagggaattaggaagaagatgcaggaaatccaaaagaataatgactgtccctatttgctttctcgcgggggatatgaattgctagaaaagaagctgttagacgagaaaatgaagaaaaggcaacatgacacattgatgactgaaaatccagcactcattgaggacccccccatctcccattcaaagacatgtcaagtggaagatggcccgcacgaatcgatatgggaagatgacatctga

SEQ ID NO: 47154 - DNA, 884 bp, Glycine max
  Peptide Sequence Number=SeqID_138839
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcagtttgatctttggggataatctgggaacaggctgtgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 47155 - DNA, 600 bp, Glycine max
  Peptide Sequence Number=SeqID_138840
atggatgactttgctgctcagcaacatctgcccacgatcataattccgacctcccctgccaaagtgtcagctggtatggcacctaccaggcaccctttggatccagataagtccaatagggccctgggatttcccgcactgatcacaggactctgccagtcgttcggagtccccgtggcacctaccaaggtgattcagtcgcccatcacccgggcttttattgagaagtactgcacccagagacaggctcagggggatgctccgcaggccgcagacgcgccgccaccttatcaggctggccaagctggatcgtttgatacggagcggtatttgcggcatttggttcgcgagcaggcagccaaccaccgggcacatgtacagacccatgattgtctttaccagctgagcctcagcatgcagagtcagggcttcgcttctttttcatgccctactccagaccagttcagggcagaggtcgcatggcccgaggcccaagcaggagaggcgcccccagaggctcccggcgatggagaggaggcccacgaggacgaggagatggccgatttgcttgacttcttgggagggagtggagctacatga

SEQ ID NO: 47156 - DNA, 501 bp, Glycine max
  Peptide Sequence Number=SeqID_138841
atggaatatctcccatacaccgcatcaaagttaacagacccaagagtagagcttgtttacgaagacggtgcgaagttcgtaaggcaatttaaaaacgagtttgacgttattataattgactcaaccgacccaacagcaggggaaggtgggcacctattcacgcttgacttttacaaggcatgtaacgaagctttgaaagaagatggtattttgtgtgctcaaactgaaggcatgacatacgactacgaatggggttcaactgcttacaaaagaattaaggcaaacttcccgcttgtaaagatgtaccttggctttatgccaacgtatcccggaggtatttggtcttacacttacgcttcaaaagcaggaattgacccagttaaagatttcaatccagataaagtaaaaaatttcagagaaccgttaagatattacaatgaagaaatacacatagctgcatttgcacttccgaatttcgtaaaaaaatacatagaagaataa

SEQ ID NO: 47157 - DNA, 231 bp, Glycine max
  Peptide Sequence Number=SeqID_138842
atgcatctacgtgatcaaggaagccttccttacaacatagagaagaacaagatgaaagattgcaaaaatacaagtggtgaggatgtctccttcacctctaggatgtcacaatcactcaaaaactcatctcaagttctcaaaccagctcctggttcaagctctagtctctgcagatcttcacacaacaaaatctctcaaaactctatggaacttggacctttccctctctag

SEQ ID NO: 47158 - DNA, 318 bp, Glycine max
  Peptide Sequence Number=SeqID_138843
atgaagaatcgtcgaagaacggttgaaacctttgcgaaattcttcacggaaaacgttacggaaatgtttcggaagcgcctcggctcagattttcttcacggaaacaatttttccaagcaaattcgaaagagagagaacaaaataggggagatgcttgccgcccagctcgcccaggcgagccaggttgcttcctccagaagcaacagccttctagaggaatcttctggagggcccaagtgggcctggttgctatttgcacccccatttttactaagtacacccccctctgctttttttttgatgattcttttttcgtaa

SEQ ID NO: 47159 - DNA, 102 bp, Glycine max
  Peptide Sequence Number=SeqID_138844
atggatgaactgaaagatttaatcaagcaagttgtgcctcatgggattcccccttatggtattcatgaaacacaaacggtgttaattgagtctaactactaa

SEQ ID NO: 47160 - DNA, 366 bp, Glycine max
  Peptide Sequence Number=SeqID_138845
atgggtatcaccgtacgcaacctgacttcatgggtcaggatgacagaaaccgtttgtacggataaccgcttgggtatctccattcgtcacctgacttcatggttcaggatgacagaaagcgcgaaagacgatgtatatccgcctgccaccttacttcacgggttaggattaaaagaaatcttttgtacggataatcacttgtgtatctccggacgtcacctgacttcacgggtcaggatgacggaaaccgtttgtacggataatcgcttgggaatctccgtatgtcacatgacttcacgggtcaggatgatagaaaccgtttgtacggataactacttgggtatctccatacgccacctgacttaa

SEQ ID NO: 47161 - DNA, 235 bp, Glycine max
  Peptide Sequence Number=SeqID_138846
gcaccctttggacccagataagtccaacagggccctgggatttcccgcactgatcacaggactctgccagtcgttcggagtccccgttgcacctacaaaggtgattcggccgcccatcacccgggcttttattgagaagtactgtacccagagacaggctcagggtgatgctccacaggccgcaggcgcgccaccaccacctcatcaggctggccaggcgaaattcatacactaa

SEQ ID NO: 47162 - DNA, 198 bp, Glycine max
  Peptide Sequence Number=SeqID_138847
atgtctcctacggtacccgtaccaggtggaagtagcgacctagagcagcagggtgctgtagcgaaactaattgcaaaagaggggaaatcggccacattaaaattacctttctggggaggtccgtttgatatccaaaaactgctcggcaacagtcggacaagtgggaaatgttggagtaaaccagaaaaatttaggtag

SEQ ID NO: 47163 - DNA, 198 bp, Glycine max
  Peptide Sequence Number=SeqID_138848
atgaatggcagcggaatggagaaggaagaaagagagaggagacgcctcttcaagaagaacatgagtctagaagaagctcaccaccaccaccataggaggccatggataacagcttggaggaagaaggagatgaatgaagggagaggaagagaagagcatgaaattttattctctaaaagagctctgaaatggttatga

SEQ ID NO: 47164 - DNA, 622 bp, Glycine max
  Peptide Sequence Number=SeqID_138849
ggtgcacccttgggtactagtaccctcaccttccgaggactacacgtccttgccttcagaggactacacgttctcgccatcagaggacaacacatcctcgcctacagaggactacacgttctcgccatcagagggctgcacgccctcgccttcagagggctacgcgtcctcaccttcagagggctacatgcacgcccttagaggactacacgtcctcaccttcagagggctacatgccctcgccttcagagggctacacggcctcacctttagaggactacacatccttacctttagaggactacacgtcctcgccatcagaggactacacgtcctcaccttcagagggctacacgccctcacctttagaggactacacgccttcacctttagagggttgcacgtcctcgccttcagagggctgcacaccctctcctttagtgggatgcacgccctcacttttagagggctggatgccctcgccttcaaaggttcagttcctgggccaccccctgatcctggaggagggtcaactgtgcgagcacaactagaggaggaggctatcgtacagccactatgcatactggggcaagatttcacccgtgccattacaaagagatga

SEQ ID NO: 47165 - DNA, 102 bp, Glycine max
  Peptide Sequence Number=SeqID_138850
atggctgattctaaacctatcagcactcccctttcagaaaaagagaagttgtttgttgtgataaaggttcaaactcaggctgatcaggactatatgtcaaag

SEQ ID NO: 47166 - DNA, 153 bp, Glycine max
  Peptide Sequence Number=SeqID_138851
tcaagaatcaagattcaaggttcaaggtctcaagaatcaagattcaaggttcaagatctcaagaatcaagattcaaggttcaagatctcaagaatcaagatcaagattcaagactcaagattcaagaatcaagagaaggctcaatcaagataa

SEQ ID NO: 47167 - DNA, 315 bp, Glycine max
  Peptide Sequence Number=SeqID_138852
atggcctcgatcaaatttggtgccgttgccggggagcagtgtccaaagtgtatgactagaggcaatccatctgacttacaaccctttgatcctgagatagataggacatttcatagattagttaggcatcattttataccttttgatcatcttgagcattccattactggtgaatttgtgcattctgttattggtgattttgaacatcctgattttgagcattacaattttgagcattctgattttgaacattctgagaacatggcacaacctccaccccgtgagaggactctaagggaaatgggctgcccctga

SEQ ID NO: 47168 - DNA, 471 bp, Glycine max
  Peptide Sequence Number=SeqID_138853
atgtcgcttacagaagaatttattcattaccacgccgagggaaagatctttacgggcgtactggttcgtgattcccggaacgcacctcttcccggcgttcttctcgcccctaatatgatgggtgtcgcatcgtcgagtattgaacacgcgcgtaccattgcaaaaaaaggctacgttgtactcgttgccgatctttatggatgcctgcctgactcggcagaggatgcagctaaccgtatgaattcattaaaggactcgccagccgaacgcctgattcttaacgcagcgctggcacgactggcgcagctccagtgcgtgaatgaggataagcttgctgctgtaggattctgttatggtggacattgcgtactcgaactggcacgcagcggtgcgcctctggccgtcacggcatgctttcacgggacgcttgatacccgcacccctgctgagaaaggggatatcaggggcaag

SEQ ID NO: 47169 - DNA, 507 bp, Glycine max
  Peptide Sequence Number=SeqID_138854
caccagcagcgcttcgaggccatcaagggatggtctttccacagggagaggcgtgtccagctcagggaagacaactatcctgacttccagggagatatctctcgcagacattgggcacgactagtgacccctttggctaaatttaacccggagatagtaatagaattttatgctaatgcctggcctactgaggagggggttcgggacatgcgctcacgggtgaggggtcactgggtccagtttgatgcaaatgcagacggtttcgatgagaaagccatcgcccaactattgtgcatatcagggcaggatttcgcccggaccgctgcagggaggcaggtacggattatgcgcaccagcatgactaccttgacccagatatggatgacactgctgcatagcaatgtcttgccgagcgaccacaactttgacctccctctgcctaagtgtcagttggtgtatgccatcctgacgcagatgagcattcacatggcccaagtgattgctgat

SEQ ID NO: 47170 - DNA, 651 bp, Glycine max
  Peptide Sequence Number=SeqID_138855
atgggtgaagtagaagaggtgcaagagcagatgaaggccaacatggaggccatgaaaaagcaaatggccacaatgatgaaggccatgatgagcacgaagaagataatggaagccaatgcggttgcagttgccgctactagcactgttgctaaggtgaacccgacgccccgatctggcctcaaccaaatgaatcatccaaccttagatatggtaggaaaagatttgggaagtatgggtggcccccattatgtgcaaattcaaaacaagcacgccttcctgccatatggcttgcctcccaactatacaccacccaatgtggcgtgcactcccagtgagaatgtcaataactccactcccatactctttgagagtcaacaacctcaatctgatcatgcacatgtctctcaacccatggggaagacacatgaaattccccaccacaatctagccgacttcgagccttgcctcagatatgccactgaagggcacccctgcaaaacactttggaggggcctcaatttctcccccaaccacaacccttctatggaaaaatggtgggttacacaccttcaagctttgcggatttggtcttcaccggaaagaggatcaaaatgtgtttggaaagaggtatatctgatcatcctgctttaa

SEQ ID NO: 47171 - DNA, 498 bp, Glycine max
  Peptide Sequence Number=SeqID_138856
atggcaagagctggtgacaatggtggtgtatatcatcaactggacgaatctcagcgcttatttctggacgcgtggactacacaaatgcaacgtttgttgaaccgtaacaaagaagagccctacagacgaatagccaaatcttcctcgtttactcttaaacctctatcccttagagaagtgccaacttacaaaagcaatccccaagagactcaacgtaaggatgcacatgccaaagttgagtatgtgaaaagattgtatgaccaagtgaaggtgcaaattgcaaagaagaatgaaagctatgtcaagcaagcccacaagaaaaggaaggaagtggtacttgaacacggtgatgatcctgaacatttgaggacaaatgttttccaagaaggagggaatgatgagaatcatgaaactagccaaatacaggctaaaggcccaagtggagaaggacgaaggcccaagtggagaaggacaaagcccccgagtggagaagggtga

SEQ ID NO: 47172 - DNA, 377 bp, Glycine max
  Peptide Sequence Number=SeqID_138857
atgcagacgctaagtgcacctgctaagcacgcctgtgcgcctaagcctcagtgtctctctgttgaggctgagctaagcgccagcatatggcttataggaaaagaaaggcaccatctacacccacccaagttagatttgacagatcaagattcacttcccaagaggcttgggaaagatacagacattattgtgcctaggaagcttctgccagagaggaacatggcggtctactatatagagttcgatgagttcaaggaggaactcgaaagaagccactgggacgaggagttgactgactttggggatggcaacattgatgttgccattgtgaaggaattctatgccaacctctatgaccccgaggacaaatcacctaa

SEQ ID NO: 47173 - DNA, 492 bp, Glycine max
  Peptide Sequence Number=SeqID_138858
atggtctcccgtggcgaagacgaaagggacgaatgtttgtttcacctcggggagtcacacgatatggaaacctgtcccacggtggaagaattgcttcaacggctcatggactgggggcagcttgaagtgtccaaaggagggagggaagaaccacagatttgcatgcagtcagaagaaaagaagggactggctccacgcccgtttgcatatcaaagcaataaggccgttccgtggaagtatacccctcccgcatttggagaaagagttgcaaccgaagttgactccctgtcagccaaggtgaccaatatcatcggcctcagtggcgtaacccgcagtggtcgggtgttcgctccccttcactcagcggaatttccctccaaggggaaagcacccatggtccaagagcccacagacatagccacccctcaaaagaagtggatcctccaatggcaaaaggggttgaaaagaaagagggtcttcaaggaaagatag

SEQ ID NO: 47174 - DNA, 330 bp, Glycine max
  Peptide Sequence Number=SeqID_138859
atggagcaactcctccacattggtgctgcttgcactgaaagcaaccctcagtggcgggtggacatgaatcaagaagccttgcagattctcatcatggtgaacaatcacagaggagacatggaagaaacaacttcggaagctgggataatatcgaatatggcagctcctaggttaggagctgtggatttaaggctgtggtgcccaagactagattattcactatctcaacagataaagatactttatggtgtggatgaaatcgaagcagagtttggaattggaactgggactggaggagagcattgttttcttgggaggaagaacaactag

SEQ ID NO: 47175 - DNA, 195 bp, Glycine max
  Peptide Sequence Number=SeqID_138860
atggcaaacatcaccgcttcagccatgggcacgaacaggaagcgcgatacgccttcgagaaagaacatgggcacaaacacaatgcaaatacacaacaaggacacaaaagccggggtcacgatctgtgcggcgccatccaaaatcgcctgctctaccggtttgccttgctccaaatgccagttgatgttttctatg

SEQ ID NO: 47176 - DNA, 207 bp, Glycine max
  Peptide Sequence Number=SeqID_138861
atgatattgcacgagattagaaggcctaactctctaaaaacagtccccactggagtcgccaactgtcgcaacctacccttcggcgggagggcgacgcagggctcgcgggtgcgtcttccatggaaggaaaatgcgtggagtcgccaccaacgtttattcgaggaaaacgtcggaaaaaccggaaaaggtgtggtctacgaactttaa

SEQ ID NO: 47177 - DNA, 264 bp, Glycine max
  Peptide Sequence Number=SeqID_138862
atgtgcatacttacctatgtcatgacggcacagaccaaccgaatgttactaaatagcaatgtcatccatatccatgtaaaagttgtcatgttggtgcgcatgatccaaactcgtctttttgcagcgacacgggtgaaatcttgccccggtatgcatagtagacgcgtgatagcctccctctctggatgtgctcgcacagttggtcaccctccaatatcagggggtgacccgggaactgataaaaggaaactactggccccttaa

SEQ ID NO: 47178 - DNA, 270 bp, Glycine max
  Peptide Sequence Number=SeqID_138863
atggactcgggaaggttccaagttagtgtaccaggtaacagctacccagaggggctcttcccaccgcaaaatgaaatggttgtagttgcgggcgaaactgagggccctccaaagtgttttcaaagggtataccaccaactgcttccccttcagtggcatatccgagtcaaggctcgaagtcagctagattgtggtggggaatttcatgtgtctcccccatggtttgagagatatgtgcctgatcagattgaggttattggttctcaatga

SEQ ID NO: 47179 - DNA, 285 bp, Glycine max
  Peptide Sequence Number=SeqID_138864
atgttcggggtgtttaatgaagacttccccttgtacataaagtatgaagatctgtctgaaatagcacatggtggtcaatgtctaagcatctctgtgatacaattgtggattctgcatatgaatgagacaagtatacaagcggggaatgccgatgtgtatggattcctcaagccacagtccatccagagatccgggcaattgaaatttgaatcagaaagttacattaagaactggatgcagaattcaaaacaggaagtgtacctaggagcctacctgaatagctaa

SEQ ID NO: 47180 - DNA, 372 bp, Glycine max
  Peptide Sequence Number=SeqID_138865
atgggtgaagtagaggaggtgcaagagcaaatgaaggccgacacagaggccttgaaagagaaaatggccacaatgatgggggccatgatgagcataaaggagataatggaggtcagtgcggcttaccgaacccgtgctagagctagagtaatgggtgaagtagaggaggtgcaagagcagatgaaggccgacatggaggccatgaaagagaaaatgaccgcaatggtggaggccatgatgagcatgaagaagataatggaagccaatatggttgcagttgccgctacaagcgctgttgctaaggtgaacccgatgcccccatctgatctcaaccaaatgaatcatccaacctcagatatggggatcctctag

SEQ ID NO: 47181 - DNA, 321 bp, Glycine max
  Peptide Sequence Number=SeqID_138866
atggtgacttggtcaggtataaatctcgtatatatcatatggagagtcatgagttttcttggatcccatatagaggatttgaagaacacttatcgagacatgcatacagagacaaagagatttggtctgcattttgatgcaccatgttcgtttgaagagcaaggacaaagttcttcagctacaataacccacaatgaatacactgacacagaacaacaacatcatcatcatgagggaggaccagtcacacaagagagaagaaatctgcgatgtaatcgatgtccaccgtcttgtgggactggtcatcatcttggtcattga

SEQ ID NO: 47182 - DNA, 159 bp, Glycine max
  Peptide Sequence Number=SeqID_138867
atgcaagtcaaggtcttgcttttatggactcttcaagcctgtggaaggcaaaggagaagaggagaggggaggcaccatccactagggaataagccaaggaagaaggagcctcaccaccaagaattaccttggataagaagcttgaagatgatgctttaa

SEQ ID NO: 47183 - DNA, 435 bp, Glycine max
  Peptide Sequence Number=SeqID_138868
atgacaccggtaaaccgaaaggcaggaacaggagagcgcacgagggagccgccagggggaaacgctggaaatctccgccccgttcgtaagccatttccgctcgccgcagtcgaacgaccgagctgtagcgaaacagatcgaattcgctgcagcccgggggccactttagttctagcgcctgccaccgcggtgaagcccattcatgcccctcatcacctgaatggcgaatgggcagcctgtagcggcaacgcaattaagcgcggcgggtgtggtgagttagctcacgtctggcaccccaggctttacacttgcccgctgatgtccggctgtagtgcttgtgtgccgaattgtgacgcggataaccaattcccgtcagtagctgaacaggaaggacagctgatagaaaccatgatacgccactggagctcgaaataa

SEQ ID NO: 47184 - DNA, 917 bp, Glycine max
  Peptide Sequence Number=SeqID_138869
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgagcaaactcgtggactcggagtgaactcatgtaaactcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 47185 - DNA, 300 bp, Glycine max
  Peptide Sequence Number=SeqID_138870
atggagaggagtatgattgatgttgccagtggtggagctcttggtgatataacccttgctgaggctaggaatttgattgagaagatggcttccaactcccaacaattcagtgcaagaaatgatgctattgtccttagaggagtccatgagacaagtcctccacaacaacaacaacatatccctccttttcagaatgttgctggtccaagcaagccatatgttcctcctccaatgcagcaacagcagcagcaatcacaacaagacaacaagcaactgaggcctctcctcaaccttccttag

SEQ ID NO: 47186 - DNA, 132 bp, Glycine max
  Peptide Sequence Number=SeqID_138871
atgggctcaaaaatctaccctaaggttcatgagaaccctagggccttctttagtagctctagcccaagcctcttggagtcttctatccaataccttaggggggaattaatgaagcattggacttggatttga

SEQ ID NO: 47187 - DNA, 489 bp, Glycine max
  Peptide Sequence Number=SeqID_138872
gaataggagaaaaaggaaatagaccaccaaggatgactcttggtgactatgcttatcaacaaggaccaaagcattacaacaacattgtcattcctcctttcaacaacaaggttgtggagttgaagccaacactacttagtctgattggctcacacccttttgttggcatggatcatgaggatccatacacacatttgtctaccttcatggagttgtgcaacaccatgggagcttttgacaaagatgttgaagctgtctaccttagagttttcccattctccttgatagattcatcaatgcaaaatcagtcatcgctaatttttcccaagggtatgatgaacctcgctgtgaaacatacgaaaggttcaagtctttgttgcggaggtactatgacgtctaagagtctagaggaagcaattgtaatcattgactccattgcagccagtgattatcagagtcatcatgatagggctcagattctaagaaaag

SEQ ID NO: 47188 - DNA, 192 bp, Glycine max
  Peptide Sequence Number=SeqID_138873
atggtgaaagttggaacctcttacgtgccgatcaacgtctcattttcgccaaaagttggcccagggcttcccgctgtccctcctgttcagctactgacggggtggtgcgtaacggcaaaagcaccgccggacattagtgctggcaagtgtagcggtcacgctgcgcgtaaccaccacacccgccgcgcttaa

SEQ ID NO: 47189 - DNA, 222 bp, Glycine max
  Peptide Sequence Number=SeqID_138874
atgagttctcgagagttttctgcctatgctctgttttgcttggctgtgatagcttgtgcgcttgggaggattgatggggacccggtgttgagagaaacaaggatatgggctacgtgggagtacgtgagctcagatggaggtgggcaacaggggatggtgggtttatgcgcgctttgtggatgtggaaaacttgttgtgcaccatcgcccaaccgccacctag

SEQ ID NO: 47190 - DNA, 603 bp, Glycine max
  Peptide Sequence Number=SeqID_138875
atgacattgctacttagcaacattctgcccagcgaccgcaatgccaatctccccctgcaaaagtatcagttggtctgtgtcgtcccgacatggggatcgcacccacaaagacacccagtggacctgaagaagtccaacagggacctggggtttccatctctggttacgggcctctgtcggccctacagggcgcccgttccccccagcaagttcatgtcgtcgtggcatagggattgtgcccgcaagacacctagtggacccgaagaaggccaacagggtcttggagttgccagctctaaatacgggtctcttaaggtcatcaggcccccctaccaatcgagctttcatcaagaagtactgcgcccccaggcaggcgcagggcgaaacaccacatcagcattgggatggccggtagtgggcaacagacgcaccgccatcacctctagagttcacctctgctcatccacaaaaaggtttgagtattgcctacaccacatggccgactgtcgcaacctacccttcggcgggagggcgacgcgtgactcgcgggatgcgtgttccacaaaaggaatacgcgcggagtcgccaccaacgtttatttga

SEQ ID NO: 47191 - DNA, 207 bp, Glycine max
  Peptide Sequence Number=SeqID_138876
atgaaaagagaaaaacatgcctcctatagtagtcataactcttgcaagagcctaagtgaagaacttcgtgactattacgaaggaaggcatagtgatcaaggggttcccatgaaccctaagagaataaaggtcattcctaagtggcccactccaccaagtgttcagggaaggagcccagagtatgaagaacctcaagatttgaggtaa

SEQ ID NO: 47192 - DNA, 171 bp, Glycine max
  Peptide Sequence Number=SeqID_138877
atggataagagcttgaaggtaggagaagatgagtggagggagagggagcgaggggggcatgaattttatgcctcaaatgagtctatgtgccctaaaatacaagggctgaaaaatcctacattactagggcaccctccctacatgttagacaagtggcctcagatatcttaa

SEQ ID NO: 47193 - DNA, 531 bp, Glycine max
  Peptide Sequence Number=SeqID_138878
atggggacaaatcaaaacggaaaaagattctatcaagtcaagattaagggcctagatgtcaccagccataaggagttgggacggttgatgggacccctccaatggcaagccttccgcaaagtgtacggaaagattttagatttgaccacagcggaggtatttacggaagccgttgtatccctcgcccaatactatgatcagccgttgagatgcttcacgtttagggacttccaaatagtaccgactgttgaagaatttgaggagattttaggatgccctcttgggagaagaaaaccgtatcttttctccgggtttcctccctccttgagcaagattgcagctgtggttggagattcggcgagagagttagatcgtatgaagcaaactcgaaatggcgtagtgggcctaccgcggaaatacttggaaggcaaggcatgggatatggcgaatcaagaggagtgggtcccgtgtgcggatatactagctttgctaatctttggggttgtcctctttccaagcgtggacagtttg

SEQ ID NO: 47194 - DNA, 153 bp, Glycine max
  Peptide Sequence Number=SeqID_138879
atgaagaagatccaaggcctacaagctccacatggagctacatcatgtgggaattggaaaggaggattggtgccatcccttgaagaatttgagtcaagaagcaaggggccaacccccttaagagctattggactaagaagccctccaaattaa

SEQ ID NO: 47195 - DNA, 168 bp, Glycine max
  Peptide Sequence Number=SeqID_138880
atgactgaagcacgtcaaaagggggtacggaaagaaaataggggaggagcttgccacccagctcgcccaggcgacccaagttgcttcctccagaagcaactgccttctggaggaacaatctggaaggcccaactttcggaatgttacggaaactcacggattgcgtaa

SEQ ID NO: 47196 - DNA, 213 bp, Glycine max
  Peptide Sequence Number=SeqID_138881
atgtcaaacaatattgttagaaaatgtgaggggctagcgttggcgattgtgtccattggtggtctattatcaacaaaatctaaaactgtgtttgaatggcaaaaggcagagatgcaacatttgaaagataagctagctatatcagagataacagcaaaggcagagtcaaaattgaaggtaacctatttgtcttccttccatgtaagcatgtaa

SEQ ID NO: 47197 - DNA, 369 bp, Glycine max
  Peptide Sequence Number=SeqID_138882
atggatgaagatcaatggaggtatgacaatataatgtctaaagaagttgatatggattatgaaaatgaacaagaatgtggtgtgaatgaaccacatgttgattgttcggatgcttttactacttctcagataggtagtagagaaagaagttcatttgtgttaattggttgtgaaaggagtggtcagtataggtgtaggaagaaagaatttgttagaagagatactgggagtaggaaatgtgggtgtcccttcaagcttcgtgggaaaccaatgattggagggcaaggttggatggtgaagttaatgtgtgggattcataatcatgaattggccaagtcattgttggacatccatacattgggtgattga

SEQ ID NO: 47198 - DNA, 146 bp, Glycine max
  Peptide Sequence Number=SeqID_138883
gcatggcttttgcaagtggagatgctactccaccatctccaaaaaccgcaaggctcatggcggagatgattaaacttggtgatcaaatgagaaaaatgagttatgacaatgaagaaaatgatggagagaatgagaaaggagaatga

SEQ ID NO: 47199 - DNA, 201 bp, Glycine max
  Peptide Sequence Number=SeqID_138884
atgtggatatggcatggtgaagtgaaagacatgcagagtgggtcccaagctaaatcgtttgatgccaggtatgggtggagtgacaaaagttttacctcactgcttgaggtagtgcacaatctgcttctagaggacaacacgctgcctaaaaattactataaggcgaaaaagatactgtgttcgataggtatggagtattag

SEQ ID NO: 47200 - DNA, 156 bp, Glycine max
  Peptide Sequence Number=SeqID_138885
atggtttttcacttaaggcttgtaatgagcttcaaaacagagaaaagaaaacataggctcaaagggctatcaaagggattaattcaaggaagcatcaacaagaatcaagccaaggctaatgtgcaagcaatcaatggggcaaaacacaccaaatga

SEQ ID NO: 47201 - DNA, 516 bp, Glycine max
  Peptide Sequence Number=SeqID_138886
atgatcgtcgcagttcgaccggagagggtggtacgccagttcggttacatccagagcatccctccgccgcctgttagtgcacgattgtcacaggagcagatagatgacaggtggatggagtttgcggatcacttactacctgcgggtcagccttgtttagtgcctgggcaggtatctgcggattacattgagtggtttttccgcatatctcaccctttcatgacaccgacccaggcagctgaccagcagagggatgcaccagctgcagaccctgaggactacatacagccgcccagcccccaggttccagtggcatttgacccccctccatatgtggatgattacgagggatatgaggcgattgcacagaggttggagcgtgtgctcaaccttaggatagtcactgcaggcacagagttatatgacattatgcaggactgcctgacgatcgcgagagggggacccagtgctgatgggacggtcagggctcgtcagagacgccgcacggaccattga

SEQ ID NO: 47202 - DNA, 342 bp, Glycine max
  Peptide Sequence Number=SeqID_138887
atgggtcagagtaggggctatgcctggggagctgcggccctggttcatatgtatgaccagttagatgaagcttctaagaccacgacacagcagattggggggtaccttactttattacagtactggatctatgagcattttccgagtgtgcatcagtgtgtcaccgatgatgcgtatgaggagatgtccccttgtgcctcccggtggctgacgatgaaggctcatatgaagggaattacaggagcttcgtaccgggcacgttgtgatgctttgacggtcacagacgtgtgctggttgccttacagtgaccatcgaggggttagggggtttgagctgatttaa

SEQ ID NO: 47203 - DNA, 663 bp, Glycine max
  Peptide Sequence Number=SeqID_138888
atggccccgaggaaacttgcctcaaagagatccaggaaggataaaacggccgaaggaactagttccgctcccgagtatgatagtcaccgctttaggagcgctgaacaccagcagcgcttcgaggccatcaagggatggtcatttcttcaggagcgacgcgtccaactcagggacgacgagtacaccgatttccaggaggagatagttcgccggcggtgggcatcgctggtcacccccatggccaagttcgatccatacatagtcctcgaattttatgccaatgcttggccaacagaggagggcgtgcgtgatatgaggtcctgggtaaagggtcagtggatcccgtttgatgcagatgctattggtcagctcctaggatatcctttagtgctggaggagggccaggagtgcgagtatggccagaggaggaaccggtccgatgggttcgatgaggaggccatcgcccagttgctatgtataccggggcaagattttgcccggactgctgccgggagacgggtgcggatcatgtgcaccaacatgaccaccctgactcagatctggatgactttgctgctcagtagcatccagcccagtgatcataattccgacctccccctgccgaagtatcagcttggtgtacgccatcctgaacacggatga

SEQ ID NO: 47204 - DNA, 367 bp, Glycine max
  Peptide Sequence Number=SeqID_138889
atgactagaggaaattcatctgacttacaaccctttgatcctgagatagataggacatttcatagattagttaggcatcattttgtaccttttaatcatcctgagcattccattactagtgagtatgtgcattatgttattggtgattttgaacatcctgattttgagctttataattttgagcattctgattttgaacattctgaaaacatggcacaacctccaccccgtgagaggactctaagggaaatggctgcacctaatttcacctacgaaagcttgtgcatccaataccctgatgaggatgtcatatgtgttcttaaaactggactcctccatttgcttccaaagtttcatggccttgcag

SEQ ID NO: 47205 - DNA, 204 bp, Glycine max
  Peptide Sequence Number=SeqID_138890
atgagccctctgtcccacgcatctaaccagctcgcgtggttcaccggttccaccgaaaactctcatttgttgaagcggagcatagtgcgctttaggcgccgagcgagaaaggtctctttcttctttcgtttcggtttattcactgatctgaaacttagcacttgttttcttattgattccaggggcggcggcgttcttgaatga

SEQ ID NO: 47206 - DNA, 216 bp, Glycine max
  Peptide Sequence Number=SeqID_138891
atggccagtctaataattcgtgactcggcattgaaattcatgcaaacaacgaacatcaaacatcagcaaacaaccaacaccaagcattcaacaaaacaaccagagaatgcacggaaaaacatagcagactcacaactcactggccgaaaggttcgacctgctctgataccactaaatgtaacgacccgggtcgtcgctacggtatccacactctaa

SEQ ID NO: 47207 - DNA, 384 bp, Glycine max
  Peptide Sequence Number=SeqID_138892
atgtcaggatttacacgcaattctcctcaaatttcagccagcccgcatcaattagaccttgcaccttacgcttcagagccctacaatgctcaatggaacgccccagggcttctccatgacaaacacacgttgcgttcgagtcgtattctcggagaaatggaggttgatgaaccttggctagggttatggctaccattgaattatcaagtagatatgggagcaagtggtgttcgtcattggagtgcggtagaagactttgtggttgatttagggatggcctttgtggataaatgggcagcaggaacggcagtcattgcatgggtttctccctcatcctcaccctcttcatttgccccagttttctcattcgtccaagcaggatga

SEQ ID NO: 47208 - DNA, 243 bp, Glycine max
  Peptide Sequence Number=SeqID_138893
atggtttccgtaacattttccgtgaagaatttcgcaaaaggtttctaccggttcttcgacgttcttcattcgttcttcatcgttcttcgatcttcaacgggggccttatacccgggttcatgggaacataaggagtggaggcgaatctgtgatcatgctagtatgttcttcgaagaggataatacctctagaaaccgtcaagagagatatgactaccttggggggttatcgctaaatgcctag

SEQ ID NO: 47209 - DNA, 362 bp, Glycine max
  Peptide Sequence Number=SeqID_138894
atggaagggttagaggacctagcagcgattgacgctttcctcgcctttcatcatggcaagggaagcccggtcgtcgccattttggccatgcatgacacgttcgaccagagatgtgaaaagagcggcgcaaaaattgtttgttgtacaccggctctctatgtgtggctggtttcgcacctttttctccaagaaggtaggcccgtctatccgctacaaggtcaccgctcgattctatcttcatgcgaaggatgtccaaatgttcccttgatgggaacaaggggttgcattaattataatcccgtcctcgccataagacagcttggctaccccatgagaggagtgccatcagacgaaagcatcac

SEQ ID NO: 47210 - DNA, 873 bp, Glycine max
  Peptide Sequence Number=SeqID_138895
atgtcattaaaattaccatattatcctgagttagtacgagtcttttactcaaatttgaaaattcaggatggaactttaatttctgaggtgcatggtatccctatgattattgataagtctattttcttttctctaacacaactacccagtcagggtgcaccttttgagggtacccttgttgacgactggaagtttgattactccagtcatgatgcccgccgcatggtctgcattgaccaggtggatatgaccggtagactgcttgtcgggtcattgacatttgattgtcgcatcatgcactatatcattgttagaattttgatgactcgttcttctaatctcgctcaagcctctgaggaggacttgattctgatgtgggctttcttgaccggtcgtccaatcgactgggcccatttgattcgttaccgcatgcataagaaattgcagtctagtgcacctctaccttaccctcagcttgtgactttatttcttcgacattttgaaattcctttgaattctaagccttttgtgcaagtgaaacgttcctttgctattggtgccgatgtggtaacctccttcggctaccgtaaggacatggattggcaatggttgaagaaggatgcgcaacctccgcaagacaaacatattccctctccttcacctcaacgagatgactcctcagccctcatgcatgaagttctttcggagttacgaggcctccgcacctatgttggtgaatgctttgagaccgtggatggtcgtatcaatgccatagatgctcggtttgaaggactggatacccgcatcactcagcttgaggaggatgtgagttatctttgtcggtgcttcgaccttccatcaccaccttcatag

SEQ ID NO: 47211 - DNA, 453 bp, Glycine max
  Peptide Sequence Number=SeqID_138896
atggaactaatgagactgaatcaatataaggagaatgataagaaaaagaaaggaatcacattgaaagcttcatcttcaattcaagaaggaagtgataaagaagatttgaatgaaatagaggaagacggtgatttcagtttcttcgtaaagaggttcaataaatttctaagaaacaaaggaaatcaaagaagatcaaatttcaaaccaaagaaaagaggagaagattcatcctctcttccaaaatgttatgaatgtaatcaaccaggacatctgagaattgattgccagagtttcaagaaaagaatagaaagatctgaaaagaaaaccttcaatgataagaaagcaaagaaggcttacatcacttgggaagacaacaatatggattcatccgaagactcaaaaaatgaagttgtgaatatgagtctgatggtcaaaaattatgaaaaacgatga

SEQ ID NO: 47212 - DNA, 456 bp, Glycine max
  Peptide Sequence Number=SeqID_138897
atggggatcgcacccacaaagacacccagtgaacctgaagaagtccaacagggccctggggtttccagctctggttacgggcctctatcagtcctacggggtgcccgtacccccgcggcaaggtcacgtcatcatagttctacggagtacctgtcacctccagcaagggcatcaggccccctactaatcgagctttcatcaagaagtactgcgccccagacaggcgcagggcgaaacaccacagcagcattgggatggtcggcagcgggaaacagacgcaccgccatcacctctagagttcacctctactcatccacaaaaaggtttgagtattgcctacacaacatggccgaccagcaggcgaccaagtccaaagccaaaggtaagcaaagtactaggtccgtgacctacaagccatcatgcgtccagctcaagacgttaaagaagcgctactag

SEQ ID NO: 47213 - DNA, 537 bp, Glycine max
  Peptide Sequence Number=SeqID_138898
atggcttccagaaaaagaaagagtattggtacaagacccatagctcagtatgatacaaggaggttccactcttttgaggcttggacccgatacacagataatgttcttggaagacatatactacctaagaggaaggtagaaatataccatactgagctgggcgagtttaaggctgaattggagaggcgtaacttccataaacgcctcaccaatttagttgacaacatcatagatctagctttggtgaaggagttttatgccaacctttacagctccgaagggccttcaccaaagcaagtcagggtcagaggccacttggtgaggattgacgcagacaacctcaacacctttctggagacacctgtggtactagctgagggtgaaaccttacccgcatattccagatactacagaaggccaccctgggaagattctcaggaaagatttaacaactcttgctcaggtgtggactgttctctcatactccaacctggctcctacttcccacaccttagacctgatagtagatcgagctag

SEQ ID NO: 47214 - DNA, 126 bp, Glycine max
  Peptide Sequence Number=SeqID_138899
gatgagtcatccgagacttccactccagagcccctgatcagaaggaagagggtagttgaaacacaagaagttgcagccactcctgagcctccagcaccagtggcagatacaacctcaccgcagtag

SEQ ID NO: 47215 - DNA, 528 bp, Glycine max
  Peptide Sequence Number=SeqID_138900
atggatcaagctggtgaggaaagaaagttgcaactgagtgagttagatgagatccgcctagaagcctacgagaatgccaagttctatcaagcttatcgataccgtcgacctcgagggggggcccggtaccagcttttgttccctttagtgagggttaatttcgagcttggcgtaatcatgctaactcacattaattgcgttgcgctcactgcccgctttccagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggagatacttaa

SEQ ID NO: 47216 - DNA, 251 bp, Glycine max
  Peptide Sequence Number=SeqID_138901
gcccacttgggcccttcggaatattcctccagaaggcggttgcttctggaggaagcaaccctgctcgcctgggcgagctgggcggcaaccacctcccctattttgctataaataggggaggaaggcaagaaggaagggccgaggtgcttccgaaacgtttccgtaacgttttccgtgaggaatttcgcaaagatttcaaccgttcttcgacgttcttcattcgttcttcatcgttcttcgatcttcaacgg

SEQ ID NO: 47217 - DNA, 54 bp, Glycine max
  Peptide Sequence Number=SeqID_138902
aggattcctgaacacaagggaatggttgtcccctatgtggttcagactttgtaa

SEQ ID NO: 47218 - DNA, 1620 bp, Glycine max
  Peptide Sequence Number=SeqID_138903
atggctagatcaccgggtttcgggttctatttcactcccctcgccggggttcttttcgcctttccctcacggtactggttcactatcggtcagtcaggagtatttagccttggaggatggtccccccatattcagacaggatgtcacgtgtcccgccctactcatcgaactcacgacctgtgcattttagtgtacggggctatcaccctttgctgcgcgactttccagacgcttccactaacacacaagccgattcaggttctgggctcctccccgttcgctcgccgctactgggggaatctcggttactcttcattccagtacatctacggaggaatgaatttcagccgtcatgtttcaattttcagcttgttccagattgttaaagagcaatatcttaaacatgactcgaaagggattcgaacccctgttaccgccgtgaaagggcggtgtcctaggcctctagacgaaggggacacgacaccgtacttttatgacgcttttgctcgttactttttcatcagacaatctgtgatccaaccgcaggttcccctacggttaccttgttacgacttcaccccagtcatgaatcacaaagtggtaagcgccctcccgaaggttaagctacctacttcttttgcaacccactcccatggtgtgacgggcgactccaatccggactacgacgtactttatgagggccatgatgacttgacgtcatccccaccttcctccagtttatcactggcagtctcctttgagttcccggccgaaccgctggcaacaaaggataagggcaccaaagcatctctgctaagttctctggatgtcaagagcggtcgatttaacgcgttagctccggaagccacgcctcaagggcacaacctccaaatcgacatcgtttacagcgtggactaccaggtcttcgtccagggggccgccttcgccaccggtattcctccagatctctacgcatttcaccgctacacctggaattctacccccctctacgagactctagcttgccagtttcaaatgcagttcccagtaattccgattaacgcttgcaccctccgtattaccgcggctgctggcacggagttagccggtgcttcttctgcgagtaacgagtctggaccgtgtctcagttccagtgtggctggtcatcctctcagaccagctagggatcgtcgcctaggtgagccattaccccacctactagctaatcccatctgggcacatctgatggcaagaggcccgaaggtccccctctttggtcttgcgacgttatgcggcagtttcccagacattactcacccgtccgccgctcgtcacccaggagcaagctcccctgtgctaccgctcgacttgcatagacttggtattcatttttcgtcttgcgacgttaagaatccatgtcactttgagtgcccacacagattgtctgataaattgttagagagcagttgcaacgcggctttcgctcaccgttgcgaggtggcgtatattacgctttcctctttcagagtcaacccgttatttcaggattttttctcttcaaccgaccgggctgtttgtgaagtgattcacatccgccgtgtcgatggaggcgcattatag

SEQ ID NO: 47219 - DNA, 1277 bp, Glycine max
  Peptide Sequence Number=SeqID_138904
ggtaagccaaccaatttctgggcattgtcgcttccgcgtgaaacgtcaatctatgtcccgaaaatgctggcgctgagcgacatcatcaagaacagcaagaagtacggtgtgaaactcccgaaaacggatgaaacccgtgcgctggcgcgtatcgatgtcgggcagcagatccagctgactcaggcggctgagatggcggggctttcagtcaccaagatgaaagcgtataacccaggctacaaaaaaggcgttacggcacccaacgggccccattacatcatggttcccaaaggacatgccgagcaactgaaagactcgctggccgatggccagatcgccgtgactcagccaacgacgcagttggcgaagaacagcggtttgaccggtggcagttcgtataaagtgcgctccggcgacaccttatcgggcattgccaagcggctgaacgttaagaccagcgatttgcagagttggaacaacttacgcgccaagagcgccataaaagttgggcaaaccctgcaagtggccagcaatactggcggtaacagcagtattacctatcaggttcgtaaaggtgattcgcttgccagtatcgcacgtcgtcacggcgtcgatattaacgacgtgatgcgttggaattcaacgctcggtaaaggcaacagccttcaacccgacgggagaatctttttccgggtggaactccaccaacagcggattgtgatccgacgcgctggtcaccagtaccgacgcctctacgaccccaagattgcgataaaacacaaagtccagcgggcggccaaaagccttacggcggtgatcgtcggcgaagctcacttcgcgcagcgccatctcaccggcaaagtcatacaaggcattgatacgtttgcggctccaggcgttgaagtccccggccatgatcaccggcccccggtggctggcgatctgctcgccgatcggccccagctgcttgctgtagacgtcgactcccagactaaagttcaccgcatggatgttcaccaccatcaacagctcgccgttatacagcggataaacggtgatcagggccgacttggacagccgcagcagcggctctcgctcgcgcagcgggcagcagtaaaccggatgagcggccgccagcgtcatcacgccggaagggtgctgcggcaacacaaaggccggcacctgatcggccgccagatagttggcggtagcgtagctcaccagctccggcgtagtttgcgcttcttgcaacagcaccagctgcgcatctttgcatg

SEQ ID NO: 47220 - DNA, 438 bp, Glycine max
  Peptide Sequence Number=SeqID_138905
atggcgttcaaaaaatcgtctccggcgtgcttaccgctcaaccctgacaaatcaaggcttgcagagcatgccgcccggatgatacagatttatactgcgtcgcacccagggcaggactttttgggtatgaaaagtgtaaaaattagcctggcttggcaaatcctgatcgcgttggtgctgggtattattgttggcgcggtattgcacaaccagaccgaatctcgtgagtggctggtgagtaatattctcagcccggcgggcgatatctttattcgtctgatcaagatgattgtggtgccgatcgttatttccacgctgatcgtcggtattgccggtgtgggcgatgcgaaaaagctgggccgcatcggattgaaaaccattatctacttcgaagtgatcaccaccgtcgccatcgtggtggggttgacgttggccaac

SEQ ID NO: 47221 - DNA, 402 bp, Glycine max
  Peptide Sequence Number=SeqID_138906
atgacggaaaaccttcacgactttgctcacgaaaatgtctcagaagctttacggaagcacctcagcttggattttcttcacggaaacaatttttttcacccaaaacagctgaaatgcatagccaagggggttagggatatttggaacagcatcccttcgcctattcataggaaaatgggggaggaagttgccgcccaaatcgcccgggggagctgggttgcttcctccataaaatgttgcgggactttacggattacgcaacaatgctctttttggcttccggaatattgtggatctttacggattgagcattccattgagcattgtatgaccctgaaacataagatgcaaggtctgattgatgtaggctggctaagatttgaggaggagaatcgcttgtga

SEQ ID NO: 47222 - DNA, 291 bp, Glycine max
  Peptide Sequence Number=SeqID_138907
atgacagccaccgttttaggagtgctgagcaccagcagcgctacgaggccatcaagggatgatcattcctccgggagcgacgcgtccagctcagggacgacgaaggagggcgtgcgagatatgcgatcctgggtgaggggtcagtggatcccgttcgatgcggatgctctcagccagttcttgggataccctttagtgctggaagagggccaggaatgcgagtatggccagaggaggaaccggtccgatggttcgatgaggagccatcgcccaggggatcctctagagtga

SEQ ID NO: 47223 - DNA, 69 bp, Glycine max
  Peptide Sequence Number=SeqID_138908
atggaagagaagcttgcttgtgaggcttctatggagactggatctttaagcttcaatgaggtcctttaa

SEQ ID NO: 47224 - DNA, 257 bp, Glycine max
  Peptide Sequence Number=SeqID_138909
gccatgataaagtcaagtttggtgttgaagaagttagagatgcagatgctctcattcctatacccactgaagaggttcaattagtggggcagacacttaacaccttcgttgcttggctgacacattttgtgaagcgtttatcagaacaaggagctgtgggatcggcgaaacctacagataggccagatcatgatgtcgatgatcccctatatctgatgatattgactatcccacaactttttcttaagccgttgtag

SEQ ID NO: 47225 - DNA, 678 bp, Glycine max
  Peptide Sequence Number=SeqID_138910
atggtcattgaccaatccctattctatgacttgacccaattatctagtgagggtgtaccatttgaaggtgcactaaatgatgattggaaatttgatttctctgtgcatgatgcccgctggttggtttgtaccaaccaagcggatatgactggaaggctacttgctggatcattggcttttgaaagccgtatccttcactatctcattgtgcatattttacttccaagatcttcaaaccttgcacaggtttctgaagaagatcttattgtcatgtgggcttttcatactggccgacaaattgattgggcacacttagtccgatatcgcatgcataaggcattgcgattaaatgctccattgccatatccacatctagtcactctcttccttcaacactttaacattcctcttgattctgaaccttatgttccaatcaagagatcctttttgattggtgctgctgtgattgcatcttttggttaccgcaaagagcatgatggctcttgggtaaaaaagggtgctcaacccattgatgatgaaggaaacttaccagttggagaggattcctctctccttcagaaaattttggacaggttcgatggtcttcaaacctatgttggtgaaaggtttgatgctttggaactacaagtggacatgcgattcaacgagatggactaa

SEQ ID NO: 47226 - DNA, 445 bp, Glycine max
  Peptide Sequence Number=SeqID_138911
atgggaaagttggatcatctagaggaaaggctcagggccattgaaggaggtgaagattatgcctttgctaacctaaaagagttgttcctagaacccaatatcatcacccctcccaagttcaaggtgctggaccttgacaagtacaaggggactatttgtcccaagaaccatctaaagatgcagtatcagtacaattttgatatggttccggataggatgcaactacagaacatttgcaaaaagggggacggatctttcaaagaacatgcccaaaaggtggagggatctggcggcccaggtggtacccccaatgatggaaagggagacgatgatcgtgatggcaaatttgatcatcctactaggacgactgagaaaactggggcaaatgaagagggtgagaaagagggagaaacccatgctgtgactgccattcctatacggccaa

SEQ ID NO: 47227 - DNA, 156 bp, Glycine max
  Peptide Sequence Number=SeqID_138912
atagaggtagcaaaagaacatcacctagatgaagatgctgtgataccacatgatgtagctccatgtagagcttataggccttggatattcttcattaatgaagtatttttcttcttgaatatcaatgaaagcggaatggagaaggagaaaaggtga

SEQ ID NO: 47228 - DNA, 132 bp, Glycine max
  Peptide Sequence Number=SeqID_138913
cttctcgttaagccaatctgccggcttagcgatccatctgctaagtgcaccactcttgcagctgagcgcgaggaagtatctggaagaaggatgagctggacacatgcgataagcgagcactcatcctgctaa

SEQ ID NO: 47229 - DNA, 528 bp, Glycine max
  Peptide Sequence Number=SeqID_138914
atgaagagtttacatctggtgacatgtaatcgattacaccttgatgatatttctgattcatttctcaacatctttctaagagtttttgttaaatactttctcttccaagaaaatttcattgttaaaaaacttgtgctattcatcttcttcattcacttctccctttgccaaaagaataaaaggactaaccggggtacatccacttggttgttcaaagagacaagggagggtacatcccttgtggatctttggcttgtaaaggattttacaaggttgaaagaaatctcaagaaccattggttgcttggggactggatgtaggcaccgattgtggccgaaccagtataaatcttgtgtagctgctgccacacctgagcgatcccttgaggctacttcagagccttctgcacaaggggagggcataccttcacctcagcctacagcagacccctccactccttttctagagatgttagaggacccgactacaccagtcctggctatggacacttctcctccagctacttca

SEQ ID NO: 47230 - DNA, 419 bp, Glycine max
  Peptide Sequence Number=SeqID_138915
gcaagactcgccaaagaaaaattcaagtcagctgctacacacatcccggaaggagtgcaccgagttacgagagggaaacgcggccactgcaagagcccttgtacaagaaaccaaaagggccccgcaaggaggaacatgggtcgagagaaatttcgaggagctttctggggtagcaacaatgagctcaagctccgaagagaggaaagagaccggtcacgggtccaagaggagtttggctcaacacttggaagccacggagcaaagcatgctagctatcatagggcaatacaagagttgaaccagtctgtgacccatgaacaaaagctagtggaggattttgcacaagtgtacgccgaaaaagaagcaagagggagggtgattgatgcattgcatcaagaagcgactatgtggatggatag

SEQ ID NO: 47231 - DNA, 552 bp, Glycine max
  Peptide Sequence Number=SeqID_138916
atgagtaggagggcgcggcgggtcgctgcaaaacccagggcgcgagcccgggcggagcggtcgtcggtgcagatcttggtggtagtagcaaatattcaaatgagaactttgaaggccgaagaggggaaaggttccatcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 47232 - DNA, 843 bp, Glycine max
  Peptide Sequence Number=SeqID_138917
atggcgtgcaaacatcgccatcgaccggctgcgcgccgaacggccgttcagcgccaccgacgtcgtgctcgaagacgtcgaggacgcggcgcccggcccgctgcgcatcgcgcaggcgcgctcgtcgatgcgcggactgatgcgcctgatcgaggccttgccgcggcaacagcgcgagatctacatcggcgtgcgcatcgagggcatgctgcaaagcgaggcagcggcgcgctacggggtgtccggccgcattgtcaggcgccatctgcgcgatgcccgccagcatgtcgaaagccaggcggcccggttgcaggcatgaacggtcgcgccgtcgcccggccttcgagcgccgcgccggcgctcccggcacgctcgcggcggacgcagcgcggcttcacgctgatcgagttgatggtggtgctggtgatcgtgggcgtggccaccgccgcgcttggcctgagcatccgctccgacccggcgcgccaattgcgcgatgacgcccagcggctggtcgaacggctggcggcggcgcaaagcgaggtgcgcatcgatggccgcgcgatcgcctggcaggccgacgccgacggctaccgtttcgtgcgcggcgcctggatgctggacgggccggtgccggtgctggacccgacgcgcatcgacgatttcccgcgcgatccggcgctgcggccgcggcaatggcaggcgggaccggtgcgggtggcgcccgccgtgccggtgctgctgaccccggagtggttcgggcagccgtggcgcctgacgctgtccagcgcggcggggcgggtcgaagtgcgccgcgatgccaacggccgcttcctggtccaatga

SEQ ID NO: 47233 - DNA, 594 bp, Glycine max
  Peptide Sequence Number=SeqID_138918
atggctgagaagataaagaaaagactggaggaagttgcccagtccggaagcactgagggcgtcattgaccctccatctcccatcagacgccatgcgaagtggaagatggcccgcaccaagaaaactgggcgtcacagggatcagaaccctagccatgtccgtcctgctggagccatagctgacccaacaaatcagagaccatctggaggagtcgatcacagaaaaagtgacttggcaggtgatggcatccttcagccagatgcaatcccagtttcagtctcagatgcaatcacaaggacttgcattgcctccggagccatagggaacgatccagagacgggtgactcagacaaatgcgggctgtacattaaagaaaatccttcccacctggttgtcctaggaaaactttatgagggatacacagcggttcacaacatccctttgttgcatggccaagtgaaggttggtgttgaggaggttaaagatgcagaggcttctgttcctgtacccactgacgaggttgccttagtggggcaggcacttaaaaccttccttgcttggctgacacatctcgtgaagcgtttatcagaacaa

SEQ ID NO: 47234 - DNA, 396 bp, Glycine max
  Peptide Sequence Number=SeqID_138919
atgcattttgttattggtgattttgaacatcctgattttgagcattacaattttgagcattctgattttgaacattttgagaacatggcacaacctccaccccgtgagaggactctaagggaaatggttgcacctgatttcacctacgaaagcttgtgcatccaataccctgatgaggatgtcccatatgttcttaaaactggactgatccatatgcttccaaaatttcatggccttgcaggaccacgaccatcaggaaggacatctcagttgccctcaccatcagatttcggagcagcttcttctcctaatttttatgaaggactcagtaatatggagagaagtatgatagatgttgtcagtggtagagcccttggagacatcgactcctgctga

SEQ ID NO: 47235 - DNA, 519 bp, Glycine max
  Peptide Sequence Number=SeqID_138920
atgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggctttcgggcgcaacttgcgttcaaagactcgatggttcacgggattctgcaattcacaccaagtatcgcatttcgctacgttcttcatcgatgcaagagccgagatatccgttgccgagagtcattatttgagttccttggcgcacgaagcgccggggtttgtgtttgtcgcgaggacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 47236 - DNA, 93 bp, Glycine max
  Peptide Sequence Number=SeqID_138921
atggctctcggtcattcggcctggcgcgtcgttttaccttttgctgttcgtctgcttcctggtcatgaccatgctggtcggcctggtgtataa

SEQ ID NO: 47237 - DNA, 315 bp, Glycine max
  Peptide Sequence Number=SeqID_138922
atgggcgaatggctggcgcagcggcgtgatgagggattagtgacggatatccctgattctgcaccgcacggtgtatctgttctgcaccctgctaccgttcgcgctggtggcggatttgcacctgatgacgccgctggtgtcggtgtttatttcgtatacctttttgtcgctggagtcgctggcggaggagctggaagatccgttcggcaccgcgcccaatcatctgccgctggacgcgctgtgcgtgaatatcgaacgcaatctgaaagcgatgaacaacgatttcccgctgccggcagcgagccagccggaccg

SEQ ID NO: 47238 - DNA, 549 bp, Glycine max
  Peptide Sequence Number=SeqID_138923
gaacacgctttacggtgcccttaccgaacccgtgctagagctagagtaatgggtgaagtggaggaggtgcaagagcagatgaaggccgacatagaggccatgaaagagcaaatggccacaatgatggaggccatgatgagcatgaagaagataatggaagccaatgcgattgtagttgcccctaccagcactgttgctaagttgggaggtacgggcggcccccattatgtgaaaattcaaaacaagcacgccttctcgccatatggcttgcctcccaactatacgccacccaatgtggcgtacactcccaatgagaatgtcaataactccacttctatactcattgagagccaacaacctcaatttgatcatgcgcatgtctctcaacccatgggggagacacatgaaatgccccaacacaatctagtaaactttgagccttgcctcagatatgccactgaaggggaagcagatggtggtatacccctgcaaaacactttggagggccctcagtatcacccagaagcagacccctcacattccacagcg

SEQ ID NO: 47239 - DNA, 570 bp, Glycine max
  Peptide Sequence Number=SeqID_138924
cgagaattcgctaagcgcaatcttcagtggctaagcgcgaggaagaatccagaagatgagctatcaagttcgctaagcgcactgctccagatttgcgctaagcgcacaagcacgaacaaggccacctgcttaagcctgaaatcagatttgcaaagggagtttgacacttttcttgagaagctttgcatgcgcgaaggttctagagagagaaaggtccaagttccggagagttctgagagattttgctatgtgaagatctacagagacgcgagtttgaagtggaagccgaggtttctggactatggaaagctaaatcctctgttggatcttccctggtgcttttaccttgatcacatagatgcatgctttgttagggtcattcaacaatggaaactggaatcggggtacaagaacttagttgtgtatgtgtgtcttaatgcggtcttggttgagtttagtcttacaagaggaatctacggacgaggcttgatcaggactaggctaggctatcatgaggaatcgaggtctagcagtctaggagacagcataggaacgcatgagcattgttaa

SEQ ID NO: 47240 - DNA, 141 bp, Glycine max
  Peptide Sequence Number=SeqID_138925
atggatacctcaaagccttacactagggcaatgaggggcatcgtgcatgagcctcaagttcccagctacaaggtcatgaagaaagataacaactggtacctcaaagccttacattggggcaatgaggggcatcgtgcgtga

SEQ ID NO: 47241 - DNA, 294 bp, Glycine max
  Peptide Sequence Number=SeqID_138926
atggaggaacaggcctcacaggattccatggaggaacaggcctcacaggattcctttgtcgcccatggacaacaccctggtcgtgtgcgtgctgctggagccaatgtcacgatcaaacaatactttggaccgactccaagaacctcccacacatcttcgtccattgctccgaaagacatggagcagttgacgcaaaaaatcagggaccagctggaggagtcgatcacagaaaaaccagatgcaatcccaatttcaatcgtagatgcaatctcaggtactcgcactacctcctga

SEQ ID NO: 47242 - DNA, 336 bp, Glycine max
  Peptide Sequence Number=SeqID_138927
atgaatgaagtcctctccgaattacggggtcttcgttcttatgttggtgaccgcttcgactcattagatacacgctttgccggtatggacattcacctcacacaacttgaagaggatgacttgtattgtcatcatcaaaaagggagagattgtagatgcaaatgtctttggtgttttgatgatgatcatgatgatatgatgcaattaatgcaaatgggcttttcaagtttaaattcaagacaatacttcaagattacaagtcacaacatcaagatgatcactagtatattaggaagggaattcctaattgaattagcaaaaggtttggccaagtaa

SEQ ID NO: 47243 - DNA, 345 bp, Glycine max
  Peptide Sequence Number=SeqID_138928
aatgtttatacagataaccactcgggtatttgcgcccgtcagcgtgactcaaacgtcagtatgacagatcttgtgagcgcagaagatgaccaaaagaaagtttatacggataaccactcgggtatttccgcccgtcagcgtgactcaaatgtcagtatgacagatcttgtgagcgcggaagatgaccaaaagaaagtttatacggataaccactcgggtattttcgcccgtcaacgtgactcaaatgtcagtatgacagatcttgtgagggtggccgacaaaagcaaggctcttgctcctacgtatcctcaaatgaggaactcaaacctacgtagttctggataa

SEQ ID NO: 47244 - DNA, 951 bp, Glycine max
  Peptide Sequence Number=SeqID_138929
atgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagaccgatcgctgagataggtgcctcactgattaagcattgcgtcagaccccgtagaaaagatcaaaggatcttcttgagatccttttgttctgcgcgtaatctgctgcttgcaaacgtgaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataa

SEQ ID NO: 47245 - DNA, 312 bp, Glycine max
  Peptide Sequence Number=SeqID_138930
atgccacttcgaaagaaaagtgaatcggagagatctttgaacagcagaaaagacggatctcagaacatagccatagttacggtttcagggcttagagagactggactggacgcgtaccgaacgaagatcgtgtctatttacgctcaaacaatccatataggtggaaagctggaagcttcaatagttccccgcgggaccttagagtgctatgatggggtatttcagttcgtccttacgagtccattcgaccatagcgtgatgagcactttacgtccccccgctcgccttcagctcacctggtcctttacttga

SEQ ID NO: 47246 - DNA, 480 bp, Glycine max
  Peptide Sequence Number=SeqID_138931
atgggtgaagtagaggaggtgcaagagcagatgaaggccgacatggaggccatgaaagtgcaaatggccacaacgatggaggccatgatgagcatgaagaagataatggaagccaatgcggttgcagttgccactactagggctgttgctaagtacggatggccccatgatgtgcaaattcaaaataagtacaccttcccaccatatggcttgcctcccaaggaggatgtcaataactccgctcccatactcattgaaagccaacaacctcaatctgaccatacacatgtctctcaacccatgggggaaacacatggaatgccccaccacaatctagccgacttcgagccttgcctcagatcgattaaaaaccctcatgctatggcagaaatgggaaaagtggatcatctaaaggaaaggctcagggccattgaagaaggtgaagattatgcctttgctaacctgaagagttattcctaa

SEQ ID NO: 47247 - DNA, 327 bp, Glycine max
  Peptide Sequence Number=SeqID_138932
gtaccaccacatgtggaggatgagtcatccgaggacaccattctagagcctttcattgtagaggaggaggtaggtgagacacaggttagacaggaagctgctgctactcctgagagatctcttgagggcactatagagcctcctgcaccagtggtggacctatcctcgcctcagcatgcaacagaccccttcactgagataccagaggatccgatcacaccagtccttactctgaacacttctcctcgagctactctagtacttcatctgacagataaggaggatgttcagacacaagatactcaggaccagtcacaggaattctaa

SEQ ID NO: 47248 - DNA, 498 bp, Glycine max
  Peptide Sequence Number=SeqID_138933
atggagaggagtatgattgatgctaccaatggtggagctcttggtgatatgacccctgctaaagctaggaatttgattgagaagatgacttccaactcccaacaattcagtgcaagaaatgatgctattgttcttagacgagtctatgaggtggccacagattcatcttcatctactgaaaataaaaagcttgaaggaaaactagatgccttggtcaacctagtaactcagcttgccatgaatcagaaatctacacctgttgcaagagtttgtgatttgtgttcttctgcagatcaccatacagatctctatccttctttacaacaatctgaagtcaatgagcaacctaaaacttatgctacaaacatttataatagacctcctcagcagcaaaaccaacaacaacagaataattatgacctttcaagcaatagatacaatccaggttggaggaatcatccaaatctgagatggacaagtcctccacaacaacaatag

SEQ ID NO: 47249 - DNA, 588 bp, Glycine max
  Peptide Sequence Number=SeqID_138934
atgctttcctcgcatatcaccatagcaaggaaagtccagtggtggctatcttggcagatttgtttaacacctttgaccggagacacgagacacccgtgtccgcttcaaagctatcgctcatgcgccgaaaaaggaagagtcgattgggaccaacatttggctgggatagggggcagcgcgatcaattggtttcctcgttggaaggaaggcaaggaaggagttcttttctcgtgtggggactaccctaatgttccactaatagggactaggggttgtattaattataatcccgcactcgccataagacagctagggtatcccatgaggggagcgccaaccgaagaaagtctctcgcctttccttgtgagggatctaggcgcgcaaggtctcaaggttatacaaagaatccacaaggcgtggaggaatccattgaagaaagacaaggagcttaggggcatccgaaatggcgtcattggaggttatcatggatggctaagaattcatgcgcgagggttagattggctctccaaattgaaagttatcgatgaggagaatttcgaagctccggaggaagatgaagaagtctga

SEQ ID NO: 47250 - DNA, 138 bp, Glycine max
  Peptide Sequence Number=SeqID_138935
atggccaagaaaggggttttcagaccttatcgtgttgaggaaagaatccatgagtatcaagaacctctggatttgaggtcaaatccttttcaagggggagggaatgatgcaatcctatcccccaagggcattggatag

SEQ ID NO: 47251 - DNA, 240 bp, Glycine max
  Peptide Sequence Number=SeqID_138936
atgacgttagtctctgcgtgctatcatgctttgattcttagagatagcaaaagaaagtttaaatggataaccactcgggtatcttcgcatgtcactgactcgagtgtcctggatgacagaaattcgtctgcgcggaagatgcataaatctccgcgtgtcatcgggcttgttggccgcggattgacaaagggtgcagaagacgacgttagtctctgcgtgctatcatgctttgagtcttaa

SEQ ID NO: 47252 - DNA, 450 bp, Glycine max
  misc_feature (441)..(441): n is a, c, g, or t
  Peptide Sequence Number=SeqID_138937
atgaaaactgaggaggacgagctggaagaggaggtcgccctcaatgttcttactgctgactatcaagagtatctccagctaaaagctgccaaggaatctcaaacatcatctgctataagtggtcataactccactacttgcacttcccaatttggtaataatcaaagtccatggataattgattcaagtgcttctgatcacattgctggtaatagttctttattttcatccctctctcctcctaaaattcctcatttcattactttagccgatggttctagagttgcagcaacaagaatcagccatgaatgtggtacgagtcggacgattggcataggacatgaatctcacggtctttactatctcaagcctaatctttcttgggtttgcaatgctgccacatcaccaaagctctttcatgaaagtttgggacacccacantttatctaa

SEQ ID NO: 47253 - DNA, 418 bp, Glycine max
  Peptide Sequence Number=SeqID_138938
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagatgcgaccatggactccattatcggtggtgaagagcgggagcaagcggataagaaagagagcatcgtgaacgtggttcagtcttggctcgtgtga

SEQ ID NO: 47254 - DNA, 210 bp, Glycine max
  Peptide Sequence Number=SeqID_138939
atgggggcatacgcaaaagatgagaaattactgatacattccttccaagaaagtcttactggggtagctgttacctgtgtcagtataatggcttcagataggatgcaactacataacatgtgcaaaaagggggcacagatctttcaaagaatatgcccaaaggtggagggatctggcagcccaagtgtttccctcaatgacgaagaatga

SEQ ID NO: 47255 - DNA, 573 bp, Glycine max
  Peptide Sequence Number=SeqID_138940
atggcagagccatcgaagaagcgaaagggatcatcctccaccgccgctgctgctgcccattgccgccacggaccatctaaagcatccacagcacctattcatccatctttatcatctctaagatcatccacattgttttcttccgatgatcaggcgtctacggatggcattattatttctgaggtgcatggtattcctatggtcattgatcagtcattgttcttttctttaactaatttacccagtcaaggtgcaccttttgagggcaccattgttgatgactggaaatttgattattcgagtcatgatgctcatcgtatggtctgcaatgatcaagctgaaatgaccggtagattgttggccgggtcattaacatttgataatcgcatcatgcactatataattgttagaattttgcttcctcggtcttcaaatttagcacaagcctctgaggaggatttgattcttatgtgggcttttcttaccggtcgtcagatcgactgggcccatttggttcggtaccgaatgcataaggcattcgggccaatgcacctctcccttatccacatttga

SEQ ID NO: 47256 - DNA, 183 bp, Glycine max
  Peptide Sequence Number=SeqID_138941
atgccacttcaaggagaagatgagtctagaagaaggttaccaccacaggaagccatggataagagcttgaaggtaggagaagatgaatggagggagaggaagagaaggaacacaaaattttgtgcctcaaaagagcccactaatcctagatcaagtccaagattctccactaagtgtgcttag

SEQ ID NO: 47257 - DNA, 582 bp, Glycine max
  Peptide Sequence Number=SeqID_138942
atctacccccaagaagatggacaaccattagtggttaaagagaagtgtaaggaggtaagtgtctcctccaagaggttagctaagaaggaaactcattttacaataaagacaaacattaaagaaacttttcctcttagacaacctccacattttctcttttgtaaaaagacacttgttagcactgccacacctcttgggcttgaggttattcatcaagtaaaggagttgttggatgagggtttggttcgtaagagcttaaatccttatgctttgttggtgcccaaaataggggttcccacgaaccctaagagaataaaggtcattcctgattggccccctccaccaacaccactcattgagttggtgaggaaccatgttccctcatggaaagatgtccatgaaaggggttttcagaccttaccttactctaaaatacccaacaccactaatacatatgtttttattatttttacaagtgtcgagggaaggagcctagagtatgaagaacctcgggatttgaggtcaaatcctttacaaggtggaggggatgatgcaatcctaccccccaagagtattggatag

SEQ ID NO: 47258 - DNA, 1353 bp, Glycine max
  Peptide Sequence Number=SeqID_138943
gcgcgttgggcatcagccagtccagcgtggtgaagttcagccagaagctcggcttcaagggctacccggacctgaagtactcgatcggccaggacgtggctcgcgccggtgccaatccacaacaggcccccagcgaacccgacagcggcgatgactacctgcgcctgggcgacgccctgcgccgcagcaaggcgcaggccgaagaggaaacccgccaggccaacccacgcgaggaaatcgagcgcatcgtgcagctgctcgacggcgcaccgaagctgttcgtccatggcctgggtgacgatggcctgttcgcccgcgagttcgccatgcggctgtcactgctcggcctgctggtagtgccgcataccgacccgatcctgatgctggccaatctgtcggccgcacgcccgggcgatgcgctgctgatgttctccgagttcggcaacctgccccagctttcgcagctgtcacggcaattccaggacatgggtggcaaggtgatttccatcacccgccacaccgccaacccgctgcgcgcgcatgctgatgctgcgctggtggtgtgtgcgcacgatcgcacgccgcaggtcgcgcagctgctgtaccgtagcgccatgcacgccctgctcgatttcctgttcgtgctgctctgccacaccaatccggatcgccagcagcagcttggcggtgaacctggagcggatcgaccacctgctggattcctgaccggagcgcacgttgatgaatcgctggtccgccttgccactactgcactgctgcttgctgcggcggtgtccgttcacgcggcgccgctggatggcgcacgccagctgatcgtggtcaccagcgaaggctgggacagcaccgaggggcaactgcaggcctatgcgcgtgatggcaagggctggcatgcacatgggcaggcgttcccggttgcgctcggccgcaccggcagcgcttggggactgggcctgcatccggcacaggccgatggcccgcagaagcaggaaggggacggtcgcagcccggccggcatattcgcgctcggcagtgcgttcggctatgccgtcacccgccccggcaccgcgatgccctaccagccgatgctggacagcagctactgcatggacgtgcccggttcgccgttctacaaccgcatcgtcgatgagaagaaagtcggcagtgcggcggtcaagggctccaccgagccaatgcggctggacctgcacaacaagggcgacgtgcgctaccgggaaggcttcgtcatcgcccacaacccggacaaccagcccggcaagggcagctgcatcttcgcccacctgtggcgcacgcccggtgaggccaccgccggct

SEQ ID NO: 47259 - DNA, 983 bp, Glycine max
  Peptide Sequence Number=SeqID_138944
atgatcaatgtctatggtacaactctcaattttcttctaggatcatcttagaccctaagtacctagacacaaatttctttaatgatgagacatttgactgttatcaagtgtttcaaaactctggattggttgattttatgtccttaaaattgccttactatcctgaacttgttaaagtcttttacagcaatttaaaaattcaggatggcattatttcttctaaggtgtatggtatttctatgatcattgatcaatctctgttcttttcattgactaaattacctagtcaaggtgcaccttttgagcgcaccattgttgatgactggaaattcgactattctagtcatgatgctcatggtatggtttgtaatgaccaggctgaaatgatcggtagattgctggccagatcattaaactttgattttcgcataatgcactatattattgttataattttgcttccccgttcttctaatttggctcaagcctctgaggaggacttgattttgatgtgggctttccttaccggtcgtcagattgactacgctcacttggttaggtaccgaatgcataaggcattatgggccaatgcacctcttccgtatcctcagttggtcaccctttttctccatcattttcaaattcctcttgatgatgaaccttttgttcaagtcaagcgattttttgctataggtgctggtgcaatcacttcatttggttgccgtaaggatcgtaatggtcaatggctgaagaaggatgcgctacctccgcaagacgagcgtactccctctcctactcctcaacgagatgattcctccacccttctgactgaagttctttcagagttacgaggcctccgcacctatgttggtgctggtgcaatcacttcatttggttgccgtaaggatcgtaatggtcaatggctgaagaaggatgcgctacctccgcaagacgagcgtactccctctcctactcctcaatga

SEQ ID NO: 47260 - DNA, 384 bp, Glycine max
  Peptide Sequence Number=SeqID_138945
atgaaagaattgagaagaggaagaaatgcttcctatggtagtcatgagtcttgtaaaagtttgagtgaagagttaagtgactactatggagggaggcataggtcttatacaagacctcactcccaaagaagagaaaatgatagaaggtctcaagaggaaatgaaggttgagcaactctttgcttgccatcatattagtgaagagagaagagttccattggctacctttagcttccaagggtatgccctctattggttaacttccgtagttagggaaagaaggattcttgggaatcctccggcggagaattggaatgatcttaagagtgcccttaggaagaggcacattccctttgatgtgtcattattttctcctatttcttaa

SEQ ID NO: 47261 - DNA, 297 bp, Glycine max
  Peptide Sequence Number=SeqID_138946
atggtcaaattacatttgttgaatacaattctctttgctgtcaatgctactgttgaatgtacaataaatattatttcccagatctcattgttagaggaatgtgagtttcttgagagagctctggaggagttgcacataaaagaatctaaaattgttgataaacttgtatacaaagaacaagaggtttcacttatagtaaagcttggtcacctagaagaaggcgaagctttgtaccgggcattactttccatgaatcctgataattataggcgatctctgttgccacatatattttag

SEQ ID NO: 47262 - DNA, 811 bp, Glycine max
  Peptide Sequence Number=SeqID_138947
gctacacgccctcacctttagaggaccacacgtcctcaccttcagagggctacacgccctcgccatcagaggactgcatgtcgtcacgttcagagggctgcacgcccttgccatcagaggactgcatgtcctcaccttcgtagggctacacgccctcacctttagaggactacacgtcctcgccaatagagggctgcacgccctcaccttgagaggactacacgtcctcgccaacagagggctgcacgccctcaccttgagaggactactcgtcctcgccttgagaggactacacgtcctcaccatcagagggctgcacgccctcacctccagaggactacacgtcctcgccttgagagggctacctgccctcgccttgggtactagttactctcacctccagaggactacatgtcctcgccttcagaggactacacgtcctcgccttcaaagggtcatgtaccttcaacttcagaggactacacgtcctcgccgtcaaagggtcatgtacgttcacctttgtagggctacacgccctcaccttccgaggactacatgtcctcatcttcagaggactacatgtccttaccttcagagggctacgcgccctcgccttcgtagggctacacgccctcaccttccgaggactacatgtcctcaccttcagagggctacgcgccctcgccttcgtagggctacacgccctcaccatcagaggactgcatgtcctcaccttcagagggctacacgccctcgccatcagaggaccacacgtcctcaccttcgtagggctacacgccctcacctttag

SEQ ID NO: 47263 - DNA, 825 bp, Glycine max
  Peptide Sequence Number=SeqID_138948
atggatgagaagagaaagaaaaaactagaggaagctactcaatccggaagcactgacaccgtcattgatccttcatctcccatcaaacgacacgtgaagtggaagctagcccggaccaagaaaactggtgacatgacatctgaagcagcaaaggaaatttgtgacaagattgatgcgcttgaggagcaggcctcacagggttcctttgttacctatggacgtcatgatatactgactgctgccattgggcgaccagaacaccctggtcgtgtgcgtgctgtaggagccgttgacgcaacaaatcaaggaccaactggaggattcaatcacagaaaaagtcacttgacggcgctgcctcctgaacctaatgttggtccttcagctactcgtgtcaacacaaaggagagttgtgttgatccctcagggaacgatccagacaccggtgactcatacaaatgcgggttgtatattgaagaatatccttctcgcctggttgccctaggaagagtttatgagggatccacaaccattcacaacattccttacttggccgacacatcttgtcaagcgtttatcagaacaggagttgtgggacccacgaaacctgcagataggccggatgatgaggtcgatgatcccctatatctaatgacattgaccatcccacagctttttttgaagccattgcaggttatgtgggatgctaccttgtttgacctgtttaatgaaaacttccccttgtacataaagcttgaagatcggtctgaaattgcacacgatggtcaatgtctcagcatatctgttatacagttgtggattctgtaa

SEQ ID NO: 47264 - DNA, 876 bp, Glycine max
  Peptide Sequence Number=SeqID_138949
atgggaacaaatcaaaccgacaagaggttctaccaagtcaaggttaaaagcttagataccaccagcatcaaggaattagggcggttgatggaacctctccaaatgcaagctttccgcaagacttacggaaaaatcttagagttgaccttagcagaggatgtcctctcgggggaaggaaaccatatcttcatccgggtgtctccctctttgagcagaattgcaactgtggtcaaggattcagcaagaggtttggaccgcataaaacagactcggaatggcatagcgggcctaccacgagggtacctagaagacaaggcgaggggtatggccaatcatggagattgggtcccgtttatggatgtgttagctttgctaatttttggggtcatcctctttccaaacgtggatggtttggtgtacctagcagcaatcaacgctttccttgcataccaccatagcaaggaaagtccggtggtagctgtcttggcagatctatttgacacatttgaccgaaggtgcgaaaagagtagcgcacggatcatctgttgcttgcccgccctctgtgtttggttggtttcgcacttgttccaacaagacacaagacatccatgtccgctcctgagccatcgctcgtgtactgaaaagaggagaatagattgggaccagctcttggttgggataagaggtagaacaatcaattggttcccccgatggaaggaaggaaaagaaggagtccttttctcatgtggaggatacccaaacattccgctggtaggaacgaggggttgtattaactacaatcccgcgctcgctataagacatctagggtgccctatgaggggagcaccgacggaagaaagcatgtctcctttcctt

SEQ ID NO: 47265 - DNA, 339 bp, Glycine max
  Peptide Sequence Number=SeqID_138950
atgacggtgaaaacctctgacacatgcagctcccggagacggtcacagcttgtctgtaaacggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctcttccgcttcctcgctcactga

SEQ ID NO: 47266 - DNA, 1107 bp, Glycine max
  Peptide Sequence Number=SeqID_138951
atgtccaacgtcaatattctgtcgctcatgcgcgaggctggcgtgcacgttgatgcggcgggattttcagcagccgctacagccacgggcgccgcgggcatcgttttcactgccgatctttttgaccgtgataccctcgattatgttgtgcgggagaagattgaagtcaatgcaggctctttggacatgctgcaccaattgggcgaaagatcacctggtcatcgtgtgtggctgcgtatcaatccaggcttcgggcacggtcacagcaagaagaccaacaccggcggagaaaacagcaaacacggcatctggcatggacaacttgcccaagcgattaccttgttagagcgttaccgtctccatctggtaggcttccaccttcatatcggttcaggcgtcgactatcgccaccttgagcgcgtctgccaagccatgaccgatataatttcatcggtggaccacgattttgaggcgatatctgctggtgggggtctttctgtgccctacaagaatggggaccaggacatcgacgtcgcacactatttcaatctttgggaccagacccgccggcaggcagagaaaaaactaggccattcggtgcgtcttgagattgagcccggtcgttttctggtagcacagtcggcggttctcgtggcggaggtgcgtgccaccaaacagatgggcgacaatcatttcactctggtcgatgcgggcttcaacgacctgatgcgtccggctctctacggcagttatcaccatatttcagttttgtcggctaatagtagggcccggaagactgaagcttcgcgcccgactgtcattgccgggcccctgtgtgaatcaggagatgtttttacacaacaacaagatggcaccgtggaaatgagagaattgccaccggctcatgtcggtgactatctggtgtttcacgacgcaggagcttacggagcatcgatgtcctccaattacaatagccgcccacaggcggccgaatatctgttggatggcccagcatcccgtttgatccggacaagacagaaaataaccgagctctatcagagagaatgtcctaacttggcatccccgactaccgcgaaggcaatataa

SEQ ID NO: 47267 - DNA, 711 bp, Glycine max
  Peptide Sequence Number=SeqID_138952
gaggttacagatgcagatgcttctgttcttgtacccactgatgagatttccttagaagggcagacacttcacacattccttgcttggccgacacatctgctcaagtctttatcacagcaggtagctgcgtctccagcaaaacctcctccgaagcccgatccggagatcgatgatccgctttatctgatgacattgaccatcccagagcttttcttgaggccttatcaggttagatgggattccatcgtgttcggggtctttaatccagatttccccctctacataaagcacgaagacctctccgaaatcgcacacggtggtcaatgtctcagcatatcatccattcagaggtctgggcaatcgcagtttgagtctgaaagtgacataaagagttggatgcagagttcacaacgcaatcggacactggaagatggtggtcatcctgcccaaggaacacctagttgtctggtcttgatgatgctccatagcctaaatcaaaggcttctgctaggtggattgtcgtcaagacaaaaaggaagtactgagtgcggctactatgtcatgcactggatgtccaccatcattttaggaacttttaggaataattgggaagcgtattttaacaatcctagaccattggagccagagagattaaaggcattgcggatccagtgggcacagttttatctccgagttagagatcaggcctaa

SEQ ID NO: 47268 - DNA, 204 bp, Glycine max
  Peptide Sequence Number=SeqID_138953
atgccaggagctgatcacaagcaacccaatcacaagggtggtgagacttcaagttcaaccggagcaataggaaatattgggagtcaaaataggaagactggttatgcagaattaagtcccgaaccactaggaaggaccatttcagaggctattattggagaaactcaggttgtggcaaatatgctctacgagattgatccttga

SEQ ID NO: 47269 - DNA, 468 bp, Glycine max
  Peptide Sequence Number=SeqID_138954
atggaccctcggaggactacacgtcctcgccaacagagggctgcacgccctcaccttgagaggactacacgtcctcgccaacgactccatgtcctcaccatcagagggctgcacgccctcacctccagaggactacacgtcctcgccttgagaggactacatgtcctcaccatcagagggctgcacgccctcacctccagaggactacacgtcctcgccttgagaaggctactcgccctcgccttgggtactagttaccctcaccttgagaggactaaacgtcctcgccttgagaggactacatgtcctcaccatcagagggctgcacgccctcacctccagaggactacacgtcctcaccttgagaggactacatgtcctcaccatcagagggctgcacgccctcacctccagaggactacacgtcctcgccttgagagggctactcgccctcgccttgggtactag

SEQ ID NO: 47270 - DNA, 288 bp, Glycine max
  Peptide Sequence Number=SeqID_138955
atgacggtgaaaacctctgacacatgcagctcccgggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgtaa

SEQ ID NO: 47271 - DNA, 234 bp, Glycine max
  Peptide Sequence Number=SeqID_138956
atggcacgcagcgtgtttgctctgtgcccctattttagggagctatacggggggaaactaaaagggcttttagtgataattcccaaggtggtcatatctctcttgatggtctctagaggtatcatcctctttgaagaacatattgcggcagtagggactactagcaacaatatgttatcaaagagaaaaactctagatgagggttcactgttatcaagcaagtcggagacctag

SEQ ID NO: 47272 - DNA, 412 bp, Glycine max
  Peptide Sequence Number=SeqID_138957
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacctcgacgacggctatagagcaatcattgatgccgtga

SEQ ID NO: 47273 - DNA, 543 bp, Glycine max
  Peptide Sequence Number=SeqID_138958
atggctaaaagtcatatacgaggtttagattggctcgccaagttaaaagtcgtcagcgaagagaattttggagcaccggaagaagacaaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcgaaaggaagaaagggaccagtcgcgagcacatagcatggttttgaaagaggagttagttgcctcttcgaggtccaaaagaagcgtgtctcagcgtttatgcgagacggagaccaacatgctagctatcattgccaagtaccaagaagagttaggtctagccgcggcccacgagcataggattgcggacgaatatacccaagtatacgcgaaaaggctagaggaagggtga

SEQ ID NO: 47274 - DNA, 78 bp, Glycine max
  Peptide Sequence Number=SeqID_138959
tcccgtaatatatcgaggacgcttgaattggggcttctgaaaatggaggctcctagaaatctaagtgagcttcaatag

SEQ ID NO: 47275 - DNA, 231 bp, Glycine max
  Peptide Sequence Number=SeqID_138960
atgggggtgcaaatagcacccaggccctcttgggccctccagaatattcctccagaaggctgttgcttctggaggaagcaacctggctcgcctgggcgagctggaaaatctaagccgaggcgcttccaaaacgtttccgtaacgttttccgtgaagaatttcgcgaaggtttcgaccgttcttcgacgttcttcattcgttcttcatcgttcttcgatcttcaacgggtaa

SEQ ID NO: 47276 - DNA, 288 bp, Glycine max
  Peptide Sequence Number=SeqID_138961
atgtggacagggatcagtggaaagggatcaaatggacaaatactagcagagcttgtttcttccttctttgaggatgaaccttcttcctcttgctgtaacatttgcagaacttccttaagagttttagttaggatctctttcgattttgatcctgctaaaaatgctgctagatgggacttttggtttcaaaacacaaaattttctagatcaactgctttgaggaattttggatgggattggaaccagagtttcacttgttctggatctactttggatgagtcgaattga

SEQ ID NO: 47277 - DNA, 676 bp, Glycine max
  Peptide Sequence Number=SeqID_138962
tagactgagaggctttggcagaattgatcgaacttcttgctctcagggtgcttcgcttgagctcaaccatccgggatgcttgttttctgaggatgattctttcgcggaaggacatgactacgttaaccagccgcaagggtgtgccgaaatggcacaacaccctcctgctgaaggatcttcgcatatagccgcgagccaatctcgctgtcgtggctccgccaaccccattcctgctgtggcacctgcaagaattaccaaccaagaggtggctatgattaggcaacaagtgggaaaagagaatcacgatatgatgctgaggatgatacaacaggtggctactgttctcagcccaatgtacgagacgtctcatgataaagaaaaaggtatcaagttcaatgagctttcccctcaactcaggcccatcctacagtatgggaatgcgcacttgatctggaggcctgaggaaatgcccaggctgggggcatgtttacacgcacttgcttccgagtcaagtaggaggcctgtcggccaacaaggaagcgagcaaggtgcggagtctcaatcacgtgtacgacggtcgaagggcgaaagggaaccagagcagcaagcatcacaactagggacattccccgccacaacagttccacaggcaccatcggatctggaaattacatag

SEQ ID NO: 47278 - DNA, 542 bp, Glycine max
  Peptide Sequence Number=SeqID_138963
tacctattgcctttagaggactacccattctcgactttagagggctacacattctcgccttcagaggactgcaggtcctcgcctttagagggctacacagcctcgccttaagaggtctgcacgtcctcgccttaagaaggctgcatgtccttgccttaagagggctgcacgtcctcgccttaagagggctgcacgtcctcgcctttagaggattacacgtcctcgactttagagggctacatgtcctcgtcttaagagggctacacgtcctctcctttagaggtttgcacgcccttgccttaagaaggctacacgccctcgccttaagagagctgcatgccctcacctttagaagactgcatgtcctcgccttcaaagggctgcacatcctcgccttcagagggctgcacgccatcgccttcagaaggctgcacatcctcgccttcagagggctgcatgccctcgccttcagagggctgcatgccctcagaggtgttggatcaagtggcctcagaataattaagaaggggaggttgaattaa

SEQ ID NO: 47279 - DNA, 231 bp, Glycine max
  Peptide Sequence Number=SeqID_138964
tggcgtctatcctggacttatcttcctgtcaccggaagtggcgtctacccagacttatcttccttcaccggaagtggcgtctaccctgacttatcgtccttcactggaagtggcgtctacccagacttatcttccttcaccggaagtggcgtctaccctgacttatcttccttcaccagaagtggcgtcatccaaaccttcgtaacctgtatcaagcgatccgccccgtaa

SEQ ID NO: 47280 - DNA, 222 bp, Glycine max
  Peptide Sequence Number=SeqID_138965
atgggggagatgcttgccacccagctcgcccaggcgagcaaggtgacttcctccagaagcaaccgccttctggaggaatcttctggagggcccaagtgggcctgtttcggcatgtcacggaacttcacgaattgtgcaacgatgcttccttttgagttctggcatgtcacggaacttcacaaattgcctgatgatgggtgccaagtacctcaaaatggttaa

SEQ ID NO: 47281 - DNA, 558 bp, Glycine max
  Peptide Sequence Number=SeqID_138966
atgcgagcggggaattatgatatctatggattcctggagccacagtccattcagaggtctgggctatcgcaatttgagactgaaagttacataaagagttggatgcagagttcaaaacgtgatgtctaccttggagcctacctgaatggtggacactggcagatggtggtcatcttgcccaaggaacacctagttgtctggttttgttcattgcataacaggccaaacaactaccttaaggggatcattaacagtgctttaaaaggtcttgatgatgctccacaacctaagtcaaaggctcctgctagttggattgtcgtcaaggcagttgtgtctccggtaaaaccacctcaaaagccagatccggaagttgatgatccgctttatctgatgacatcgaccatcacaaagcttttcttgaggccttaccaggttacatgggacgccaccatgtttggggtctttaatccatacttcccgctctatataaagcacgaagacctctccgaaatcgcacacggtggtcaatgtctcagcatatcattgttacagttgtga

SEQ ID NO: 47282 - DNA, 636 bp, Glycine max
  Peptide Sequence Number=SeqID_138967
atggatgtaacgacctctagaaggtttatctacaaagccttacaaaaagcgggcatgattccccgtggcgggcacaaagaggattcatgtttaatgcatccgggtgtactacatgacatggaaacatgttcaacggtaagagatctattacaacaaatgatagaccaaggccggcttgaggtcagcaatgagggggaggaggaacaacatgtatacatgcagttggcagataaggaaggccctaaaaagcctaaacccttggtaatacacttcaccagggacacagctccccaaagacctcaatacccctcggcagtatcgggtgctaggcctatgtcgtttccttacgagaacagtcgcgcagttctgtggaggtatgcccctccgggcggaaggaaggaagaagctaccgatatcggttcactatcggccaaagtgaccaatatcaccgggttgagcggcataacccgcaatagtcacgtgttcgcaccccctagcctgccaatacagcccgcaaactttaaaaagaaagcaaaggtgaccaaaggacaaaatgtcaaggtgattcccgtaccggacgagggtgttctgacgaatgattttgccaagggaagagaaggctacggcaagaaagag

SEQ ID NO: 47283 - DNA, 939 bp, Glycine max
  Peptide Sequence Number=SeqID_138968
atggctacctcaccaaaagaaacttcagctcctggttcaccctctgtaccatcatctccatcatccaccaaagcaccatcaaaccaggaacgacctgaattcaatatccagcccatacaaatgattcctggttcagcccctgttcctgaaaaattggtccccaaacgacaacagggtgtgaagatttctgaaaaccctagccttgcaacaagtcctagggaagtagacacggagatggacaagaagatccgcaatgttccaacatcttccaccccaaatgtttctgtgcctgatgttgataaagatgttccaacatcttccgctccaaatgttgaagccctcccttcacccagtgaagaggaatcaacagaagaagatgatcaagccacagaagagacccctgcaccaaaggcaccagaacctgctccaggtgacctcattgacctcgaagatgtagaatctgatgaggaacccattgccaacaagttggcacctggcattgcagaaagattacaaagcagaaagggaaaaacccccattaagaggtctggacgaatcaagactatggcacagaagaagagtactccaatcactcctgacacatccagaaggagcaaagttgcaatcccttccaagaagaggaaagaaatttcctcatctgattctgatgatgatgtcgaactagatgtctcgacatcaaagagggccaagaaatcagggaaaaaggtgcctgaaaatgtccctgatgcaccattggacaacatctcattccactccattggcaatgttgaaaggtggaaatatgtatatcaacgcagacttgctgttgaaagagaactgggaagagatgccttggattgcaaggagatcatggacctcatcacgactactggactgctgaagactgtcaccaagttgggagattgctatgagagtcta

SEQ ID NO: 47284 - DNA, 320 bp, Glycine max
  Peptide Sequence Number=SeqID_138969
gactgatagaggcccgtaaccagagctggaaaccccagggccctgttggactttttcgggtccactgggtgtcttgtggaatattgctaagtagcaatgtcatctatgtaagagtggtcatgttggtgcgcatgatccgcactcgtctctttgcagtggcacgggtgaaatcttgccccagtatgcatagtagcagtgtgatagcctccctctctagttgtgctcgcacagttggcgctcctccaatatcagggggtggcccaggaaccgttaaaagggaaactactggtcccttaaccgggagtgcaagtctcggttaa

SEQ ID NO: 47285 - DNA, 475 bp, Glycine max
  Peptide Sequence Number=SeqID_138970
atgcctcctaaggtgtctagttcctccggcagaggaggaagatccagtacaaaaggtaaagaagttctactggctctaccagagccaataaccaaaaaggcaactacaacatcttctgggtcacctaaccagactgggtcatcgacccataaaggaaaacttgaagggtcattgacccagacaagtaccatcaaatctgagtcatcaactcaggaatctccaaaaccaacaacaagcaaacagactgtggctgactatgcctggtcaatacaaactctcttggccttagaagatataggcctcaccaaaataccaaaattagcaaaaaagacctgggcagaaatggcctcagaatcagacgatgattctgaaacagatctacaaaaacaaatccaaaaagccaaacagaccaaaatcgtctgtaaccaaaaaccaagccaatcattgactaaacaagaatcaacaccacaacccg

SEQ ID NO: 47286 - DNA, 267 bp, Glycine max
  Peptide Sequence Number=SeqID_138971
atggattgtcatcatcaaaaagggggagattgtggaaataatgacctccaagattattttgatgatgctaaagaatcaagagttaagcaagttccaaagaatcaggcttcaagaatcaagtctcaaagaatcaagattcaagaacaattaagtttcaagattcaagattcaagaacaatcaagatcaagattcaaggttcaagagaagctgatttaaagattcaagagaagaaatcaagaaacaacagtcaagacttcacaagggaa

SEQ ID NO: 47287 - DNA, 176 bp, Glycine max
  Peptide Sequence Number=SeqID_138972
atggtgggttacacaccttcaagttttccggatttggtcttcgccggtgaaaggatcaaagtgggtctaaaaagaggcaaatctgataagcctgctttcatcaatgcaaaaactagggcaaacgaagaggatgagaatgagggagaaacccttgctatgactgtcattcctacacg

SEQ ID NO: 47288 - DNA, 294 bp, Glycine max
  Peptide Sequence Number=SeqID_138973
atgattgaaagttttcaacaacaacaagaaatgagtgtcattgaattgtacattgaagtagatgttgtcggtgcttctgcgttgaatatggcaaattcactattatcatatgggaataatatagctggcaatgaatcaaaagttcaaagatttgtaataaatttagataatgattttgacaatgatgattacatgatatctaattcatatgttgaatactctttggatgaggaggaagatattgatgatatatctgatacagatgaagaaggtggaagtgggactgcattttaa

SEQ ID NO: 47289 - DNA, 642 bp, Glycine max
  Peptide Sequence Number=SeqID_138974
atggagagaagtatgatagatgctgccagtggtggagcccttggagacatgactcctgctgaagccagaaatttaattgagaagatggcctccaactcccagcagtttagcgccagaaatgatgccatagtcattagaggagtgcatgaggtagctacatacccatctgcatcatctaaaactaagaagcttgaaggcaaactggatgcgctggtcaacttggtaacccagctagccttgaataagaaatctgtacctgtcgcaagggtttgtggtttgtgctcctctgctgaccaccatacagacctttgcccttccatgcagcaacctggagcaattgagcagcctgaagcttatgctgcaaatatttacaatagacctcctcaacctcagcagcaaaatcaaccacagcagagcaattatgacctttccagcaacagatacaaccctggatggaggaatcaccctaacctcagatggtccaggcctcagcaacaacaacaagcagcctgctccttccttccaaaatgctgctggcccaagcagaccatacattccctccaccaatccaacaacagcaacaaccccagaaacagccaacagttgaggcccctccacaaccttccctcgaagaacttgtga

SEQ ID NO: 47290 - DNA, 153 bp, Glycine max
  misc_feature (135)..(135): n is a, c, g, or t
  Peptide Sequence Number=SeqID_138975
atgataaatgccggaatgatatgtccattacgattccatgaagagatgcctgatgccatcaaggagcaagccagagtgagtttgctatgtgcccccctaatggaaaggatcccaaagtccccttctattgacaantcccaagggtggtttcat

SEQ ID NO: 47291 - DNA, 297 bp, Glycine max
  Peptide Sequence Number=SeqID_138976
atggtggggtacgcgccttcaagctttgtggatttggtcttcgccgatgaaaggattgaagtgggcaaatttaatcatcctgctttgatgaataagaaaattggggcaaatgaagaggccataaccccagccaaggttcatcaacctccatttctccgagaatacgacttgaacgcaacgtgtgcttgtcatggagaagccccggggcgttccattgagcattgtagggccctaaagcgtaaggtgcaaggtctaatagatgcgggctggctagaatttgaggagaatcgcttgtga

SEQ ID NO: 47292 - DNA, 390 bp, Glycine max
  Peptide Sequence Number=SeqID_138977
atggagaggagtatgattgatgctgccagtggtggagctctcggtgatatgacccctgctgaagctaggaatttgattgagaagatggcttccaactcccaacaattaagtgcaagaaatgatgctattgttcttagaggagtccatgaggaatctggagtcaatgagcaacctaaagcttatgctgcaaacatttataatagaccccctcaacatcaaaaccaacaacagcagaataattatgatctttcaagcaacagatacaatccaggttggaggaatcatccaaatttgagatggacaagtcctccacaacaacaacagcctgtccctcccttccagaatgttgctggtccaagcaagccatatgttccgcctccaatgcagtaa

SEQ ID NO: 47293 - DNA, 318 bp, Glycine max
  Peptide Sequence Number=SeqID_138978
atgtcaggatttacacgcgatcctcctcaaatttcagccagcccacatcaattagaccttgcaccttacgcttcagggccctacaatgctcaatggaatgtctcggggcttctccatgacaagcacacgttgcgttcgagtcgtattctcagagaaacgaaggttgatgaaccttggctagggttatggcttccattgaattatcaagtggtgtttagcattggtcgtgtggaatggcagtcacagtatggatttctccctcattctcaccctcttcatttgccccagtttttttttgcatttatccaagcaggatga

SEQ ID NO: 47294 - DNA, 623 bp, Glycine max
  Peptide Sequence Number=SeqID_138979
agctacacgccctagccttcagaggactacacgtcctccccttcaaaggactacacgtcctcgccatcagagggctacacgacatcaccttgagaggacaacacgccgtcatcttcagagggctacacgtcctcgcctttagagggctacacgtcctactcttcagaggactacacgtcctcgccttcagaggactacacgtcctcatcttcagaggactacacagagctacatgccctagccttcagaggactacacgtcctcgccttcagagggctactcgtcctcaccttcagaggactacacgccctcaccttcagaggacgacacgtcctcgtcttcaaagggatacatgtcctcgccttcagaggactacacgccctcagcttcagaggactacacatcctcgccttcagagggcaacacgactacacgtcctcgcctttagagggctacacgtcctcacctttagaggactacacgtcctcgccttcagagaactaaacgtcctccctttcagaggattacatgtcctcgtcgtcacagggctacacgtcctcgccttcagaggactagacgtcctcgcctacagagggctacacgtcctcggtgggatcctctag

SEQ ID NO: 47295 - DNA, 414 bp, Glycine max
  Peptide Sequence Number=SeqID_138980
atgttgagaccaacctacctagattgggaaatgaaggttgaacaactctttgcttgccatcatattagtgaagagagacaagttccattggttgcccttagctttcaaggggaacaaaggattcatggggatcctccaatagagtattggaataatcttaagagtgcccttaggaagaggcgcattccctcctactatgaaagggagcttatgagaaccttcatgaggctaatgaatcatgtcctatgggagttcatgggtagcaaagatgatgacaaaggtgatgacaaaaaactcaaagatcaatcaaagaatgagttcaagatgttcaagatagaattaagaacacttcaagattcaagagaaaagttgaattcaagagtcaagaatcaagattcaaggatcaagctttaa

SEQ ID NO: 47296 - DNA, 351 bp, Glycine max
  Peptide Sequence Number=SeqID_138981
atggaaagtaaaagagtagggaagaagaagacaaacacacaagagtttttatactggttcagcaacaacccgtgcctacatccagtctccaagcgacctgcggtccttgagatttctttcaaccttgtaaaaatccttttacaagcaaagatcaacaagggattggatgtaccctccactagaactgatccacaagagatgtaccctctcttcttctcagtcaacaacccaagtagatgtaccttctacttgtaccacaagagatgtaccctatcttcttctcaggcggttaaacctttgatactttatgaatggggatacaaaagaattctcaggtggttagtcctttga

SEQ ID NO: 47297 - DNA, 276 bp, Glycine max
  Peptide Sequence Number=SeqID_138982
atggattatgaggatttcaatctgattaaagagttcctcttcatgtggtggtttgacgactcgtggtggccaccgatggcggaggaggagtttctagggtggtttgggtggagttttgagagagagagcgagctcgtatcgataggtgagaatccacttttggcgctaagtgggatttttgcgtcaagcgcaattcctctcgggtcgggatttgcgttaagtgcaattcctcttacactgagcgcaacattttgcgttgagtgtaatttctcctag

SEQ ID NO: 47298 - DNA, 337 bp, Glycine max
  Peptide Sequence Number=SeqID_138983
atgaagggccaagacatttatagtagccaagataaggctactacttcaccttcctctagcgaaagtgaagaagaaaaaggggaagaatctagtgaagaaatctacccccaagaagaaggacaaccattagtggttaaagagaagtgtaaggagacacttgctagcattgccacacctcttgggcttgagtttattcctcaagtaaaaaagttgttggatgagggtttggttcgcaagagcttaaatccttgtgctttgttggtgcccaaaataggtgttcagggaaggagcccagagtatgaagaacctcaggatttgaggtcaaatcctttccaag

SEQ ID NO: 47299 - DNA, 183 bp, Glycine max
  Peptide Sequence Number=SeqID_138984
atggcttataccgccatcttattgggttggtttaggtcccagctcacactactgaaaaaacgatcggcgatatccgaaacaggtaaccttacagcttgcttaggtgcaagcaatctcaatgcaatgagagagggagtctccggttccatgaaagggtgtcgtgatgctaaacgagtaccataa

SEQ ID NO: 47300 - DNA, 1025 bp, Glycine max
  Peptide Sequence Number=SeqID_138985
atgccctcttgggggaagaaaaccgtatcttttctctgggtttcttccctccttgagcaagattgcagctgtggtcggagattcggcgagagagttggatcgtatgaagcaaactcgaaacggcgtagtggacctaccgcgaaaatacttggaagccaaggcaagggatatggcgagtcaagaagagtgggtcccgtttgtggatatactagctttgctaatctttggggttgtcctctttctgaacgtggacggtgcgagaagaacagtgcacacattgtctgctgtttacccgctctttttgtgtggttggtttcgcacctattccaacaagacataaggcacccgtgtccacttcaaagttatcgctcgtgcgtcgaaaagagaagagtagattgggaccaatacttggctgggataggaggcagcacaatcaactggtttcctcgatggaaggaaggaaaggagggagttctcttctcatctggggactacccaaacgttccgttgatagggacgaggggttgtattaactataatcccacacttgctataagacagttagggtaccccatgaggggagcaccaacggaagagagcctctcgcctttccttgtgagagatttcggcgcacaaagtttcaagatcgtacacagagtccacaaggcgtgggaaagcccgttaaggaaagataaagaacttaggggcatccgtaatggcatcatcagtggttatcatgaatgcttaagagttcatacacgagggttagattggctctccaagttgaaaattatcaacgaggagaacttcgaagcttcggaagaggatgaagaagtccaagctctaaaattagagctaggaaaggcaagactcgctaaagaaaaattcaagttagtcgctacagacatccggaaagagtgtgccggattacgagaggaaaatgtggctaccgcaagagccctcgaacgagaaaccaagagggctcgcaaggaagagcatggccgagataaattccgaggagcttt

SEQ ID NO: 47301 - DNA, 144 bp, Glycine max
  Peptide Sequence Number=SeqID_138986
atgaagcattgttgccttccgtgcctcctcgttataaatctcagctttattcgaggttgcactagcacgatcaccaccaatctgtgcttcttcctcgtctatcagagtagttttcaaaagccaaggtcaaaggaaagatattga

SEQ ID NO: 47302 - DNA, 1530 bp, Glycine max
  Peptide Sequence Number=SeqID_138987
atggatatgggcatagatgcagcagttttaatgtgtctaagagatattaggcataatcaatttgaagactccctaattggaacagtcgaaaccagcctaggacaaggtccaatatattttaattgttatccaaacaaaatagtgagtctgatggacagaaacattcttgactctctgttcttaaacatccactttcatggccttgacatgaaagaaggatcaatcccagcagccttaatttataggatccagtacaaggtcatgaatacttgtgcatctagagtcctgttaaaacctcaaagaggagaaacaaccttgtttatcactgatatgacaaaggctaacgtgtctctcccaagaaaaataaaatgggatgaagtaactcttcccgaaagatgggttatggataaggccacaccgtctattccccgacccgctccaaccatagagcatattaagcaagataactccggaaaggtagagataaccttcaataggagaaattctttttcatcaagaatagaagcctctaggtctgaatatgagtcagccagaaggtctttttcagttagaacccgttcaattccagtaggactaaccagatctgagtcacataaccagttccctactgtaaacctccaaggattagacactacttctagcatacctagaacaacttacaaccaagaacaggaggacgaccaaaacattgataaggaaacccttaggaaagatttctattctccggagaatgaacctcaaaggagatggtttttccaacattacaagggtgcaaatagtaaacaaatccaagacaagttctacgaatttgtcgaaagagtcaaaattaatgtccttttctttgattggtttcatgcttatgccatcagaaaggatatagattacccttggaaacaagacatcataggtgatccaacgacaaatgtcataacaaattggcaagtgaaggatggtgagttaatccaatcggaattacctcccgcaacacaatatcaactgccaaacatcaaagacagtaacaataaacctgtcatggcaattccattcaagacaaaagatgtcaacgaggaaataacctctaaagacattaagagcctaatggaacaggcaaattataccaacaaatacttacaagctttaggagaaaccataaaaactaaggtagttcctatacaaaaatcaatagaggaaacttcgcctagtatccccattgaaaaacctttattcaaacctttcaaagttagtgagaaggctaaaagaaaaattagggaacttagaaaaactaaatccttaattgaaggcgtaggtgacaaccatagtgaattactaaacaagattggtagtttacttaaagtcattccagataccccccaagcctcggaaaatacttccaaaatggtaacaagaagtacctccaaattaatcaatgttattaatgaagatagtgaccaaaactcagattacacaactgagataggatcagtgtcagataagtatataatccaataa

SEQ ID NO: 47303 - DNA, 489 bp, Glycine max
  Peptide Sequence Number=SeqID_138988
atggtcgagagagagatgatcactatgatggtagacacgttgccagtgttctactatgagaagctagtaggttacatgtcgtccagcttcgcggacctagtgttcgccggggaaagaatcaaggtaggattgaaaagaagaaagttcgattacgtttcctccacgagtgcgaatgccaaaaggatcgggacaacgggggcaaaaaggaaggaagaagatacccatgctgtctcttcaacgcccgcatgggtcaaacccccgcagacacctcatggtacccatcagtacgcgcaacatcacccaagcttctcggctcacgccgggaacgcctctagttcagcacctgtgcagcctaaggcacccacccagagggaagctccccaagttccaactccaaacacaactcgcccggccggcaattccaacgcaatcaaggaacttccctccgaggccatttcaagaattcatcccactcccaatgacgtatga

SEQ ID NO: 47304 - DNA, 348 bp, Glycine max
  Peptide Sequence Number=SeqID_138989
atgtaccctcccttgttctctttgaacaacctagtggatgtaccctccactagaactgatccacaagagatgtaccctctcttgttctcagttacaacaacccaagtagatgtaccctctacttgtaccacaaaggatgtactctccaatgtgttaagacaaagttctcagtcggttagtccttcgaaactttgtgaagggggaaacaaaagaattctcaggcggtttggaaaactagcaaacttaagaaagcttttgacaaaggaagaagaagaagaaattcaagaagatgttcaaagagactcaagggttgtaaaggatttgaaatcaaggtattcaatgcattga

SEQ ID NO: 47305 - DNA, 81 bp, Glycine max
  Peptide Sequence Number=SeqID_138990
atgggatataagatgaggaaaccacgatttgaggcaaagttaatcgcaatgcgagcagagtttccacaagcagcatattga

SEQ ID NO: 47306 - DNA, 314 bp, Glycine max
  Peptide Sequence Number=SeqID_138991
atggcttccatgatggatgccatgctgggaatgaaacaactaatggagagtaacgcggccaccgacgccgctgttagttcggctgccgaagaagacccgactctcccaactgtcgcgcaccaccctattccaaacatggtgggacgagagagaagcacaccggggcacatcagcaacccaaatccagggtacaaccgaggaacttaccccaacggtttaccacctagttaccacaacaccaggtcatacgtgacgacacgggtcacgttcctcccctcatcctcgaaggggagccctctcgacatcctgacgag

SEQ ID NO: 47307 - DNA, 201 bp, Glycine max
  Peptide Sequence Number=SeqID_138992
atggctgatgagcaatccaatgacatggatcaagggaatgaacaagtcttacaagagataaatcataatgatttgatcagagcagcagccgatgatagtgatgatatcattgaagttacaatacctatggagaacattttaccacatgacaaggatgataattatatagatgatgatgagagcgatgcagacttcttttga

SEQ ID NO: 47308 - DNA, 177 bp, Glycine max
  Peptide Sequence Number=SeqID_138993
atgagcaagaggctccaagaggattgggctagagctgctgaagaaggccctagggttctcatgaaccgtagggtagggtgtcgcaacctacccttcggcgggagggcgacgcgagactcgcgggatgcgtgttccacgaaaggaatacgcgcggagtcgccaccaacgtttatttga

SEQ ID NO: 47309 - DNA, 321 bp, Glycine max
  Peptide Sequence Number=SeqID_138994
atgtccaacattcccgataatgagccatgttgcaagatcgagaattcaatacttgagtcgaccgatcctacagtgcttgaatctcaatctctgtctattacaactgatcatgatcggtcgatgcttgccttaagtgagcctacagagtttgaatttcaatctgtgtctgttaccggggatcatgaccctcttctcaggattccattgacaccaactaagcgcgtatcttctgatgagttggataatgagcgaaaaaactttgagatctcacctgctgaagtttcctcgaacaaattagccaagcattctcagcctgaatga

SEQ ID NO: 47310 - DNA, 273 bp, Glycine max
  Peptide Sequence Number=SeqID_138995
atgcaacaccgtgacaagacaacttctgatgagaatcctgaaattggccatatacagacttatcaaggtaatccttgtggcgtctaccctgacttatcttccttcaccggaagtggcgtctacccagacttatcttccttcaccggaagtggtgtctaccctgacttatcttccttccccggaagtggcgtcatccaaacctttgtagcctgtatcaaacgatccgctcctactcaggttcacatcatctggtatcagagcttcggctcttga

SEQ ID NO: 47311 - DNA, 450 bp, Glycine max
  Peptide Sequence Number=SeqID_138996
atgccaagatttgaaggcttgtttgaaggacagattctcagtatacaaagcttgcaggaactagttcagcagagatcgattatgagtatagagcagtttgttgagaaggcacctcaacagcatgggccagaactagaaaatgatcactcatctaaagcctccatctctggagctattaattgtaaaaaaagaagattagagacgagatccaataaggctactcatcatggaccagtgccagcgtcagctgatgcaccatttccaagagtggatccatcttcacctcagcacgcaacaaactcttccatccctgtcttagagatacatgagggccaaaccataccaattctgcctttggacacttctcctccagctactccagtatggcatctaatagatgagaagaatgttcagatacaggacaatcaagaccagtcacaggaattttaa

SEQ ID NO: 47312 - DNA, 413 bp, Glycine max
  Peptide Sequence Number=SeqID_138997
gggtagcgtcctcaagacacccagtggacccgaaagagcccaatagggccctggggtttccagctctggttacgggcctctgtcagtcctacagggcgcccgtccccccagcaagttcatgctatcgtgacatagggatcacgcccgcaagacactctgtggacccggagaagtccaacagggtcttggagttgccagctctgattacgggcctctgtcggttctacggggttcctgtcgcccccagcaaggtcatcaggccccctactaatcgagctttcatcaagaagtactgcgcccccaggcaggcgcagggcgaaacaccccagcagcctggggacggccgacagcgggcaacagacgcaccaccaccacctctagagttcacctcagctcatccacaaaaaggttag

SEQ ID NO: 47313 - DNA, 393 bp, Glycine max
  Peptide Sequence Number=SeqID_138998
atggctacaccacccagctctcctcctcctcctcctcctcctactggtgcaacatcacagtcgccatctaccctgaagcggacaagaaaagccacacgactaagaccattagcgactagaccagttggggcagagagaccgatggtccatgttgatcctacgaccagggatgtccctgaagcatatttggggatcctcgcttgtgataagctgacaaggaaagtgtcgacgacactgtatgtgaaaagcatgacattagcaaggagaagtggacccaattttttcagacctatagagacccttcgtgggaggatgtgcgaaaaaaggcacaaaccatccaaaaacaaaacattgctcctcacatgttgtctcacgggggttatgaatatttag

SEQ ID NO: 47314 - DNA, 231 bp, Glycine max
  Peptide Sequence Number=SeqID_138999
atggccttctcaataccaccacctttgctcccaatcctgactactacagttttgtggcatcggttaatgggaaagaaggttcttgcagtctcaagtgatgttcatattaaagacttttacctacagttagaaaattttttgtctataggtataggttatttttcttgtagtgctcccactgaccttctggtatatacagtgatccatgacattctcttcaaagctaaatga

SEQ ID NO: 47315 - DNA, 177 bp, Glycine max
  Peptide Sequence Number=SeqID_139000
atggagcttgcatcaagcgtggtggtcatattcattaagagggagctgatttgtcagtacggactccctaggaagatcattactgaaaatggaaatgtgcatggatttcaaaatccagcatcacaattccacgccctactgaccaaagatgaacggagccgtggaagcaaccaataa

SEQ ID NO: 47316 - DNA, 246 bp, Glycine max
  Peptide Sequence Number=SeqID_139001
atgcttccttttgattttcggcatgtctcggaacttcatgtaatgtgcaacaaagggtgccaagtacctcgaagcggtcaaacaaagagtgtacatctacttgggttgttgactgagaacaagagaaggtacatctcttgtggatcagttctagtggagggtacatccactaggttgttcaaagagaacaagggagggtacatcccttgtggatctttgcttgtaaaaggatttttacaaggttga

SEQ ID NO: 47317 - DNA, 309 bp, Glycine max
  Peptide Sequence Number=SeqID_139002
atggtagccataacccctgctaggtttcctcaacctccatttttcggaggatacgactcgaacgcaacgtgtgcttatcatggaggagccccggggcattccattgagcattgtagggccctgaagcgtaagatgttcaagattgaatcaagaacacttcaaggttcaagaggaaatttgatttcaagaatcaagattcaaggttcaagcttccaagaatcaagatcaagattcaagactcaagattcaagaatcaagagaagacttaatcaagataagtatgaaaaagtttttgcaaaaactgagtag

SEQ ID NO: 47318 - DNA, 183 bp, Glycine max
  Peptide Sequence Number=SeqID_139003
atgtggtgggtagcagctacaagcttcagcggaaatagtgactgtgcgcacggtgtttggggggtggttatggctggccgagggaagaagggttgcggaaagatatatatcatggatacacttattgataatggaatacgtggacatccaatgagagacggtcatagtaacgtttacaaataa

SEQ ID NO: 47319 - DNA, 249 bp, Glycine max
  Peptide Sequence Number=SeqID_139004
atgggtgccaagtacctcaaagtggtcaaacgagagttgcatcctaacaacggatggtccccggacgaaattagggtgtgcggaatgaccataatttgtctccgcccacctctcgacttactgtttttgaatgacaaagggcacagacttatctctgcgcgtttatcacccaacttgcgaaatctgaatgacaaagggagcagaatttgtctctacgcgtttatcacccgcctcgctgctcctgaatga

SEQ ID NO: 47320 - DNA, 507 bp, Glycine max
  misc_feature (400)..(400): n is a, c, g, or t
  Peptide Sequence Number=SeqID_139005
atggctaagtttgaccttggggtagtcctagagttttatgataatgcttggcccacagaggagggagtgcgggacatgcgttcatgggtaaggggtcagtggattccctttgacgcagatgccctcagccagttcctgggtgacccgctagtgttggaggaagaccagcagtgcgagttcaaccagaggaggaacagggccgacgagttcgacgaggaggccattgcccagctgttatgcacaccggggcaggatttcacccggatcgctgcagggaggcgggtgcggatcatgcgcaccagcatgactaccttgacccagacgtggatgacattgctgctcagcaatgtcttgcctagtgatcataactccgatctccctctaccgaagtgtatgccanccaccaggcaccctctagacccggataagtctaacagggccctaggatttccggcattgatcacgggtctctgccagtcgttcggggttcccgtcaaccccactaac

SEQ ID NO: 47321 - DNA, 255 bp, Glycine max
  Peptide Sequence Number=SeqID_139006
atggatacctggaaaattgggattattcctctgccgctgttcgttttggcgggtgcgctgattgcgattgattgcctgggcggaaaactgccgagtgatatcgtggtgatggtggcgacgctggccttcttcggctttgcctgcggtgagtttggcaaacgcctgccaattgtcggcaagctcggcgcggcggcgatttgcgccacctttatcccttccgcgctagtctactacggcctgctgccggacgtggtg

SEQ ID NO: 47322 - DNA, 183 bp, Glycine max
  Peptide Sequence Number=SeqID_139007
atggtgctggtagcggctattgcagccacattgacctccattatctcctttatgctcatcatggcctccatcattgtggccattttctctttcaaggcctttgtgtcggccttcatctgctcttgcacctcctctacttcaccaattactctagctctagcacgggttcggacatcaagttga

SEQ ID NO: 47323 - DNA, 697 bp, Glycine max
  Peptide Sequence Number=SeqID_139008
atggggacgaggggttgcatcagctacaatctcgttcttgctataagaaaacttggctaccctatgagaggggcgccactagaggatgagctcgcacctgtcatttcacaaggcttcaataagacgaacgtggagacacttcagaaggcccacaaggcatgggagttaaaagcccacatgcaaggtttggattggctcccgagtttgagaaccgctaaaagggaggaagttgaggcaccagaggaagacgaagaggtgctggcccttaggacgaaactcaagcaagctcaaacagtcaaagaaagggctcgtagggaagagcacgaccggaacaagtttcgaggggctctgtggggcagcaacggtgagcttaagctccggtccaaaagaaacttgtctcagcggttatgcgaaacagagaccaacatgttagccatcatcagcaagtaccaagaagaactaaatctagctacggcccacgagcatagagtggcggacaagtatgcccgagtgtacgccgaaaaggaggctagaggaagggtgatcgactcgttacatcaagaggcaacgatgtggatggaccggtttgctcttaccatgaacaggagtcaagaacttccccgattgctagccaaagccaaagcaatggcggacacctactccgcccccgaggagatccacagacttcttagctatt

SEQ ID NO: 47324 - DNA, 222 bp, Glycine max
  Peptide Sequence Number=SeqID_139009
atggcagcggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctcaaaaggagctctgaaatctgaacccacatcaattccaagattctccactaagtgtgcttag

SEQ ID NO: 47325 - DNA, 744 bp, Glycine max
  Peptide Sequence Number=SeqID_139010
atgaaggccgacatggaggccatgaaagagaaaatggccacaatgatggaggccatgatgagcatgaagaagataatggaagccaatgcggttgcagttgccgctaccagcactgttgctaaggtgaacccgatgcccccatctggcctcaaccaaatgaatcatccaaccttagatatggtaggcaaagatttgggaagcacgggcggcccccattatgtgcaaattcaaaacaagcacaccttggcgccatatggcttgcctcccaactatacaccaccgaatgtggcgtacactcctggtgaggatgtcaataactccactcctatactcattgagatccaacaacctcaatctgatcatggacatgtctctcaacccatgggggagacacatgaaataccccatctcaatctagacaacttcgagcatcgcctcgaatatgccaccgaagggcaagcagttggtgatatacccctgcaaaacactttggagggccctcagtatcacccacaaccatacccattgcattccacagtggataaaaaccctcctgctatggcagaaatggaaaagttggatcatctagaggaaaggctcagggccattgaaggaggcggagattatgcctttgcgaacttagaagagttgttcctagtacccaatatcatcaccccccccccaagttcaaggtgccagactttgacaagtacaagggaactacttgccccaagaatcctctga

SEQ ID NO: 47326 - DNA, 651 bp, Glycine max
  Peptide Sequence Number=SeqID_139011
atgggtctaggcaaggacgacctcgggaatgccgacatagtcgatattaggggaaatatgtacaaaaatggattggggtatgaacctgggatgccgggaaggaggaatgtgccgtcaagacttcgggcggatagggcatggcccggccgcattagccagtgtttcgccagtgccggaatgatgtccgaggaagaggtggccgcagtaggagaggaatgtgagggtcgattctttgaggatcctaaagacgagggtttgacgatcgatttcgaccgagatgtaagccaaatgatgaacgaagaagaggaagaggacgtcctttcaccagagttggagaggttgatcactcaggaagaacgcgggggatcctctagagtcgacctgcaggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 47327 - DNA, 1191 bp, Glycine max
  Peptide Sequence Number=SeqID_139012
atggtttctcctcagcttgccacatggccttgctcaatggttttgctacaaatctttgttgtggctcaaaccagaagtaacaaaatcattggtcactctcttcttaaaaaaactagcaaagcctcatggatggtttcacctcatggtcaatcaagaagaaacatagttgttggtgattctcttctagccgaaacaactagcaacaataacaacctctcatcatgggtggtttcacctcttggtgactttgcctttggatttgtcctacttgaggacactaataatttcttggttttcatttggtatgctaagattcctgagaaaattgttgtttggtataccaatggagagactcctgcttcaaaggggtcaaaggacaatggcaactttgtgcttgtggatgaaaaccatcaaggtgtgttgtgggagactttaaaggatccaagggacaccttgttgccctcacaacctcttgaaaagggtgagaagcttttatcgagatttctagagtcaaatttctcaaaggggaggtttgagttgcttcttcaaatggatggtattctttcgattcatgctttgaactcaccctctgagtatgccaatgaaaactactgtgaaactaggactgaagagtccaacacatcgagtcctggaactcggttggtgtttgaaccattaggtttttgcacgttgggaggtgatcaaaggtcaagttgtcaatgcccaaaatggtactctttgcttgaccctaatcacccctatggtagcagcaagcttgatttcatacaaggatgtgcagaagatgagctgattggaaggaaagaagatgtggctgaatatgattttgaagtgttgataaatacagattggcctctttcagattatgtgcttcttaagccttttactgaggaacaatccttttcctttcccacagaaacccagagatgtctcggtaaaactatgatcccgaccttcatcgttgggatttgcgaaataatattcgtggagggagaaaaaggaatcgcacaaagacagtacaaatggaggcttcaatctcttctcattctctctaacatttgggaaccctatcagagcaaccagaggaagaaattgaggaatcctaggaacttgctagagatgctgctatcgctttttggaagacacgtgagtctgcttagaggtaagggatga

SEQ ID NO: 47328 - DNA, 90 bp, Glycine max
  Peptide Sequence Number=SeqID_139013
atggtggtatttctggtgctctccaaagctcctcatccggttgctttgttaggaaaaccaaaggaagcaggggttgaagatgatgaatag

SEQ ID NO: 47329 - DNA, 270 bp, Glycine max
  Peptide Sequence Number=SeqID_139014
atggctcatggcatattatctcggcatcgaaggaaaaaggtgagcaaagctccaaagattcagcgactcatcactccactgacactgcaaaggaagcgggcaagaattgctgataagaagaagagaattgcaaaggcaaaatctgaggcagcagagtaccagaaacttcttgcctccagattgaaggagcagagggaactccgcagtgagagtttggcaaagaggagatccaagctttccagtgttgctaagcaatctgccactgcatag

SEQ ID NO: 47330 - DNA, 738 bp, Glycine max
  Peptide Sequence Number=SeqID_139015
atgttggctgagctactaagaagagagaagcatgcaaagattaaaccggatcctgatattgatgcctatatgaaggatgtgaagaacgaagcagaagcatacatgcttaaggagttgtctctgttgaaatggcaagagaaagctacaaagttcgcccttgatgatacaggtggaaaaatggatgagttacaagggaatgttgctactctagaagaaaatctcaaggcagaaaggcaggatgtgaagtatcgagaggattttaagcacgtgaatcagaagatcaaaaagcttgaggataaagtagaaaagcttgctaaagttcgtgctgagcttaaaccttgggaaaaagatttgattgagcacaatggaaaacttgaagttgtatgtacagaggctaagcttctaaatgataaggcattaaaggaaataggaaccaagattgggaacaaagactggaactttggggtggatccttgcagtggaaaagggaattggaatgtgcctgatgctaggaaagcctttgtgatgagttctatgatatgtgattgttccttcaatcacaattcttcttgccatgttgagaagcaagttgatcttcttccgaagttgaaaaagaatgtaagcactctagagggggttccacgcctttttgatttagtgaaagttcaagatgaaagaatgaagcttgctttctttgcggcacttagaaacactgtggttactaaagatcttgaccag

SEQ ID NO: 47331 - DNA, 237 bp, Glycine max
  Peptide Sequence Number=SeqID_139016
atgcatgttcaaactggtattaaaaggtataatattaatgagaattcccctatgttatggcatcagagattaggacatatctccattgagaggattaaaagattagtgaaagatggggtactcaatactctagattttgctgactttaagacttgtgtggactgcattaaggatatggatgcacgtgatcagaaattctttatcacctttatagatgattttattcacaatatatga

SEQ ID NO: 47332 - DNA, 360 bp, Glycine max
  Peptide Sequence Number=SeqID_139017
atggagccagagcagcctattcaggattcatcgggagctctagcactggaccttaatgaagatcagccacaggatgacttgcagccattagaagagaatgagcatgtgaatagaactttgactgaaaatgttagtcagattgtcagagtgattgtgaaggaatgtattgaccatatctcggagagcatcatcctcaggaagcttggttcaaagcaaacttgtcccaaatttgggggagtaattatcaaggttaaaaagaggctaagtcatgaagtgctaaaagtgacagttgagctcagctcatcagttgggctaagcgtgcatccatcgctaagcgcagcttcagcgcgcttagcgtga

SEQ ID NO: 47333 - DNA, 417 bp, Glycine max
  Peptide Sequence Number=SeqID_139018
atggagaaccattggctcaatgtgcagaaaatgttacataaaaaggttacacaaacaattcatcttgtcgcaacgtgcccttcgcgggcgagcgagggcgacgctcacgggtgcgctttccaaaggaggaaagatgcgcggagtcgccaccaacgtttatttgtggaaaacgtcggaaaaaccgaaggaaaccggtcaaaaataaaaattctaagttcgggagttgtatttacgcttgaggaatgtattagcacctctcacgtcgacaaaagcggggcttttgctcctacgtaccctcctttggagaggaaatcagacctacgtagttctttctttatacgtgaatcaagtgattctttttacttgaagggtgatcattttaaggcgttggaccttaaaaatgatccattttacttg

SEQ ID NO: 47334 - DNA, 2772 bp, Glycine max
  Peptide Sequence Number=SeqID_139019
atggagttcgcgtcttcttcatcacccttctcaaaatccaaaccccaattcatgtacgatgtgttcatcaatttcaggggagaagacacccgtaagaagttcgtttgtcatatctataaggccctctcaaatgctggaatcaacactttcattgacgaggagaacatacaaaagggaatgacgctggatgaactaatgacagcaatagaagggtctcagatagcaatagttgttttctccaaaacctatactgaatctacctggtgtcttcgtgagcttcaaaaaatcattgaatgccacgaaaattatgggcaaagagtcgtgcccgtattttaccatattgacccatcccatatacgtcatcaggagggtgattttggaagtgcgttgaatgcagttgcagaaagaagacattcaggagaagatctgaaatctgccttgtccaattggaagcgcgtactaaaaaaagctacagatttctctggttggaatgagagggatttcaggaatgatgctgaactagtgaaggaaattgttaacgatgttcttactaaactggagtacgaagtcttgcctattactcgattccctgttggattagagtcccaggtgcaagaagtgattagatttattgaaacaaccacatattcttgtatcatagggatatggggaatgggaggatcgggtaaaactaccacagccaaagccatctacaatcaaattcatcgttcattcatggataaaagtttcattgaggatattagagaagcttgtaaaagagatcgagggcaaatacgtttacaaaaacaacttctttcagatgttctaaaaacaaaggtggagatacatagcattgggaggggaacaactgtgatagagaacagactttctaaaaaaaggttactcattgtacttgatgatgtgaataagagtggccaattaaaagctctatgcggaaatcttcaatggattggtgaaggaagtgtaataatcattacaactagagataaacacctgtttacgggacttaaagttgattatgttcacgaaatgaaggaaatgcacgcaaatgagtcccttgaacttcttagttggcatgcttttagagaagcaaaaccaaaagaagacttcaatgaacttgcaagaaatgtagttgcttattgtggaggactaccactagcacttgaagaccttggtttatatttaactaataggactacaaatgagtggagaagtgcattgtcaaaactagaaacaactcccaatcctcatgttcaagagatattaaaaataagctttgatgggttaaatgatgagaaggaaaaagatatatttcttgatgtatgttgcttctttattggtaaagacatagcctatgttacggagatactaaatggttgtggactacattcggactgtggaataccagtcctcatagaccgtagcctcataaaagttgaaaagaacaacaaacttggaatgcataatttggtacaagaaatgggaagagagataattcgtcaaagttcaagaaagaaacctgggaagcgcagtcgactgtggtttaatgtggaagtagttgatgtattgacaaagaatactgggacagaagttgttgagggattggctctgaaattccatgtcaacagcagaaattgcttcaaaacttgtgcttttgagaaaatgcagagattgagactattacaacttgaaaacatacaacttgctggagattatgggtatctttctaaggagctgagatggatgtgttggcaagggtttccttcaaaatacatacctaaaaactttaacatggaaaatgtgattgcaattgatttaaaacgcagtaatcttaggctagtctggaaagaaccccaggatttggcatcgctaaaaatcctcaatcttagtcactccaagtacttgactgaaacccctgacttttcaaaactacgaaatcttgaaaagctcattctcaaagattgcccacgtttgtgcaaggtacacaagtccattggagatctccgcaatcttattctgttaaatttgaaggactgtacaagtcttggcaatctcccaaggagtgtttataagttaaaatctgtgaaaactctcatcctttcgggttgttcgaagattgacaaattggaagaagatatagtgcagatggaatccttgacaacactaattgctaaaaatgttgttgtgaaagaaaataatgcttttggggatgtagcaccaatgcttggcggccttggaattcttcgtagtgttttggtgcaatgtgacacagaacttcaactattgaaactaggattggcaatcaatgattcttgtgatgcttttcttccaggtgacaatgatcctcattggttggtccgtatgggtgagggaaattcagtgtatttcactgtgcctgagaattgtcgcatgaagggaatggctttgtgtgttgtttatttaacaaaccctaaaaacacagcagctgaatgtcttatttatgtcttaatggttaattacacgaagtgttccatcaagatatacaagcaagatacagtaatttccttcaatgatgtagattggcagggcatcatatcacatttggaacctggagacaaggtgaagattttcgtgacttttgggcatggatttgtggtcaagaagacagctgtctatcttataagaactttgggagaaccctcaggccctttgactagttccaagcgaacactaaaatgttggagtcactacccacaccactcgtgcagctga

SEQ ID NO: 47335 - DNA, 2709 bp, Glycine max
  Peptide Sequence Number=SeqID_139020
atggaattcgcgtcttcttcatcacccttctcaaaatccaaaacccaatggatgtacgatgtgttcatcaattttaggggagaagacatccgtaagaatttcgtttctcatcttcattctgcccttttacatgctgaagtcaaaactttccttgacgacgagaatctactgaagggaatgaagtcggaagaactgatccgagcaatagaagggtctcagattgcagtagttgttttctccaaaacctataccgaatctagtttgtgtcttcgtgagcttgaaaaaatcattgaaagccacgaaactcgtggccaaagagttttacccatattctacgaagttgatccttccgatgtacgtcagcagaagggtgattttggagaagccttgaaagcagctgcacaaaaaggattttcaggagaacatctggaatctgggttgtcgaggtggagccaagccatcacaaaagctgcaaacttgcctggttgggatgagagcaatcacgagaatgatgctgaactagtggagggaattattaacttcgttcttactaaactagactacggcttgtctattactaaatttcctgttggattagaatcccgcgtggaaaaagttattggatttattgaaaatcagtccaccaaagtctgtaaggtagggatatgggggatgggaggattgggtaaaactaccattgccaaaggcatctacaatcgaattcatcgttcattcatagataaaagtttcattgaagatgttagagaagtttgtgaaacggatggtagaggggttactcttttacaagaacaacttctttcagatgtgctaaaaacaaaggtcgagataacaagtgtagggaagggaagaactatgatcaaggggagactttgtggaaaaaggttgctcattgtacttgatgatgtgaataagtttggccaattaaaagatctgtgtggaaatcatgaatggtttggtcaaggaagtgtattaatcattacaactagagatctacacctactggacctacttaaagttgattatgtttatgaaattgaggaaatggacgaaaatgagtcccttcagctttttagttggcatgcctttggacaaccaaaaccaagagaagacttcaatgaacttgcaagagatgtagttgcttattgtggaggattaccattagctcttgaagtccttggttctcatttaattagtaggacagagacagagtgggaaagtgcattgtcaaggttaaaaatgactcccaatgatcaaattcagcaaaaattaagaataagttttgatgatttatatgatcatatggaaaaacatatatttcttgacatatgttgtttctttattggtaaagacaaggtctatgttacacacatactaaatggatgtggactacatgctgatattgggttaacagttctcatagagcgtagccttgtaaaagttgaaaagaataacaaacttgcaatgcataatttgctacgagaaatgggaagagagattattcgtgaaggttcaagaaagaaacttgggaagcgcagtcgtttgtggtttgatgaggatgtagttgaaattttgacagagaaaactgggacagaggctattgagggattggctctgaaattgcattcaaacaaaagatattgcttcaaagctgatgcttttgcagaaatgaagagattgagactgttgcaacttgataatgtagaactcactggagattataggtatctttctaagcaactgagatggatctcttggaaaggattttctctaaaatacatacctaagagcttttatctggaaggtgcaattgcaattgatttaaaacacagtagtcttagactagtctggaaagaaccccaggttttgcagtggctaaaattcctcaatcttagtcactccaagtacttgaaagaaacccccgacttttcaaaattaccaaatcttgaaaagctcattctcacagattgttcaagtttgctcaaggtacaccaatccattggagatctccagaatcttctatttataaatttgaaggactgtaaaagcctaagtaatctccccagatcgatatataaattgaaatctttgagaactctcatcctatctggttgttcgaagattgacacattggatgaagatataatgcagatggaatccttgacaacactaattgctgaaaatactgctgtgaaacaagtgccctttccaatagtaagttcgaaaggcattgggtatatatccatttatggatatgaaggattttcacatcatgtttatctttctatcatgcggtcttggatgctaccaaaaatgaatcccctatcttgtattcgctcgtttagtggcacttcatcatctccaattcccatggacatgcagaataaaaatttgagtgatctagcaccaccaatttcaaattttcgaagtgttgtggtgcaatgtgagacagagattcaactatttaaccaaataagaacaattctagatgatgtgtatggtgcaaattttagtgaattagaaataacatcatatacatcccaaagttcaaatcattccgtgaagtcttatttgattggcattggagattttgagcaagtcttcatttctctcagcaacagcatatctgaggttcctttcttcatcttcatttacataccttcactaatcattttagctattaattattag

SEQ ID NO: 47336 - DNA, 1050 bp, Glycine max
  Peptide Sequence Number=SeqID_139021
atggaggaaatggacgaaaatgaatcccttgagctatttagctgtcatgcttttggagaagcaaaaccaacagaagacttcgatgaacttgcaagaaatgtagttgcctattgtggaggactaccactagctcttgaaggtaagtccctttttctctcattcttgcatttcttcttgtcgcctcaacttcttcatcgcggcactgcgggagatgagggagctggcgcctcaacttcttcacgtcactctctctctcttagtggagacagcgaagcaaggggaaggcctttcggtaccaccacttcaccggagggaggcaacatgcaatcgaagatggcattggcctacagctacccgaggagcgaccactcctgtcctccagccacgtcacgcaccccaccagctacggctttgttcgcacgacatcgttcacgcggaaccgctcttgccccttgcacactaagaagaacctctgacctcagcagtgcccgagatggcgttgttgtagatgacgccgaagcagaggttggtatgaaggagcctatgcatcatgatgcggtagcggaactcgaagatctggagggggaggatcgcaccggggaagaggaccaaagggagagggaagagagcgagctccagtgcatcgttgggggctgcttctccgacgacgccgagcattggattaaggttgaggcattgaaagccataaagggaaaattgattgatattaatggaaatttgagcaattgggatcgtggagacccatgtacatctgattggacaggggttatgtgctccaatacaacagtggacaatgatgtctgtgctgtcccattggttgttcattaccagttgaaaagtccaggatttttagatttccatacatacgtgagagaatttgagagcttcctcacaaatggtcttactatacatactaatcagctgttcattgagcatttcggatgggaagaagggcggttgagaatgaacttgaaggtttttcccgaatacattggcaatggaagttctcatatgttcaccacaagtgag

SEQ ID NO: 47337 - DNA, 90 bp, Glycine max
  Peptide Sequence Number=SeqID_139022
atgataagctttagagaagcagagttcattaagcaatgttttccctggagtttgacatggttttggagagaggagagactagtgttttag

SEQ ID NO: 47338 - DNA, 339 bp, Glycine max
  Peptide Sequence Number=SeqID_139023
atgttgcttccaccaacccaacctccaccactagtacatattccacccacccttccaacccctaatccaaaccaaacactcggccttgaccctccattagaaacaaccatttctcaaacacttcctccacccactcactctaacattgcacaaccactaaaccactcaccatcaacccaaccatcaccactctcactcgaggaacacacaacatatgctaaattcaggaaacaaggatcaatcatcacaatggtcattacattcattgccaagatcttctacagaattgcaaacgtctctctacctataaatacaacatcaaggattgaaggactttaa

SEQ ID NO: 47339 - DNA, 342 bp, Glycine max
  Peptide Sequence Number=SeqID_139024
atgttaggtgatggtcaatggcccagagaggaaggctccaaagttggcccagttggcgatggcgtcgcttcggctcaacactttacgcccttgctcagaagtaacttccggatgaatgagacgatccgaccggaaggagctgcgaaaaaatccctaattattcaagatataccttgtcagtgcccaaagtgttcccccgaactgcttcagtgcaccacatcagtcggaacttcacaaggccccgacgctcaattggcaacaacatccgatgaaagactaccagcaacatcgatccaattccaccgagccaggtggaaaacattcatgtcgacaccagcctaa

SEQ ID NO: 47340 - DNA, 765 bp, Glycine max
  Peptide Sequence Number=SeqID_139025
atgggtccaaacgctgcggcggcgaaacaagcggaaaagctccgaattgacggcaacacttacttcaaaaaagaccgtttcggtgccgccatcgacgcttacaccgaggcgattacgctgtgccctaatgttccggtttattggacgaatcgcgcgctgtgccatctcaagcgcaatgattgggagagagtagaggaagattctcggaaggcaattcagttggacagcaattcagttaaggctttggatcttgggagaggtgccaatcccaagggctatatggtagaagaaatatggcaagagcttgcaaaggcaaaataccttgagtgggaacgattatcgtccaaacgatcatgggaattgcagtgcttgaaagaagcttgtgagtctgctctgaaggaaaaacattttctggatttctctcaaatggaaggatttgtagatgatgctactacttcccagtcagaacaattagaggctttagaaagagtcttcaatacagctgcagaagctgacacacctactgaggtgccagattatttgtgctgtagaattacactcgacattttccatgatcctgtaatcactccaagtggacttacatatgagagagcagtgattcttgagcatcttcagaaggtgggtaaattcgacccaatcacacgggaaccccttgatccatcacagttagtgccaaacttggccattaaggaagcggtcgaggcattcttggacaaacatggatgggcctacaagatagaataa

SEQ ID NO: 47341 - DNA, 132 bp, Glycine max
  Peptide Sequence Number=SeqID_139026
atggatagaagactccaagaagattgggccaaagatgcaagagaatgccctaggattctcatgagtcttagggtagggtaccctagaaaagtaggaattttcagcccttgtattttagggcacctagactag

SEQ ID NO: 47342 - DNA, 285 bp, Glycine max
  Peptide Sequence Number=SeqID_139027
atgcttcagcgcactgtggagtggatattacctacgcctactccatatcgtctagtggagccagtccaagtgatcgaggtgacgtcattcgaggaagaccctgaggaggacccagaggagctacctcctgagcttgctgtggatgctcttgactttctagagggtaatgaggacccactccctgaggtcgattctcctgaggacgtcatgtcggcatctgaggcagactctacggaggagagcggccctggagagatggcgactagtggaggctcttcatcatag

SEQ ID NO: 47343 - DNA, 741 bp, Glycine max
  Peptide Sequence Number=SeqID_139028
atggaaaaatcgtcaaagaggcgcaagggctcatcatcctccaccaccactgtcggccaccatcgccacgatccttctggaactttagttgatgattggaaaccaacttatcctagtcttgatgctcgtaaaatggtttgtgctgcaaatgctaatatatctggtcgcttacgtgctggatcctttacttttgaatgtcgtatcatgcattacattctctgtcgtgtgttgcttcctcattctactaaccttactcaagccactgaggaaggcttaattttgatgtggacattgcaaactagacgccaaattgattgggcacatcttgtttgttaccgtatgcacaaggcattacgtgcaaattcccctctatcatatccccatctggttactctgtttttgaagcacttcaaagtccctcttactaatgaaccatctgtcaagattaagcgttcatttacagtaggagccgttgcagttgcttcttttggttataagaaatatcttgatggacaatgggttcacaaacaggattaccaagcaaatgctcccgacgaacgcactccatctccaccacctagggatccctcccctgctttactgaatgatgttctcaacgagatttgggatcttcgcgcttttgtttgcaaaaggtttgattccatggattctcgcatcattggtcttgaggatgacatgggatttatccgtcgttgctttgatcctccaaccgatccttag

SEQ ID NO: 47344 - DNA, 351 bp, Glycine max
  Peptide Sequence Number=SeqID_139029
atggcctcctatggtgttagttcaaaatttatttttctcttggattggttaatcgctgctcttgctagtgctttgtatgcgaggaggaacaacacagaaagaagaaggaaaatactacaggacaggacaacacaaccaattccagaggaacctcaatcttctgagtcgtcttctatttttctagaaccaagggaacctgaattaggtgcatccatggcttatatcatggctggagatcaacctaggagggttactcttgaagattattctagctcatctgtgccacagttcttcgcaagtattgcatgccggaagttcaagcacccaatattacttaccctcattctttga

SEQ ID NO: 47345 - DNA, 291 bp, Glycine max
  Peptide Sequence Number=SeqID_139030
atggcttatgcctatgaggcttccatagcccaagagcctcagtcagagcctcagccacagccgaaggccactccagagaccactccgcagacttctccagttactacaccaattttggaggtctcagaggaggaggatggcattgcagatacagatcatgcagcagacatggcagaaacacagatcacttgggatccatggcccacaacagctcaggatattcctcagccagcccaggatgctcattcctcacctcaggacgagcctacagcagcacaggaggagccatga

SEQ ID NO: 47346 - DNA, 159 bp, Glycine max
  Peptide Sequence Number=SeqID_139031
atggcagcggaatggagaaggaagaaagatgattggagatgccacctcaaggagaagatgagtcaagaagaagctcaccaccataagaagtcatggataactatagttcagcccactaatccaagatcaagtccaagattctccactaagtgtgcttag

SEQ ID NO: 47347 - DNA, 420 bp, Glycine max
  Peptide Sequence Number=SeqID_139032
atgtggatgaggctatccaacatcaaactgcaccgaggaggaagagatgaaaacacaagccacccctttaacccaaggtatgcaatcctcacagaatcctctatgtttgattttagcaaactaagcatccataagcaaggagacggtgagaggatggccaaattcaagaaatacgtggagatgctacaagggaagaaggaggaaccacctattgaaaaactcacatggggcgtgctacatgaagtaagagccacaagacatttggaggataaaggatgttttactatctccatcacattgggaaatctctttatcgaccatgcactacttgacttaggcgcgagttgcaacctcatgcctcattctttcttagagaagattggtcgccttaacctaaagcctaccaacatgactttataa

SEQ ID NO: 47348 - DNA, 360 bp, Glycine max
  Peptide Sequence Number=SeqID_139033
atggcgtttctaatcatctttctccttctccattccgctgctattaaaattcaaaaagcaaaggactccattgatgaagaagatctaaggcctacaagctccacatggagctacctcaagcaaccttggattacttccttgacttggctcaaggaatccatacacattggcattccccgctcacatactcgtctcaatcatatgcctattgttgttaaaataaaagattctcagacattgaccaccatgagctatttcagaaagatcttcatgctttatgtacaatgggaagctatcattatgtgccccaaacacgatagtgtagaagtaagctttatgatgatgatgaatcaagattga

SEQ ID NO: 47349 - DNA, 474 bp, Glycine max
  Peptide Sequence Number=SeqID_139034
atgtcacatgaagattttcaaagtcttatgataccatcctctgttaaaatgctaaaacataacccagagattatgttggagtctgtcgggattctattgaagtatgttaaccttgatctaatattagcacaggctcggcatgctaatgaagggagaagggatgtggcattagctatagtccagagtctgagcccaaaatttagcaatccaattgcattagacacaatgttcaatgctatcaaagctattattaaaggctcggaaggaaggttggcttttccataccagagagttggaatggtgaatgcaattcatgaactgtctaatgcacctgatggaaaatacctcatcaaatatgtgattttcttctatcatactacaaggatgatgggaatgtattattatatttccacgctcacttggattcttgtacatgggaattatacacagtttcctgcaacccaacagatgtga

SEQ ID NO: 47350 - DNA, 285 bp, Glycine max
  Peptide Sequence Number=SeqID_139035
atggtgaggctcctaaaaacattaagatgcttatggatgggctcagtgaaagtagtaagagggccttatagggagtgtgatgaagagccactaaagggtgaggagattagcatgaaggaccttagcttgggaggagtcatgattagagcaaggctcaagaaactacaagaagagttcaacaagaagatgacctcacttatgaataggggtgggaataggtcagaccggcctacaggggcctacgacatggcctacataaagtctgacctgaactggcctatttaa

SEQ ID NO: 47351 - DNA, 378 bp, Glycine max
  Peptide Sequence Number=SeqID_139036
atgactaggagcaatccatgtgatttacaaccctttgatcctgaaataaatagaacatttcatagattagttaggcatagtgtgcatcctggtcattctgtgcattttgagcattctgaatattctgattttgaacattccactactaactttcatactgaaaacatggttcaacctccacctcgtgagaggactcttagggagatggctgcacctgatttcacttatgaaagcttgtgcattcaatatcttgatgagggtgttccatatgttctcaagactggactaatacatttgctgcccaagtttcatggtcttgcaggtgaagatcctcataagcatcttaaggagttccatattgtttgttcaaccatgtag

SEQ ID NO: 47352 - DNA, 384 bp, Glycine max
  Peptide Sequence Number=SeqID_139037
atgaaattgatggtttactctttgctggttacttggatttgggacttgggagattgcattttcttaataacttatgttaatggattctgtagttataggtatcagcatttgaaattatatccagaagatgaatctagcccccagtctatgaagaaactcgtggttgttgaatcttataacgagattgttttccctgaaccctcagaggtttttcttgcatatgtacagaatcatcatgttgttaatgtgcctagacttcctgctgtaccaagcgatactgtgaatgataaggagagaggtgacagcaaagatcatcctctaacccaatggttcttgaacttctctgaggctgatgagctcttaaaacttgcagcagctcgctag

SEQ ID NO: 47353 - DNA, 876 bp, Glycine max
  Peptide Sequence Number=SeqID_139038
atgggtttcatggctcgtgctaaaggaatacctgctttagaattatataggcttgctcaaaagaagaaacgcaagcttgttctatgtggccattcacttggcggagcagtagctgcattagctactcttgccattcttagagtaattgctgcttcatcttcatcaaaggacaatgaaaatgtctccatcaaatgtattacattttctcaacctcctgttggaaatgctgctttgaaggactatgttaatagaaaaggttggcagcaatatttcaagagttactgcattccagaagatttggttccacgtattttatctcctgcttattttcaccattataatgctcagactctgccagggccttctgaaaatgaaactaacagctcaatattgagaaaacatgagcaaggggtagggaagccaaaacagaaggatgtagagcaattggttttgggggtaggtccagtgcagagatctttctggagactctcaaggctagttcctttggaaggtttacgaagacagttaagtaaacacagagaaagacggatcaattttgttgaaacaaattcattgcctggttctcttgctaatacattgattgaggaggaagtagttgcaccacagccacttgaaatacaagagggttctgatggcatatcactcaagcctttacctgaaacagataaacattcattagaggttccaactaatgggaaaacagatacaaagagcaatgtgatgactggagacgaaataaagtggcgcagagtgccttatttaccttcatatgtgccatttggacagtttttcactttcctactgtttcctggtgtattgcttttgcatgttattgtttattgtgcttgcacataa

SEQ ID NO: 47354 - DNA, 1284 bp, Glycine max
  Peptide Sequence Number=SeqID_139039
atgggtccttttgggtggcaaagaggaggcaaacaattgaggaaggccaataagaaccttggcagaatcacactacaaaagctagctgttttagttggagaaccaagcaattggatcctcacagaagccttaatgccttatggatccgcgattgacacacgccggaaacaaggagggccaacagcaaggctaccaacgagtaaactagcgagacaagaaggatatatcgtccttctacttcacgcgattttctcaagatgtgacggaactggacctttggcaccagttcaagaaatggggcgattgagtgatgtacatgagctagcaaggcagctggaccagtttgtcatcggaggtctgaagttgtatgtcaacattcccaaatatgggagagacacgacaatgaagggaaccacacaacctgaaacaaccaggtatgagccgaaacagcagcacattgcacgacattggggacaacataggggagcgtcacgctcgtcgttaaccattgacatccctttgactgacaagaaatggttcagcgaagcttgggtaaggcgcatgacaaacctaacatggtttgacagactcgaagaagatcctctgtgggacttcggagcagatataactccgaagtacctaggggacgacatggttctattactcgggctctcggatgacagggctgaacgaatgatgcaagaggagaaaaaatatatccagcagattgtggcggcaatgggggatgtggtcgacgttgacaatgatgtagaagaagcccgtagggtggatagagcaagggttgtggaggaaatcaatcgaggctttgatagctatatctgtcagcgaaggagggatttatggtcgtcggaggaaatcgactccgacgagagctgcttcagaacaccgacctcagcctcaccagtcgcgccatccgacaacgatgacatgcatcacagtcaggcgtcgcgcaacacggtggaaccacgacaatcgccactcgcgttcaacaccgagaacgatggggtcgggatcgttaagttacccagtgggttatctgaggacgaagatccagagggtaacccctccgaccagcgggtaaagtctcgcatgtcgacaagcagcagaacggctctctgcgttgagagggatggtggccatgtgggattctattctagatggatcagatggattgagggatgtctatcatctgcgtgcgttgagagggatggtggccacggtacccataagggtggtggacaaattggtgcgcatacaacgtag

SEQ ID NO: 47355 - DNA, 114 bp, Glycine max
  Peptide Sequence Number=SeqID_139040
atggctcaaaagccctacggtaacttctatcctaatttggtagactatagatctagtttggctaacaactcaatggatcatgataggatgacaaaacgggtccgtcccacatag

SEQ ID NO: 47356 - DNA, 210 bp, Glycine max
  Peptide Sequence Number=SeqID_139041
atggagacttactggatctccaagagacaaaagtcgttggaaaagagggtgaagagcttgctagagtgggagatgaagaaggtggacttgggagttgctcgtcttcttcgtggagacttactggatctgcaagagacaaaagtcgttgaaaaagagggtgaagagcttgctagagtgggagatgaagaaggtggacttgggagttggtag

SEQ ID NO: 47357 - DNA, 507 bp, Glycine max
  Peptide Sequence Number=SeqID_139042
atggctacaccacctagctctcctcctcttcctccttctactggtgtagcatcgcattcaccgtctacctcgaaacagtttaagtatgatttgacatcgaaatgggtacttgcaaccaacaaggacaatgtcgatgacactgtatgcaaaaagtatgacattagcaaggagaaatgggcccaattttgtcagagccgcagagagacccttcgtgggaggatgtgtgaaaaaaggcacagaccatccagaaacaaaacaacccctcacgtgttgtctcgtgggggttatgaatatcttgaaaacaagttgatggaggagaagaaaaagaaacaactagatgaagctgctaaatctagaagcacatacactgtcattgatcctccatcttccatcagacgacacgtgaagtggaagatggcccacactaagaaaattggacaaatgacttatgaggcagctaaagaaattgctaacaagattgattccttggaggagcaagcctcatag

SEQ ID NO: 47358 - DNA, 879 bp, Glycine max
  Peptide Sequence Number=SeqID_139043
atgaatatggacgaggaatcagagaaagtggcagtggagttggctgcacaaggagttattggaaagagagttgatgagatggaatccgatttcatgatggcccttgactacatgatccaacttgctgagaatgaccaggatgataagcgtaagtcactgttggaagttatcaaagagacagtattatcacatctaaccaaaaaatgtccaccccatgttcaagtaattggtcttctatgtagaactccgaaaaaggaaagccgacatgaattgttgcgccgagttgcagctggtggcggtgtatttaaaggcgaaaatgagttgaagatgcatatcccagctgcaaatctaaatgacatagctaaccaagctgatgatttgttggaggcaatggaaactcgtcctgttatcccagatcgaaaactacttgcaaggcttgttttgattagagaagaagctcgtaatatgatgggagggggaattacggacgaaagaaaccaccgtggattctatactcttcctcagcctgaggtggacttcttggccaaattggtggctctaaaacctggaaaaaatgtgcttgatatgataagaaatgtaatgcaaggaaaagatgaaggtgcagacaaatctggcaacaacgatgaggatgacactacaaatggggatccagctgaatttcttggaaggccacttgtaacgggagagaagacacttccagtgcgccctggcatgtttcttgagactgtctccaaggtcttgtctggtttatatgctggaactgattctggcatcactgcacaacacttggaatgggtatattctctttctctctatagattcacaattttttctatttccaagatcaatgtcctgtga

SEQ ID NO: 47359 - DNA, 279 bp, Glycine max
  Peptide Sequence Number=SeqID_139044
atgtgtttctcgctagaagtctgggaaggcattaccagtgacgacctatcttctcttggtcagtgtgcatcaaactacttggagaggttctataggatatttcacccattcatgagtttgccacagcttagggaacctcctagacatccacccatgatgcatgatgatacatttattgtaccagatccacctatgttgcccgctcactcagcagttatgccacaaccacatgcacttgcagttgtcgatccagacatgcctcaacatgcagcggcataa

SEQ ID NO: 47360 - DNA, 420 bp, Glycine max
  Peptide Sequence Number=SeqID_139045
atggtggaagaagcagaaacgcgaaggagaaacgtacctcgaagaagaagcataaactcggagaagaagcagaaacacgaagaagaagctttccacttgaccccggcaacaatggcggcaacgaagatgaagaagaagcagaaacgcgaagaagaagccttcacttgggaagaagatgctgaatcgcgacgcgaagaagaagaagaacgaagaagatgcagaatctcgaagaagaagcagaagaagaagcagaagcagaaccgtccaaggaaggaagaagaagaagcaggcgtgggagagaaagaggcgagacactcatcgtctaatccgtacccacctaaaccgaatattctagttgggtgggttcagatcttatatgctaactcattgggttgggtcgaattgaattttttacattga

SEQ ID NO: 47361 - DNA, 468 bp, Glycine max
  Peptide Sequence Number=SeqID_139046
atggacaggctcctggtcgcatctccaaaggcttatcaaacccaaggtccacccttggtgagccttgacaaaacccaagacagacatgctcctggtcgcatctccaaaggctcccaaaacccaaggtcctccattggtgagtctcatttctccaaaagctcgcaaaacccaaggtcctccattggtgagtctcgtgtctccaaaggcttgtcaaacccaagtcccgtccttgatgagtctcacttatccaaaggctcgtcaaacccaagaatgctccaaccttatgggatcaacataggcttaaaggaggactcaaacccggtgacccccaaggcctacactccgaagagtccgtcagagcctctccctcctgattcagataacgctggtcgggttattgtacaattcatagcttacaacacaagtaatttcacatcaagcgttaactacacacttatccacaactag

SEQ ID NO: 47362 - DNA, 3082 bp, Glycine max
  Peptide Sequence Number=SeqID_139047
atggaattcgcgtcttcttcatcatccttcccaaaatccaaatcccgatggacatacgatgtgttcatcaattttagcggagaagatctccgtaagaatttcatttctcatctctcttatgccctttcaaaagctggaatcaacactgtccttgacggccaacaaatggagctggaagaactaatgaaaccagaaaagtctcagatctcaatagttgttttctccaaaagttatactgaatctacttggtgtcttgatgagcttgcaaaaatcattgaaatccatgaaacttatggccaaagagttgtggtcgtattttacgaaattgacccatcccatgtacgtgatcagaagggagattttggaaaagggttgaaagcagctgcacgaaaaagattttcagaagaacatctggaatctgggttgtcgaggtggagccaagcactcactaaagctgcaaatttctctggtttggatttgaagaattgcagggatgaagctgaactggtgaaacaaattgttaacgatgttcttaataaactggaatatgaagtccggtctgttaccaaatttcctgttggattagaatcccgtgtgcaagaagtgattagatttattgaaaatcaatcaaccaaagtttgtatcatagggatatggggaatgggaggagtgggtaaaactaccacagccaaagccatctacagtcaaattcatcgtagattcatggataaaagtttcatcgaaagtattagatcagtttgtgaaacagatagtaaaggacatgttcatttacaagaacaactgctctccgatgtcctaaacacaaaggtcaagatacatagcattgggatgggaacaactataatagagaaaagactttcaggaaaaagggtgctcattgtacttgatgatgtgaatgagattggccaattagaagatttatgtggaaattgtgaatggttcggtcaaggatctgtaataatcattacaacaagagatgtaggcctactgaacctatttaaagttgattatgtttataaaatggaggaaatggacgaaaacgagtctcttgagcttttttgtttgcacgcttttggagaaccaaatccaagagaagacttcaatgaacttgcaagaaatgtagttgcttattgtggaggactaccactagctcttaaagtccttggatctaacttacgtggtaggagtaatgaagaatgggaaaacatagcctatgttacagatatactaaacggctgtggactacatgctgatattggaatacctgttcttatagagcgtagcctcataaaaattgaaaagaacaacaaacttggaatgcatcctttgcttcaacaaatgggaagagagataattcgtggaagttcaataaaggaaccttttattgaacctgggaagcaaagtcgattgtggtttcatgaggatgtacttgatgtattgataaagaatactgggaccatagctattgagggattggctctgcaattgcatttatccatcagagattgcttcaaagctgaagcttttcaggaaatgaaaagattgagactgttgcgacttgatcatgtacaactcaccggagattatgggtatctttctaagcaactgagatggatctattggaaaggatttcctctaaattacatacctaacaacttttatctggaaggtgtaattgctattgatttaaagcacagtaatcttaaactactatggaaaaaaacccagtggctaaaaatcctcaatcttagtcattccaagtatttgacagaaacccctgacttttcaggactaccgagtcttgaaaaactcattctcaaagattgtccaaggttgcgcaaggactgtacaagccttagcaatctcccaagagagatatataaattgaaatctgtggaaactcttatcctatctggttgtttgaatattgacatattggaagaagatatagtgcagatggaatccttaacaactctaatttccgacaatactgctgtgaaacaacatctgctgcataatgatttgggtgatctaccaccaatgcttagcagcatttcaaaccttcgaagctttttggtgcaatgtgacacagagttccagttagataaacaagtaaaggcaatgcatatcgtttatggtgttaattatacagaattagaaaattcaaagaattacttgaggtctgattttattggaattgacagataccaagtcttcaatactctcactgatgatagcatatctgaggaaatgggaaccattgaggcttggcgggatgttttgctcccaggtgacaatcatccttactggttgacccatacaggtgagggacattcagtgtgctttactgtgcctgaggattgtcccttgaagggaatggctttgtgtgttggttattcatcaacccctaaaatcatggcaaccaaatgtcttattagtgtcgtaatgggcatagtatcacattttggtcctggagacaaggtgaagatttttgtgctttttgatcatggattagttgtcaagaagacagctgtctatctagcgtgtgataaatcaattggcaaggaaatggagcctccgccttctgccgaaaagttcagaaatatgttagtggcaaaagaactggtaactggattagtaccatttggcatggtaattgccgacaagctcaaagtagtggcagtagtggcagtactgcttctcaaactgttagtttttctggtattcaatgtgatgttcctaaactcaaaggagataactataagatttggaaggagagaattcttctatcattgggcggtgggagcgatccaatcggctgggatacgtgattctatcgaccaacatgaaaaggtccgagacttgcttaaggtcattgaggaccagttcatcacttcagataaggctttagcaagcaccctgatcatgaagttctcatctcttatgctcactagtgtgaaagaagaaaggcttgtaatggagataggtgagagttcattgctaacaactgcttgtgggaagaaaaaagcaactaagtctcaagctaatcagaaggggagtg

SEQ ID NO: 47363 - DNA, 311 bp, Glycine max
  Peptide Sequence Number=SeqID_139048
atgtcaaacacaatcaggattgagaaattcaatggaaaaaacaacttcaatctgtggcgcattaagatgcgtgctttgttgaaggaacaacgtgtttgggcttatgttgcttctgcatctgtgaagaaagaagtggcttctgaatcaaaagaaaaggtctttgtttcaaagattgaagaacttgcagaacaagaagaaaaggctcactcactaatcttgctttccttgtctgatgaagttttatatgaagttgctaatgaagaaattgcaagtggcttatggctcaagttggaaaagctttatatgaccaa

SEQ ID NO: 47364 - DNA, 174 bp, Glycine max
  Peptide Sequence Number=SeqID_139049
atgactgatgaagacacttgcccgttatgccatgataaagctaaatctatggaacatgcttttagagactgtacttggacggatgagtctggaatatggaataatcctatacaggggtgtatgaaacttaaccatgatggagcttatcttctagcagtaggagtaacttcatga

SEQ ID NO: 47365 - DNA, 63 bp, Glycine max
  Peptide Sequence Number=SeqID_139050
atggtggtgtttctggtgctctcaaaagctcctcatccggttgctttgttagggttcttgaaa

SEQ ID NO: 47366 - DNA, 265 bp, Glycine max
  Peptide Sequence Number=SeqID_139051
atggatcaaagctctaaagtctatataaagcttgaagatgttcatgatgaagttgtcaaatcactagagaatctagggtgtgaggtcttgaaggaattacctcctatggttgtaaaactctatgaaaagataaaaaccttgaaggataacctaggcaaagaggttatggatagtgaagaagtcattgttttctatttctgtggaaaggtaggtcatgagactcataagtgcaaggacctccctgaaaaggacaacccatcacagg

SEQ ID NO: 47367 - DNA, 198 bp, Glycine max
  Peptide Sequence Number=SeqID_139052
atgcattaccaaaagaggaaaactctagatgaggcttcactgttatcaagcgagtcagagacccagcatgaccatagatcgacctccactccttatggcttactgtcaaaagaggctaaaaggagcagttgcgctaagcagaccgttgggctcagcgcgcattcaccgctaagcgcagcttcaacacacttagcgtga

SEQ ID NO: 47368 - DNA, 849 bp, Glycine max
  Peptide Sequence Number=SeqID_139053
caaagaatgagcgtctgtcaactggttccctcgatggaaagaaggaagaatcgggattcttatttcgtgcggagggggcaccactagaggaagagctcgcacctattattgcacgaggtttcaataagaccaacgtggaggcacttcagaaggtccgcaaggcatgggatatggtgcaaaagaaggacaaagaactcagaggcagtaacaacgggtccatcggcggctaccgtaagtggttgaaagcccacatgcaaggtttggattggctctcgagtttgagaaccactaaaagggaggaagttgaggcaccggaggaagacgaagaggtgcaggcccttagggcagaactcgagcaagcccaaatagtcaaagaaaggttcaaatcagcagctcttaagatccgaaaagagaatgccgaactgagaaatgtaaatatagctaccaccaaggccttggaacaagagaccaaaagggctcgtagggaagaacacggccagaacaaattccgaagggctctgtggggcagtaacaatgagcttaagctccggagagaggaaagggaccaatcacgagtagacagtttgatcttgaaggaggagttgaaggaattaaatctagccacggcccacgagcacaaagtggcggacgagtatgcccaagtgtacgcgaaaaaggaggctagaggaagggtgatcgactcgctacatcaagaggcaacgatgtggatggaccgatttgcccttaccttgaacgggagtcaagaacttccccgattgctagccaaggccaaagcaatggcggacacctactcggcgcccgaggagatccacggacttctcaactatt

SEQ ID NO: 47369 - DNA, 249 bp, Glycine max
  Peptide Sequence Number=SeqID_139054
atggctccgaaaaagctttccgcgaagagatctaggagggacaccgcggctaaagggaccagtgccgcccccgaagagagacgcgtccagctcaggaacaatgagtacatggattttcaggaagagatagctcgccgacattggacgtcgctcgtcactcccatggctaagttcgacccagatatagtcctagagttttatgctaatgcttggcctacagaagagggagtgcgggacatgcagtcatag

SEQ ID NO: 47370 - DNA, 357 bp, Glycine max
  Peptide Sequence Number=SeqID_139055
atggataatgccaagaggagacgtgcaggaacccaagatgaaggccgccatctgatcggccttaaaagatgtccaattatggcgttccatctacggaggcaagttgaatatgctgcaaatatggccccctcgaatccgggccaacagaagagccccaggcagtgttcggcgcgaggaaaaagacagaaagagcgccgacccaacgcacagctccagatcccaccccggccaggaaagattgaagcgctcgaagagaggttaagagcagtcgagggcctcggtaattacccattctcagatttggcagatttatgtcttatgcccaacatcgtcatccctcccaaattcaagtactag

SEQ ID NO: 47371 - DNA, 48 bp, Glycine max
  Peptide Sequence Number=SeqID_139056
atggccgaccagcaggcgaccaagtccaaagccaaaggacgcacctag

SEQ ID NO: 47372 - DNA, 575 bp, Glycine max
  Peptide Sequence Number=SeqID_139057
aagatccatgcgactctagatgggcggtggttttgcaagggagaacaatttgtatcggtcaccatgttgatggatcaacacttgatgtcactgacatgccgtctttctccaaagatatgccttcaagtactgttgaacaggaagaggatgatgtatatgcaaatcgtactgatcatgaagagggtttatgggagaacattcgtacggccatggcaacaccaccaacgtccccacaacaatcagaaaaccatccagaggttactttgaaaaggacaagacaatccatgaggttcagaagtctgatgactagattcttagatggcccacggccaattgtgaacgtgaatccggctacaggtaaagggtcagggcctcataaagagaaatttcacagttatttaggggttgtcgcaagggaaaaagttcttattgtacacgcgaattggaatgttgtccccgacgatctaaagagcttaatatggaaagatattttgcgcaaatttgatatccctgaaggtgagaatgcaaaaaaagaaggtgatgtcaacagttgcagcaagatggaggcaatttaa

SEQ ID NO: 47373 - DNA, 553 bp, Glycine max
  misc_feature (248)..(248): n is a, c, g, or t
  misc_feature (375)..(375): n is a, c, g, or t
  Peptide Sequence Number=SeqID_139058
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgcaagggggatgtgctgcaaggcgattaagttgggctccgnccccctgacgagcatcacaaaaatcgacgctcaagtcagaggtggcgaaacccgacaggactataaagataccaggcgtttccccctggaagctccctcgtgcgctctcctgttccgaccctgccgnttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgttgcgccttatccggtaactatcgtcttgagtcaaaccg

SEQ ID NO: 47374 - DNA, 687 bp, Glycine max
  misc_feature (188)..(188): n is a, c, g, or t
  Peptide Sequence Number=SeqID_139059
agcgcacgagggagctttccagggggaaacgcctggtatcttgatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctntcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatggaagcttcgatgtcgctcctccaccgctccaactccggcaagagcagaaggcttctctccccggaaacgtccttgtgccgaaccctacagcgccatatcctgttcaccgtgtcgagataggcaggattgccgtcgcggtggagcataacagttgcgacttgtggggacaggaatggagagtggtgacactcatgaagacgctcatgctccaccgcgacggcacaattgacggcggagaccggagcgccgtcacggtggtggagctcctcaaggatcgagggtttggagaatggattcggggaaggagacggtttgcaaatggtctagaaggatctgggaaggaaac

SEQ ID NO: 47375 - DNA, 354 bp, Glycine max
  Peptide Sequence Number=SeqID_139060
atgacagatcttgtgagcgcggaagatgacgtaaatctccgcgtgtcaacggggtttcggacaccgattgacgaagggcgcagaagacgaattagtctcttgcgtgttatcaggcttttcgtcttacagacagcaaaaagtttatactggataaccactcgggtatttccgcccgtcagcgtgactcaaaaacagcaaaaagtttatacggataaccactcgggtatttccggccgtcagcgtgactcaaaagtcagtatgacagatcttgtcagcgcggaagattacgtaaatctccgcgtgtcaacgggcttgtcgtgcgtgattgacgaagggcgccgaagacgacgttag

SEQ ID NO: 47376 - DNA, 300 bp, Glycine max
  Peptide Sequence Number=SeqID_139061
atgggtgatcaagaggagacacaagaacagatgaaagccgacatgtcagctttgaaagagcaaatggcttccatgatagaggccatgttaggaatgagacaaatcatggagaaaaacgtggccaccgctaccactgttagttcggctgccgaagcagacccaactctcctagctactgcacaccatcctcccccaaacacggtaggacaagaaaggagcacactggggcacagcagcaacccccatttgggatacaaccgggtggcttacccttatggattaccgcctaatgatgcatga

SEQ ID NO: 47377 - DNA, 195 bp, Glycine max
  Peptide Sequence Number=SeqID_139062
ccgaggtgcttccgtaacgcttccgagatgtttccgtaagcaaatccgtgaaggttttcgtccgttcttcatccgttcttcgttcttcaacggaacagcccctcttcagcctttttatcggaaaaagggggaggaggttcaaaagccaacagctcgcccaggcgacgactacgttgcccaggctgagttcctcat

SEQ ID NO: 47378 - DNA, 240 bp, Glycine max
  Peptide Sequence Number=SeqID_139063
atggaagtcatgagcgattcaaatggtcttaacttttcactcggaggtctgattcaagcgcataatatatcgagatgctcgaaattcaacaacggaagctctcgagaaattcaaatggtgcataatatatcgagacgcttgaaattgagcaacggaagctttcgagaaattcaaatggtcattacttttcactcggaagtccaattcaggcgcatcacatatagagacgctcgaaattga

SEQ ID NO: 47379 - DNA, 279 bp, Glycine max
  Peptide Sequence Number=SeqID_139064
atgaaggatcaaataaatacaagtagtggggatgtctcctccacctctagaacctcacaatcactcacagactcatctcatgctctcaagatggcttcctcttcaagctcggttctctgccagtcttcacacagcttagctgatagatgcaagcgccgcaagagtggtgcgctcaacggatggctcgctaagccgacagattggcttagcgagcagatcaaaatcagcacttcacaaacttacctaattaacctaaaattgaaaggtaatgattattaa

SEQ ID NO: 47380 - DNA, 288 bp, Glycine max
  Peptide Sequence Number=SeqID_139065
atgcgcaacgaattaattaaagaacttggcaaatggtcgcaagactacataaagctctttggtggcacagagagatttgaacagttgaggttgtccctatatgtggatgggttatccaaggttagtgtggacaagtggatggatataacgaagatgagatatgtcattgcatcaagatataatgtttatctcaaagatcgttcgttgtcccttaccgcctacggcatttttgtggtcaagcaattcatatcctcaggcaaaacagtggccaactgcatatgtaggtag

SEQ ID NO: 47381 - DNA, 261 bp, Glycine max
  Peptide Sequence Number=SeqID_139066
atggagggaggcataggtcccatactagacctcactcccaaagaagagaaaaggataaaaggtctcaagagtaaagagagaaaagttccattggctacccttagcttccaaggatatgccctctattggtggacttcctttgttagtgaaagaaggattcatgggaatcctccagtaaagtattggaatgatcttaagaatgcccttaggaagaggcacattccctcttactatgaaagggggcttatggacaagctctaa

SEQ ID NO: 47382 - DNA, 456 bp, Glycine max
  Peptide Sequence Number=SeqID_139067
atgtcaccagccttaaagagttagggcagttgatgggtcagctccagcgccaagcctttcgcaaagcttacggtaaaatctgggacctagccatggtagaagtctccatagaggccattgcctccctcgcccagtattatgatcagtcgttgagatgctttacctttggggacttccagctgtcacccatggtggaagaatttgaagagatcctaggatttcctctagggggaggagaccatacctcttctcaggcaagaaccttggcagctagagacgaatgggtcccgttcatagacgttcttgcactgttgatcttcggaggagcactctttccaaatatggataggttggtggatctagcagcgatcgacgcttttctcgcctatcatgaccacaaggaaagcctggttgtcgctatgttagccgacttatatgacacctacgaccgaagat

SEQ ID NO: 47383 - DNA, 360 bp, Glycine max
  Peptide Sequence Number=SeqID_139068
atgcctcggtttgcgtaccgcctctccggttccagttcttcgcatttctctgcacccgtcggggcccattttcaaagggatcgcgcctgcaagacacccagtggacccaaagaagttcaacagggtcctggggttctagctctgattacgggcctctatcggttctacggagtggccgtcgccctcaacagggtcatcaggcccttattaacagggctttcatcgagaagtactacgcccccaggcaagcgcagggtgaggcatcatagtagaaggcaacagacgcatcgccaccacctccagagttcacctcagctcatccacaaaaaggctggagcattgcccacgacacatggctga

SEQ ID NO: 47384 - DNA, 201 bp, Glycine max
  Peptide Sequence Number=SeqID_139069
ctacacgaaagcaaaggcttaaaacgctcaagtgagaaatggtctcggacacgaaaacatcacgcacactccagacatcttctcgaagatcccaaaggtcagatcatggacaagtgtcttgtgaagctgcagaccaaatttcaagaagatccaacgattaacaaaggctggaaagcatttttaccgaggcagctcatgtag

SEQ ID NO: 47385 - DNA, 402 bp, Glycine max
  Peptide Sequence Number=SeqID_139070
atggctgcgcagttgatccatgatcacgttgtgatggagtgcctaaagggtgtttgggagaccctcgaaggcaatcagaggtaccgattccgtggcacaattcgactcactgctacttcattagtacatccggaggaacctgcacgcacacttcagcagcctgtggagtggatattacctacacctactccatatcgactagttgagccggttcaagtgataaaggacccagaggagttacctcctgaacctgctatggacgcccttgacttacctgaggatgatgaagacccgctccctgatgttgattccccagaggatattatgtcagcatctgaggcggactctacagaggagagtggccctagagggacagcgattagtgacgactcttcatcatag

SEQ ID NO: 47386 - DNA, 527 bp, Glycine max
  Peptide Sequence Number=SeqID_139071
atgtcagccagcgatcatgcaattatgcgcgatagagttcatcaacccacaaagaaaagcttgttagaactatcatcacatgactctttattggcacaaaataagttgcttgctaggcaacttgagattttaacagaaacactcggttgtaccatctgtggtgagagacaaggatatactcaaggaggattctcaggcatccagcaaggtccttataatcaacaaggacaatggagatcacaccctggcaatcaattcaacaaagaccagggtggaccttctaacaggccaatccaacaagggcctaacatctttcagaggactactaagctagaggagactttgactcagtttatgcaagtaacaatgtcaaattataaaagcaccgagtcagcactgaaagaccttgaggtccatgtgggacaactagccaagcggataactgacaagtcatccaacagttttgtggcgaatacagaaaagaatcccaaggaggaatgcaaagctatgatgacaaggagtaagag

SEQ ID NO: 47387 - DNA, 465 bp, Glycine max
  Peptide Sequence Number=SeqID_139072
atgcgggggtaccgcatggttatccgcaccttttgtcaaccaggggcacacgagcccgttgacgcgctgagactaacatcgtcttctgcaccttttgtcatcctgacccatgaaactaacgccctcttctgcgcctttggtcatccagaaatggcaagtccgatgacatgcgggggtaccgcatggttatccgcaccttttgtcaaccaggggcaaacgagcccgttgacgcgggcaaacgaggccgttgacgcgcagagactaacatcgtcttcctcatcttttgtcatccagggacaacaagtcaggtggcaggtggagataccttatggtcattcgcacctttcatcaaccgaggcaaacgaatttgacggtatcaagatgatgttggggcaattgccataccctaatttcatctggggaccattgtttggtggcatgcaacctccgcttgaccgcctcgag

SEQ ID NO: 47388 - DNA, 210 bp, Glycine max
  Peptide Sequence Number=SeqID_139073
atggtgcatccaggaggattcgaacctccgaccgctcggttcgtagccgagtactctatccagctgagctatggatgcatcggaaaatggcggggagcccttcagcctctcggccacctcaccttacgcgttcttgcgaaccgtgcttttgaactttgtttccgctcatcggcactgcgtggcgcacatattactttcccggacttataa

SEQ ID NO: 47389 - DNA, 621 bp, Glycine max
  Peptide Sequence Number=SeqID_139074
atgggatcaagtcaaatgccttcgcttaaaaagaggttctatcaagtcaaggtcaagagcctaggaatcaccaatttaaaagaactagggaagttgatgggtcagctccagcggaaagcttttcgtaaagcttacggtgaaatcagggacctagccatggtagaagtctccacagaggccattgcctccctcgcccagagaccatacctcttctcagggttctatccctcattagctagaatttccaagatagtccaaatctcggcgcaggaattagaccacaggaagcaagtcgaaaatggggtggttggaataccgagaaaatatttggaggaaaaagcaagaatcttggcaggtaaaggcgagtgggccccgttcatagatgttctcgcactgttgattttcggaggagtcctctttctgaatgtggatgggttggtggacctggcaacgattgacgcttttctcgcctatcataaccacaaggaaagcccggttgtcgctatgctagccgacctatatggcacctttgaccgaagatgtgagaagaacaatacgaggattgtttgctgtactccaactctttatgtatggttggttttgcacctttttcaccaagag

SEQ ID NO: 47390 - DNA, 801 bp, Glycine max
  Peptide Sequence Number=SeqID_139075
atgcagcgcgaaggtaacgagttggtattacaggcacagcaagacaccgtgctattgttactcaacggtgaaccgctgaatgaaccggtcgtcggtcatggcccgtttgtcatgaacacctgggaagaaattgaccaggcaattaatgactacaaccagggccggatattcatcatgaaaaacaaaccctatgtacgcctagaccgtgacaacgctgtcgttttgctggtagaccaccaggcaggtctgctctcactggtacgggatatcgagccagaccgcttcaaaaataatgtactggcgctggccgatgctgccaaattttttaacctgcccaccattttaaccaccagttttgaatccggccctaatggccccttgatgccagagctcaaagccttattccccgacgcgccctacattgcccgccctggccagattaacgcctgggataacgaagattttgttaaagcgatcaaggccaccggcaaaaaacagctgattatcgccggtgtcgtgactgaagtctgtgttgccttcccggccctggcagccatcgaagaaggattcgacgtgtttgtcgtcaccgatgcttccggcacctttaacgaaatcacccgtgatgctgcctgggaccgcatgtccgccgccggtgcacagctcatgagctggtttggtgtggcctgcgaactacaccgcgattggcgccgggatattgaaggcctgggcaccctctgcgctaaccatattccagattaccgcaatttgatgacggcttttaatgcgttgcaaggcaaataa

SEQ ID NO: 47391 - DNA, 243 bp, Glycine max
  Peptide Sequence Number=SeqID_139076
atgggatatgcttctagaggaaaacatgctaccaaaaagttactattaggcaaagaagatattgtgtctgataggtgtggggtatcacggtacaaagtgaaggataatgatgagtgtagcagtgacgaaagcacaaagaaaggccccctagcgaagatgatgcaaaagaccttacatggcatgcaaatgggagaaactacgatggaatgctccgccatccggttgattcctcccagtggatga

SEQ ID NO: 47392 - DNA, 414 bp, Glycine max
  Peptide Sequence Number=SeqID_139077
atgtcgatctccccctacggaagtatcagttgggatcgcgcccacaagacacctagtggacccggaggagcccaacagggccctggggtttccaactttggttacgagtctctgatcgcccccgcaagacacctagtggacccggagaagtccaacagggtcttggggtttccagctttgattatgggcctctgtcagttctacagagtgcctgttgcccccaacaagcgcccccaggcaggcgcagggcgagacaccacagcagcctggggatggttggcagagggcaacagatgcaccgctgccacctccagtaggcgaccaagtccaaagccaaaggtaagcaaaagtactaggtccgtgaccgacaagtcatcacgcgtccagctcaagacgttaaagaagcgctactag

SEQ ID NO: 47393 - DNA, 48 bp, Glycine max
  Peptide Sequence Number=SeqID_139078
atggatgctagggtggctaatgcatcagccattgattctcttcccgag

SEQ ID NO: 47394 - DNA, 192 bp, Glycine max
  misc_feature (125)..(125): n is a, c, g, or t
  Peptide Sequence Number=SeqID_139079
atggtggaaaatcatcacgaaatcgctcacgataacgtctcggaagcgttacggaagcgcctcgggaggtggttgccgcccagctcgcccaggcgagctgggttgcttccaccagaaggcaccgncttctgttggaacaccctggaaggcccaagtgggcttggttgctatttgcacacccctttttactaa

SEQ ID NO: 47395 - DNA, 507 bp, Glycine max
  Peptide Sequence Number=SeqID_139080
atggccaagtttgatccagaaatagtccttgagttttatgccaatgcttggccaacagaggaaggcgtgcgtgacatgaggtcctgggtaaggggtcagtggatcccgttcgatgcagatgctatcggtcagctcctgggatatccgttagtgctggaagagggccaggagtgcgagtatggccagaggaggaaccggtctgatgggttcgacgaggaggccatcgcccaactgctatgtataccggggcaggattttgcccggactactgcagggaggcgagtgcgaatcatgcgcaccaacatgaccaccctgacccagatatggatgacgttgctcctcagcaacatcctgcccagcgatcataattctgacctccccctgccgaagtgtatggcgcctaccaggcaccctttggatccagataagtccaacagggccctgggatttcccgcactgatcacaggactctgccagtcgtccggagtccccattgcacctaccaaa

SEQ ID NO: 47396 - DNA, 117 bp, Glycine max
  Peptide Sequence Number=SeqID_139081
atgaagatgcttttgataccacatgataagatgaatggcagcggaatggagaaggaagagagagaggagatgccacttcaaggagaagatgagtctagaagaagctcaccaccatag

SEQ ID NO: 47397 - DNA, 556 bp, Glycine max
  Peptide Sequence Number=SeqID_139082
atgcaaaggtactccaaggagttcgcaaggcatgggatgcggcgtgaagaaaggacagagagcttaggggaagcaactgtgagagacgatgaggttaaagcttcggaagaaagtgatgaggtacaagccctaaaggcagagcttgaaagagcccgggtagtcgaagagaagttcaaggcagcaatagtgagctcaaactctgaagaggtgaaaggaatcatcatgggtcaaaggcatgatctagaaggacgagctaaggcttgccttagtgagactgaagggaatatgtgggccatcatcgatgagtgcaaagagaagctaaatctagcggcgactcacgagcaaaggctagaagatgagtacgccaagatatcagcagaaagggaagcaagggaaagggtaattgattcattgcaccaagaggcaaccgtgtggatggaccgatttgctcttaccttgagcgagagtcaagaacttccccgattgctaaccaaggccaaagcaatgggggacacctactccgctcccaaggagatccacggacttctcagctatt

SEQ ID NO: 47398 - DNA, 597 bp, Glycine max
  Peptide Sequence Number=SeqID_139083
atgaccggctgcgccgcgccgggagataccgtctggtattccacttccgataatcctaaacgtaaatatgcgcatacctgggaattaactgaaacccggcagggggccgtcatatgcgttaacaccttgcgggcaaataccctggcgaaggaagcggtactcgccggaaatatccctgagcttgccgggtataacattctgaaaagcgaagtaaaatatggtgaagaaaatagccgaatcgaccttatgttacaggcagaagaccgccgtaactgctatattgaagtgaaatcggttacgttggcggaaaaagagtacggttattttcccgatgccgttaccgcacgcggtcagaagcacctgcgggaactcatgagcgtcgctgccgcgggccatcgggccgtgattttattcgccgtgctgcattcggcgatagaccgtttctcacccgcgcatcatattgatgccaaatacgcacagctgttgatagaggcgcaggaaaagggggtagaaattctcgcctggaaagcggaactttctaccaaaatgatgactctgaataagccgatcgccgtggcgttaacccccggtaattaa

SEQ ID NO: 47399 - DNA, 594 bp, Glycine max
  Peptide Sequence Number=SeqID_139084
atgcttattccccggataccgtcattgcttcttctccgggaaaagaagttcatgacccgtaggccttctaccttcacgcggcattgctccgagtctgggccgtgtctcagtcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggttcttacgcgttactcacccgtccgccactggaaacaccacttcccgtccgacttgcatgtacaaagctgattcggaattctcttccattccaaggcataacttgtatccaggcgcttcatattcgactggagttcgctcccagaaatatagcccccccacccctcgtgtaatcccacgagcctcttatccattctcaattattattcgatcacggcatacaaatagaaaaacttacattgggtttagggataatcaggctcgcactgataacttccaccacgtcaaggtgacactctaccgctga

SEQ ID NO: 47400 - DNA, 548 bp, Glycine max
  Peptide Sequence Number=SeqID_139085
gggaaacgcctggtatctttatagtccggtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgaaacagctatgaccatgattacgaattcgagctcggttaccccttgatctccgttttcagcattccgacggttttcgccattcgcgttgtcgtcggacggaatatgtttcgttttacgtttgttactgatttggcttcaaatgctgatgcggttttgaactggaatagatcgagcaggaggagagggattgcttgtagtgttaccgagccagataacggtagcgacgagaaggtactttctttgggaatcagctcgctctctttaactgacattaagcttcacaaattggagtttgatgagatgaagacatttgacttgaattga

SEQ ID NO: 47401 - DNA, 828 bp, Glycine max
  Peptide Sequence Number=SeqID_139086
atgaagcggacacgcaaaacctcacgtctacgatcgttgtccactagaccacctggtgctgagagaccagtggtgcatgttgatcctgctaccgggaaggccgacagtccccacaggaagaaattaagaacatatttggggattgtggcgcgtgataaggtggacgtcacctacgagaactggaaggaggtccctactgctcagaaggacctgatttgggaggatattcagaggcttctaacagtaggacgaaaaggaagttactacagaccgtcggggagagatggaggtagtttaaatcagacctcacgaggaaatgggcccttgcagccgatcaggacggtgttgaggacactgtctttatttttcaagaaggcacatgccatccagaatcagaatactgccccccacattttgtctcgtgggggttatgattatttggagcagaagctcctggatgagaagacgaagaagaagctggaggaagctgcacagtcaggaagcgttgatggcgtcatcgaccctccatccccggtcagacgccacgtgaagtggaagatggcccgcacgaagaaaacaggggagatgacgactgaggccgcaaaggaaatcgctgagaagattattcctttgaggagcaggccacacagggatccttcgtcccccatggacgtcaagatgttatcgccgctactattggacgtccagagcaccctagacgtgtccgtgctgctggagccggtgtcaccatcaagcaatactttggatcggctccacggacgtcccgcagtgcttcctctctgcctcctgatgaattgcagcagctga

SEQ ID NO: 47402 - DNA, 745 bp, Glycine max
  Peptide Sequence Number=SeqID_139087
ccaacactacaggaacgaagctgtggttgttgttgctgctccacggttgcaaaagtattctagttttgatgaccagagtggggagaagcctctgcttttgcccattcaaagcttgaaatctcgctcatctgaagaagatattgatgttcaatctctgaacatgtcaatgagttctaaaagattttcaagctattcaaatagaaaagcagaagttgaagttgttgatgttgatgttgatgttgatgttcaatatctaaataggtcaacaaccttcaaaaggtcaacaatttctcaaggattttcaagcaattccaatagaaaaactgaagttataatgttgtcttcaaacacttatgttataatgttgtctttaaacacagaggattcagtgaggaagaaaggcttctacaagtcttgtcctccaccaccgccaccaacaatgtttcagaaatcagtgttcatgaagccaaggttcgatggttcatccaacgaagcaccttccttcaataaggagttgaagagaagcttcacaagtgagagaaccacaccagtgggaaagaaaagtcatgaagaaaataaatccatgcaaggcacattgtttagaagtaacaagttcatggggcatgcaagtgtgcgtcttatgtcacagccagctgagaaagaaagccttcttgtggaatctgacgatgatgatgatgacgatgacacagaaaccaaggaccaagacattgaaggaggaagaacc

SEQ ID NO: 47403 - DNA, 300 bp, Glycine max
  Peptide Sequence Number=SeqID_139088
atgcagttagcagacaaggaaagtcccaagaagcccaagcctttggtgatacatttcaccagagatgcggctccccaaaatcaccgaggctcgtcgacgttgtcaggaagtaaatcgatccccttcccctataaaaacagcaaggcggccccatggaggtacgctcctcaaaagccgaatgagaggaaggagaaggccactgacattgactcattttccgccaaagtgaccaatatcactgggctaagcagcgtgacccgcagcggccacatctttgcagtgcctgacctgccagtatga

SEQ ID NO: 47404 - DNA, 414 bp, Glycine max
  Peptide Sequence Number=SeqID_139089
atgtcccttgagaggactacacgtcctcaccatcagagggctgcacgccctcacctccagaggactacatgtcctcgccttgagagggctacacgccgtcccttgggtactagttaccctcaccgttgcacgcctctctttaaggactacacgtcctcgccatcagagaactgcatgtcctcaccttcagtagggctacacgccctcacctttagaggactacacgtcctcgccaacagagggctgccacaccctcaccttgagaggactacacgtcctcgccaacagagggttgcacgccctcaccttgagaggactacacgtcctcgccaacagagggctgcacgccctcacctccagaggactacatgtcctcgccaacagagggctacacgtcctcaccttgggtactag

SEQ ID NO: 47405 - DNA, 924 bp, Glycine max
  Peptide Sequence Number=SeqID_139090
tatatcggtttcggccagtttacctggttcaagacgctggggaaacatgaactgcttactggattgacctaccgttatacctactacgatgacaatacaccagctacggcagatccgaaggatctaaatcgtaacaaacctacaaataccaacctaccggggatatttgtacaggaccaaattacctttgataagaataataccctgttattgggactacggtatgactacaattccctgcatggccatattgttaccccaagagttaactacaaatggagctcggatgataaaagtaatgttttgcgggttagttttggtaatggttaccgtgtcgccaatgtatttaccgaagatcatgccgctctcacgggagccagggaagtgttctttatcaacgaccttaggcccgagacctcatggaacggaaatctgaattttgtaaagaaaatgtctgttggtgattcttttatcgggtttgatgccaccgcattttatacctatttcaacaacaagattgtcgctgattacgatactgatcccaataagattatttatgacaatctcgacggtcatgctgtgtcacaaggtgtctctctcaatttagatattatacttccgattggtataaaaatattagcgggagcgacagcgatggatgtttacagtaaaaaagatggcatcagaacaagacagctatttacagagaaatttacaggtacttggaatattggctacatgctgaagaatcttggtcttacagtggactataccggaaatatttatggtcccatgcgcttacctctgttgagcgagacggatccccgccgggcatattcaccgtggtggagtatccagaatattcagctgactaaacgtatgggcggaaaaaccgaaatctatggcggtgtgaagatctcctaa

SEQ ID NO: 47406 - DNA, 737 bp, Glycine max
  Peptide Sequence Number=SeqID_139091
gaacgacccgatctgaagttagtctcccatggtagaaaagtagataaaattgggagaccagcgcctgagatcgaaggcatgattgctgccaccggattgagtccactgatcaggtgttctgttatcaccactgatcctggactcatattcgccttcgtcgagaggtggcatcgtgagactagcacgttccacctgccagttggcgagttgacgatcacgctggatgatgtggcgtcactcctacacgttcccatcactggcgcgttgcataagttcgagccgctgattacttcatacgcgattggtctactgacgaagcttcttaagggccagacgatgggttgtagcagcccgcacgtatctgctccacttggtgggttgtactctttttgccaacaagagttcaacccatcggctgcattggtccacacgtacaagcatatgaacgacgcgtcgcaagcctctacacgacaggtgggctgttacattacacttcttcagcactttcctacagtgcatacatgcgttgtgcatgatgcttatgatgaggggagcccacgggcctacaggtggcttatgggtaaggctcatatgacggggatcaagggagccccgtattggagacgtatggatgccctgactatgactgaccgggttcttcgacagtttggcttcattcagaccgtccctccaccgccggtttgtgattctttgacgggtgatgatatagatgaccg

SEQ ID NO: 47407 - DNA, 150 bp, Glycine max
  Peptide Sequence Number=SeqID_139092
atgggttggccttttgagcaaaggccttttgtgcatctatcttggtatttagttgggctaaggcatttaatgggtatagggttagtggtgggtacaaaaatggatggtagtaagggaaaggaagttagtgggttgggagaagggcaataa

SEQ ID NO: 47408 - DNA, 968 bp, Glycine max
  Peptide Sequence Number=SeqID_139093
atggcggttaatgcggcagttctgatcccgggtaaagacatctacccgatcagcacgaaagtgtaccgttcgttcttcgataacccgcagacggcgctggcaaaagatgccgaacagcagattatcatcaacgaaatgtacgacaaggcagcggaacagctgatccgtaaactgccagctattgcagcgctgtatcctgaacaactccgcgcgcagctcaatgaagggctgcgcgcggcgtatctgctcctcggtaacgatccgctattactacaggaaagcctggatgccgtgcgacacgcggcggccgctcagggcttcgatgaacaccacaccgtccagctggataacaataccgactggaatgccctcttctcactttgccaggcgatgagcctgtttgcctcgcgtcagacgatccagatcctgctgccagagaatggtccgaacgcggccattaatgaacaactggccacgctggtcagtctgttacacagcgatctgctgttgatcgtgcgtggcaataagctgacgaaagcgcaggaaaacgcggcgtggtttacccaactcgcgacccatgcggtgcaggtcacctgtcagacgcctgagcaggcgcatctgccaaaatgggtggccgcgcgcgcgatgcagaacaagcttcagctggatgacgcggcaaatcaactgctctgctactgctacgaaggcaatctgctggccctcgcgcaggcgctggaccggctcgccctgctctggccggatggcaagctgaccctgccgcgcgtcgagcaggccgttaacgacgcggcgcacttcacgccgttccactgggttgatgccttgctgtcggcgaagagcaaacgcgccctgcatattctgcagcagctgcgccttgaaggcagcgagccggtcattttgctgcgcacgctccagcgcgaactgctgttgctgatcgcgctcaagcgcca

SEQ ID NO: 47409 - DNA, 477 bp, Glycine max
  Peptide Sequence Number=SeqID_139094
atggcggaaccatcaaagaagcgaaatggcacttcaagtcggagtcaacggcattccgggtcacaggaaacaccaattccttcatccattccttctggatcattgttttcatctgaggaacagcggatacggtacacaaacctcttttcctctcgttccattatagacccaaaattcatagatatggatttattttcaaatgagagttttgaatgctttcaagcatttgaaaactccaatcttattccattcacgtctctaaaattgcctgtttattctgatcttgtcaaagccttctattcaaacttagaaatccaagaaggcaccctaatgtctgaggtttatgggattaagatggtcattgaccagtccctattctatgatttaaccaaattgccaagtgaaggtgtaccatttgaaggtgcactgattgacgattggaagtttgatttttctgtgcatgatgcccgccggttg

SEQ ID NO: 47410 - DNA, 390 bp, Glycine max
  Peptide Sequence Number=SeqID_139095
atgaaaatcgctatcgtcctgttcttcactctgacattgattagcgccctggttcagtacctttactatcggcgctataaaaaagaattttctgaattctatcaacgttatgtacaaagcgcccatcccttgcctccatttgtcatcttcgcggataaccttggtttgctcggtgtgtctatcaaagcgcaatggttccgttggatattgaatggcagaaaaataaagatagggaaaaacgcttttctgagcccaaaaacctacgaattcgtgaatgaaaacacatctcaacgtctcaaaaactggcttcgaaaagacttcatcttaagcgtgctgaaaatggggtgtttggcgttgatgtgtatctttgcttttttgagcaaggcataa

SEQ ID NO: 47411 - DNA, 243 bp, Glycine max
  Peptide Sequence Number=SeqID_139096
atgcaatctcagggacttgcgttgcctccagagcctatggttggtccctcaggtcctcgtgtcagcacaaaggagagttgtgttgatccctcagggatcgatcctaagaccggtgactcagacaagtgtgggttgtacatcgaagcaaatcctcctcgcctggttgcccttggaagagtttatgagggatcaacagttcacaacattcctttgttgcctggccaagtgaaggttgtgttgaga

SEQ ID NO: 47412 - DNA, 381 bp, Glycine max
  Peptide Sequence Number=SeqID_139097
atgacgttgttacttagcaacattctgcccagtgaccgtaatgctgatctccccctgcggaaggatcgcgcccacaagacacccagtggacccggaaaagtccaacagggccctagggtttccagctctggttatgggcctctatcagtcctacagggtgcccgtaccccccccccccccgcaaggggatgcgcccgcaggacacccggtggacccaaagaagtccaacagggtcctggggtttccagctctgattacgggcctctgtcagttctacggagtgcccgtcgccctaacaaggtcattaggccccgcattaaccgagctttcatcaagaagtactgcgcccctagacgggcgcagggcgagacaccacagtag

SEQ ID NO: 47413 - DNA, 246 bp, Glycine max
  Peptide Sequence Number=SeqID_139098
atggtgggttacacaccttcaagttttatagatttggtcttcgccagcaaaaagatcgaagtggatctgaaaagaggcaaatttaatcatcctgcttggacgaatgagaaaactggggcaaataaagagggtgaggatgatgtgtttaggcatttcaccgaacacttggtgggcgcatgtttaggcatcaatagcaagagaacggggacaatgtggcatgccccattgcttcaaaatgcattatag

SEQ ID NO: 47414 - DNA, 900 bp, Glycine max
  Peptide Sequence Number=SeqID_139099
gcatggttaagtgatcctactcacattaggcctagtgctcaggtggtttggccaatagtgggccaagaaatattgaatggtgatgtagggggagggttccgaggaatacaaataacctccgctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatggtaagagattatgatccgactattcgatacaacgatctattagatcgtgtccttagacatcgcgatgcaatcatatcacatcttaactgg

SEQ ID NO: 47415 - DNA, 60 bp, Glycine max
  Peptide Sequence Number=SeqID_139100
gaagtgatcctaggtcatttcccaacgagcaatgatacaccaaatgttcaggatagatag

SEQ ID NO: 47416 - DNA, 159 bp, Glycine max
  Peptide Sequence Number=SeqID_139101
atggttcctaatacgatacaaacccagtttgttgttaacgctgttgaagcagataaacatcctgttattttactttccagctcaatcataaaatttgctgagcagtgcctcagtccagaaatgagagcatcagtttttagtccccggcttatggagtag

SEQ ID NO: 47417 - DNA, 216 bp, Glycine max
  Peptide Sequence Number=SeqID_139102
atgtttgatactttgaaaactgatggagaatttgaccatttcaagttagggaatggtggaaaaatgaaggttgaagacatagggaatacgaggatgaagctccatgatgatactattcaaactttctcaaatgtgagggtacaagtatattggttcaaagtggggatggaaggtgtacaaaaggagacacttggtgttgtgaagacagaaaaataa

SEQ ID NO: 47418 - DNA, 281 bp, Glycine max
  Peptide Sequence Number=SeqID_139103
ggccttggagttgtcaagctctaattacgggtctctgtcagttctacggagtgcctgtcacctccagcaagggcatcaggccccctactaatcgagctttcatcaagaagtactgcgtccccaggcaggcgcggggcgaaacaccacagcagcctggggatggccgacagcgggcaacagacgcaccgccatcacctctagagttcacctcagctcatccacaaaaagccatcaagcgtccagctcaagacgttaaagaagcgctactaggaggcaaccta

SEQ ID NO: 47419 - DNA, 55 bp, Glycine max
  Peptide Sequence Number=SeqID_139104
aaagtgatacgtgtggcttggtggtactggaaaaaaacatcagcatgtgaggaag

SEQ ID NO: 47420 - DNA, 711 bp, Glycine max
  Peptide Sequence Number=SeqID_139105
atgactaccctgacccagacatggatgacgttgctgctcagcaacatccagcccagcgatcataattccgatctccccctgccgaagtgtcagctggtgtacgccatcctgacacggatgagcattcacgtggctcagttgatcgctgatgccatttatctgtttgcaggtatgccacctaccaggaaccctctggacccagataagtctaacatggccctgggttttctggcattgatcacgggtctttgccagtcgttcggggttcctgtcgcacccagaaaggtgatccgaccaccgataacccgagctttcatagagaagtactgcacagctagacaggcacagggtggcgacccgcaggccccagacgcacagccgccaccccctcaggctgatccagctgggtcatttgacacggagcggtatttacggcatttggttcaccagcaggcggccaaccacagggcgcacgtgcagacccatgactctctctaccagcttagtctcagcctgcagagccaaggttttgcttcttttccatgccctactccggatcagttcagggcaaaggtcacatggcccggagattggcctgaggcccaagcagtagaggcacccgcagaggctcccggcgaggcagaagaggcccgcgaggatgaggagatgaccgatttgcttgatttcttgggaaggagcggagccacatga

SEQ ID NO: 47421 - DNA, 243 bp, Glycine max
  Peptide Sequence Number=SeqID_139106
atgtgtttcctacaattaggattggaagaggaaattggtgcattgtttgaaggaagatttttgagtcttggaggggtgtatggggagtctccaagataccacctgtcgcaacgtgcccttcgcgggcgagcgaaggagaggctcacgggtgcactttccaaaggaggaaaggtgcgcggagtcaccaccaacgttttatttgtggaaaacgtcggaaaaaccgaaggaaaccggtcaaaatga

SEQ ID NO: 47422 - DNA, 744 bp, Glycine max
  Peptide Sequence Number=SeqID_139107
atgtcagccagtgatcatgccatcctgagggacggaacccatcaacccacaaagaagagcctattggaactaacatcacacgacaccttgttggcacaaaacaagttgctagctaagcaacttgagatcctaacagaaacacttggtcacaggttgtaccactttgtggtgaagctcgtgagacaggccaatgcattcctactgacgataacactcaagaaattcatttcatgggaatcagcagaggcaaggcaaggacagtggaggacacaccctggcaaccagttcaataaagaccaaggtggatcctcaaacagcccaattcaacaagggcctaacatctttcagaggacaactaagttggaagagaccttgactcagtttatgcaagtaacgatgtcaaatcataagagtactgagtcaacactaaagaaccttgaagtacagatgggacaactgcccaagcagatagctgacaagtcatcaaacagctttggagcaaatacggaaaataatcctaaggaggaatgcaaggctgtgatgaccaggagtaaaaggtttgtggaagctgaggatgaagaaaatgtggtagacaaggaacaattaagtgaaaagacagttgttgagtttaagaaaaattatgtgaaggttaaagagaatcaggaaaaagggaagaaaataatggtccagaataaagagatggaggaccaagaaaaggaaaaagaaagggaaaaagaaatataa

SEQ ID NO: 47423 - DNA, 453 bp, Glycine max
  Peptide Sequence Number=SeqID_139108
atggcttccatgatggaggccatgttaggaatgagacaactcatggagaaaaatgtggccaccgctgccgctgacgagaaaggaacacacttggggcatagaaacccccatttgggatacaaccgggaggcttacccttatggattaccacctaattacacgctgccagtcatgcatgatgacgcgggtcacgccccttcccccatccttgaaggggagcctcctcgacagcccgacgaggtccacgatgatcatcgagagtatgcccaaggggatgtcaatttctaccccccgatccccgtcgagaggccggcacccaacacattgcctcaacacaacctcacagcacaaccaatattcttgtccacagaaggaccaccctcggcggccgaagatagaaggaaactcgatctcctcaaggagagattgagagctgttgaaggcttttggtga

SEQ ID NO: 47424 - DNA, 359 bp, Glycine max
  Peptide Sequence Number=SeqID_139109
ccattcatatcgtgtggccccttcggagaggtcatagagatcaaggaaacctcccccacaaactttgctacgcccttaactcttgaactacttgaacaaggaagccgggggcgcgtctgtcgagtcaagcatctccctcttcatcgcagtcgctcaagacgttgtatcgatggagtgagatcagggcttctccctctacccgagcgagggatcagtaagcaaccgggcgaaccacatctgttccaattccagaggctttctccgatcgaagtcggatccaatggccaatcttcgattcctccccggaatcggttttttgctcgggctgtaaggcgatggttcgaagatttcgatgcccg

SEQ ID NO: 47425 - DNA, 99 bp, Glycine max
  Peptide Sequence Number=SeqID_139110
gcgagctggttacttcacccctaagctatttggggccccaggcaagccaggggctagcctgggagagccaggggtcaacccttttgacctcccttttgg

SEQ ID NO: 47426 - DNA, 384 bp, Glycine max
  Peptide Sequence Number=SeqID_139111
atgagcaattttcctcctcgaatctcagccaacttgcatcaattagactttgcaccttatgtttcagggtcttacaatgctcaatggaatgcgtcggaactcctccatgataagcacatgttgcattcgtgttgtatcctcggaaaaatggaggcttcctttctggaaaatttcttccccggttggtgtcttgggctgtcataccctaatttcgtccggggacctttgcttggtgacatgcgacctttctttggtccttgtgaggaagcaacctggctcgcctgggcgagctgggctcgcctgggcgagctcggcggcaaccacctcccctattttgctataaataggggaggaagtgaagaagaaaagggttcagccccttag

SEQ ID NO: 47427 - DNA, 540 bp, Glycine max
  Peptide Sequence Number=SeqID_139112
atggagaatgctaagcatatggctacaccaatgagtattgcttgctatttggataaagatgaaaccggtcagttaatagacattaagcaatatcgaggatcttcctccaccaccaccgctgctagccaccgtcgccaaggaacctctggaaacccacccgcaccagttcctccttctctttcatctcctagatcatccacattgttttcctcggatgatcaacgtcaaaggtactactctcaattctgtaatagagtcattctagaccctaagtaccttgaccttgaattctttgatggagaaacattttattgttaccaagtgtttcaaaattctggtttgattgatttcatgtctctgaaactgccttactttcctgaattagttaaggttttctataataatttgaaaattcagaatggtattctttactctgaggtgcaaaatattcccagtgttattgatcagtccttattcttttccttgactaaattgcccagtcaaggtgttccttttgagggcacccttgttgatgactag

SEQ ID NO: 47428 - DNA, 312 bp, Glycine max
  Peptide Sequence Number=SeqID_139113
atgttcctccagaaggcggttgcttctggaggaagcaacctagcttgcctgggcgagctgggtggcaagctcctcccctattttcctataaatagggggaggagtgaaggagaaaaatgttcagcccttctgattttcaaccgttcttcgacgttcttcagtcgttcttcgtcgttcttcggtcttcaaccggataaaaacaacttaaccaaacactttgttcacaaagaactacgtaggtctgatttccttatcacaactaaggaatacgtaggagcaagggaaacaccctcgtcgaccgcaaaaagataa

SEQ ID NO: 47429 - DNA, 1809 bp, Glycine max
  Peptide Sequence Number=SeqID_139114
atgagagatttttccggcagagcgctgcccgataacgttatgacagaacaacaaaaaatcactttctcgcagctctatgaacggctcgatggtctgatgctgcgcgataaatcgcgctatagccgccgcctgcatggcgcaaagaaggttaaaaatcctgatgcccagcaggccattctgcacgagatggcgcgggagatagagcaggcagcagggaaagtcgtgctacgcgaagccgcgcgtccggcaatcacctatccggaaaacctgccggttagccagaaaaaacaagagattctcgaagcggtgcgcgatcaccaggtggtgatcgtcgccggtgagaccggttctggtaaaaccactcagctacccaaaatctgcatggagctggggcgcggcctgaaaggcctgattggccacacccagccgcgtcgactggcggcgcgcaccgtcgctaaccgtattgccgaagagctgcagagcgagccgggtggctgcatcggttacaaggtgcgattcagcgaccacgtcagcgaaaacaccatggtcaagctgatgactgacggtatcctgctggcggaaatccagcaggatcgcctgctgatgcagtacgacaccatcatcatcgacgaagcgcacgagcgcagcctgaacattgacttcctgctcggttacctgaaagaactgctgccgcgtcgtccggatctgaaaatcatcatcacctccgcgaccatcgacccggagcgcttctcgaagcatttcaacaatgcgccgataattgaagtgtcaggacgcacgtacccggtggaagtgcgctatcgcccgattgtcgaagaggcggatgataccgagcgcgaccagctccaggccatcttcgacgctgtcgacgaactgggcaacgaaagtgcgggcgacattctgatctttatgagcggcgagcgcgaaattcgcgacaccgccgatgcgctcagcaagcgcgatctgcgtcatacggagatcctgcccctgtacgcgcgcctgtcgaacagcgagcagaaccgcgtgttccagccgcacggcggacgccgcattgtgctggcgaccaacgtggcggaaacctcgctgaccgtaccggggatcaaatacgtgatcgacccgggcacggcgcgtatcagccgctacagctaccgcaccaaggtgcaacgcctgccaatagagccggtttctcaggcgtcggccaaccagcgtaaaggccgctgcggtcgtgtgtcggaagggatctgtattcgtctctattccgaagacgatttcctgtctcgcccggagtttaccgacccggaaattctgcgtaccaacctggcgtccgttatcctgcagatgaccgccctggggctgggcgacatcgcggcgttcccgttcgtggaagcgccggacaaacgcaacattcaggacggtgtccgtctgctggaagagttgggggccattaccaccgacgagcaggcgacggtctataaactgacgccgttgggtcgtcagcttagccagttgccggtcgacccgcgtctggcgcgcatggtgctggaagcccagaagcacggctgcgtgcgcgaggcgatgattattacctctgcgctctccattcaggatccgcgcgagcgtccgatggataaacagcaggcgtcagatgaaaaacaccgtcgcttccacgacaaagagtccgatttcctcgccttcgtgagcctgtggaactatctcggcgagcagcagaaagcgctctcctcgaaccagttccgccgccagtgccgcgtggatttcctcaactacctgcgc

SEQ ID NO: 47430 - DNA, 416 bp, Glycine max
  Peptide Sequence Number=SeqID_139115
atggctccgaagaaactctccacgaagaggtctagaagggacgccactggagaaggctccagtgccgcctcagagtttgatagtcactgtttccagagtgccaagcaccagcagcgcttcgaggccatcaagggatggtcattccacagggagaggcgtgtccagctcatggaagacgagtaccctgacttccagggagagatagctcgcaggcattggccacgactagtgacccctatggctaaattcgacccggagatactagttcttgggcgacccgctgattttggaggaagacccagcagtgtgaattcagccagaggaggagccaagaaaacggtttcgatgaggaagccatcgcccagctattgtgcataccggggcaggatttcacccggaccgctgcaaagaggcgg

SEQ ID NO: 47431 - DNA, 549 bp, Glycine max
  Peptide Sequence Number=SeqID_139116
cctaagtgaagaacttcgtgactattatgaaggaaggcataggtcacatcttagacctcactcccataggagagaaaatgaaagaaagcctcaagaggttaacattaaaactccatacttccatgggaaggacaatgtagaggctaacttagattgggaaataagggtagagcaacacttaaaagaagtctacttcaaaatcttatggctctcaactcttatcaaagaaagaccaggtcaaggcatcttaggggtgacaccttctaagcccaaagatgataaggggaagacaatagaaaagcaagcccctaaggctagtatgcaagagaaaactagctctataaagtgctttaaatgtcttggaagaggacacattacttctcaatgccccaccacaaaaaccatgattatgaggggccaagacatttatagtagacaagatgaggctactacttcaccttcctctagtgaaagtgaaaaagcaaaaggggaagaaatctacccccaagaagaaggacaaccattagtggttaaagagaagtgtaggag

SEQ ID NO: 47432 - DNA, 243 bp, Glycine max
  Peptide Sequence Number=SeqID_139117
atgacgttgttcgccggaggacgaagggcacagaagacgacgtgttctgcgagctatcaggcttttcgtcttacaacagcaaaaaagaatgtttatacggataaccactcgggtatttccgcccgtcagcgtgactcaaatttgagtatgacagatcttgtgagcatggaagatgacgtaaatctccgcgtgtcaacgggcttgtcggcagcgattgacgatgggcgtagaagacgacgttag

SEQ ID NO: 47433 - DNA, 426 bp, Glycine max
  Peptide Sequence Number=SeqID_139118
atggatctaggaatctcccaatcatgtggctccgctccctcccaagaaatcgagcaaatcggacatctcctcgtccatgcgggcctcatctgcatcgccgggagcctctgcgggcgcctcccctgcctaagcctcaggccaatctccgggccatgcgacctctgccctgaactaatccggggtagggcatggaaacgaagggaaaccctggctctgcaggctaaggctgagctggtagaggcagtcatgggtctgcacgtgtgccctgtggttggccgcctgctggcgaacaaaatgccgcaaataccgctctgtgtcaatgacctagctggatcagcccgaggaggtggcggcggtgcgtctggggcctgtgggtcgccaccctatgcctgtctagctgtgcagtacttctttatgaaagcccag

SEQ ID NO: 47434 - DNA, 162 bp, Glycine max
  Peptide Sequence Number=SeqID_139119
atggaaattaaagagtgtagggaagaagaagacatacacaagaatttaatattggttcggcaacaacccgtgcctacatccagtccccaaatgtaccctctacttgaaccacaaaggatgtaccctccaatgtgttgggacaaagaattctcaggcggttag

SEQ ID NO: 47435 - DNA, 576 bp, Glycine max
  Peptide Sequence Number=SeqID_139120
atgaccggccctctccatgagtcgatctcttgctttctcatagggtggacccttgggaatactagtacctatcaccttcagaggactacacgtcctcgcctcaaaggactacatgtcctcgccattagagggtcacacgccctcgccttcgtagggctacacgccctcaccttccaaggactacagccctcgccatcagagggctacacgtcctcgccatcagagggctacacgtcctcgaccatcagagggctacacgccctcgccttcaggactactacatcctcgccttcagaggacaacacatcctcgccttcagccttcgtagggctagacgccctcacctttagaggactacacatcctcgccttcagaggactacacgtcctcacctttagaggactacacgtcctcgccatcagaggactacatgtcctcgccatcagtgggctacacgccctcgccttcgtagggctacacgccttcaccttccgaggactacatgtcctcaccttcagaggactacacgtcctcgccttcagaggacttcacgccctaaccttcagaggactacac

SEQ ID NO: 47436 - DNA, 237 bp, Glycine max
  Peptide Sequence Number=SeqID_139121
atggacattcatggaaaagattctaaaggaaaaggagaaggaagcaatgaggattctcaagttgatgaaaccgaaacaaatgatgatcttccaagagaatggaaagcttctagagataatccccttgacaacatcattggtgatatctcaaaaggggaatacgcgcggagtcgccaccaacgtttattcgaggaaaacgtcggaaaaaccggaaaagacgtggtctacaaactttaa

SEQ ID NO: 47437 - DNA, 210 bp, Glycine max
  Peptide Sequence Number=SeqID_139122
atgcaattgcttagcgcttttcatgtgtctccattatcaagtgcgaagcttctggtgactaggaagcacgttattctgtgtttccagatcggttccattcgccaaaagggaaaaagaagaagtagagatgagagtcgtcatcacgaaaaggcagggcggacgaaatcagtgtcctatctttgctttcctcttatctccgatgagaggtaa

SEQ ID NO: 47438 - DNA, 450 bp, Glycine max
  Peptide Sequence Number=SeqID_139123
atgcttccatttgatttccggtgtgtcacggaaacttacggattgtgcatcaatattttttggttttctggcatgtcctggaatttcacaaattgcctaatgatgggtgccaagcacctcacaaggaccaaagaaaggtcgcatgtcatcaagcaaaggtccccggacgaaattagaaaaaaagactatgacattgcccttgttggggcctttagaagggaaaaggacaaagacatggaattacaggcactaagagatgaaattcaagcgtccatgaagctggtgagacaaagagaagatgacatacaaagtttgaagatgagactacgttttcgagaagctggaataaaaagattacaaacagatgcttctgagaagatctcagctgagacacacttgctaaaagaaaaagaggagcacttgaaggaaattgaggtcttgcgggcccag

SEQ ID NO: 47439 - DNA, 478 bp, Glycine max
  Peptide Sequence Number=SeqID_139124
atgaggggagcaccgagggaaggaagcatgtctcctttccttgtgagggatctcggcgcacaaaattccaaaactatacaaagaatccataaggcatgggaaaccccgttaaggaaagatcaagagcttagaggcattcgtaatggcatcattggtgggtaccacgaatggctgaaaccggaagaggacgaggaagtccaagctctcaaaagcgagttaggaaaggcaaaactcgccaaggagaagttcaagttggctgctacacacattcggaaggagtgcgccgggttacgggaagagaatgcaattaccgcaaaagcccttgaacaagagaccaagagggctcgcaaggaagagtacggccggaacaaatttcgcggagctctatggggtagcaataatgaactcaagttgcgaagggaagaaagggaccagtcgcgagcacatagcatggttctgaaagaggagttgatggctt

SEQ ID NO: 47440 - DNA, 702 bp, Glycine max
  Peptide Sequence Number=SeqID_139125
atgcaaactagaaatgctttttcttgtataaaggaagggattactcgatccatttccatatcgatcatgatatatataataattcgagcacccatttcaaacgcatatccaatttttgcacagcagggttatgaaaatccccgagaagcaaccggtcgtattgtctgtgccaattgccatttagctaataagcccgtggatattgaggttccacaagcggtacttcctgatactgtatttgaagcagttgttcgaattccttatgatatgcaagtgaaacaagttcttgctaatggtgggaacaggggaaggggtcagatttatcttgacgggagcaagagtaataataatgtgtataatgctacagcagcgggtatggtaaaaaaaatcatacgaaaagaaaaagggggatacgaaataactatagtggatgcattggatgggcgtgaagtgattgatattatacctccaggaccagaacttcttgtttcagaaggtgaatctatcaaacttgatcagccattaacaagtaatccaaatgtgggtggatttggtcagggggatgcggaaatagtacttcaagatccgttacgtgtccaaggtctcttgttcttcttcgcatctattattttagcacaaatctttttagttcttaagaagaaacaatttgagaaggttcaattgtccgaaatgaatttctag

SEQ ID NO: 47441 - DNA, 411 bp, Glycine max
  Peptide Sequence Number=SeqID_139126
atgggtataccaaaatctcaaatagcgtctgttgcagatatccttgacctaaagacacatgaaggaggagaagttacatttggaggcataggtaagggaaagatctctggtataggcaaaattggtattccctttctagccttcataggcaacatcttatatgttgaagaagtgaccatggaactgactttggaaatgctaagttttgatcattctaagaaaagaatgaagtttgtccacgatcatccacaagatcagatcattggagatcagattgaaggagtcaagactagattaccattcaaagatcttgcttcatgtgctcttgtggttgaaatagaacccaagaccttagaagaagctttgacagatgatgacttgattattgccatggaagaagagcttcactag

SEQ ID NO: 47442 - DNA, 129 bp, Glycine max
  Peptide Sequence Number=SeqID_139127
atggagaataatatgacatgccaatccatagtaggatcaaaggagatgaatgaaaacacaaaaaatgaaagcaaaagtgcgcaaatggaggcttggggctgctggaaagagagctcccataagctttag

SEQ ID NO: 47443 - DNA, 489 bp, Glycine max
  Peptide Sequence Number=SeqID_139128
atgagagaggcaagttgggatcgactcttagcaagcaaagaaggagcgtctgtcaactggttcccccgatggaaagaaggaagaaccggggttcttattttgtgcggaggatttccaaatgttcccttgatagggacaaggggttgcattagttacaatcccgttcttgctataatacaacttggctaccctatgagaggggcaccactagaggaagagctcgcacctattattgtacgaggtgtcaataacaccaacgtggaggcacttcagaaggtccacaaggtatgggagatggtgcaaaagaagggcaaagaactcggaggcagtaacaacgagcccatcggcggctaccataggtggttgaaagcccacatgcaaggtctgggttggctcccgagtttgagaaccactaaagggttggaagttgaagcaacggaggaagacgaagaggtgcgggcccttagggtagaactcgagaaagtctaa

SEQ ID NO: 47444 - DNA, 555 bp, Glycine max
  Peptide Sequence Number=SeqID_139129
atgtgggcatgggaacgatgcacgactttggcaccaaagaggactcctcccgtaatagaaaataaaccactcgaactcaggtggctgcgacgtggaaatcaacatattggcaatgatgatctgatatttctgtgggagccttacacagcaactgctatgtcagcgttacctccaatttgtttggttggtagtgtagcgtggtgcgcggtggtgccactcatttgtttccatgctgttgagtggcaccaacccgatatagtgttgcaacaatttggaatgcaacaacctattctcgagtgtccatcgcaaccactgaatatccatggcctaacgctgaaaggcaaacaagctaaaaattggttccagctgttggccccaatgatcagtcaatggaacaatcgagctgagtttaggatcgacgtttatcctcgacaggagggcctattgagttttaactccgactacatggtccggtataggcgaaaaatgaagatgtttgtcgacccaaagaatgcaaacacaactacattggctgaagttgcggagacattgtaa

SEQ ID NO: 47445 - DNA, 713 bp, Glycine max
  Peptide Sequence Number=SeqID_139130
atcccatagaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcagatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggag

SEQ ID NO: 47446 - DNA, 420 bp, Glycine max
  Peptide Sequence Number=SeqID_139131
atgccgatctcccccaacagaagtatcagttggtctgtgccgtcccgacataggggtagcgcccacaagacacccggaggagcccaacagggccctggggtttccagctctggttacgggcctctgggtagcgcccgcaagacacccagtggacccagaggagcccaacagggccctggggtttccagctctggttacgggcccctgtcagtcttacagggtgcccgttccccccagcaacgaatcgcgcccgcaagacacctagtggacccaaagaagtccaacagggtcttggaattgccagctctaattatgggcctctgtcagttctacagagtgtctgtcgcccccaacaaggtcattaggccccctactaatcgagctttcatcaagaagtactgcgccctcaggcaggcgtag

SEQ ID NO: 47447 - DNA, 246 bp, Glycine max
  Peptide Sequence Number=SeqID_139132
atggaatctgagatgataacactagcaactgctagtgaggaagcaagttggctgagaagcttacttgcagagattccgttatgggaaagaccgataccagttgtgttgatccattgcgatagagctgttagagtggatcacgtatgcactgatgataatttagcagatcctttgacgaaaggattagctagagagaaagtccattacatttctaaaagaatgggactattgcccttactacgatga

SEQ ID NO: 47448 - DNA, 234 bp, Glycine max
  Peptide Sequence Number=SeqID_139133
atgggggtgcaaatagcacccatgcccacttgggccctccagaatatacctccagaatgcggttgctactggaggaagcaacctggctcgcctgggcgagctgggcggcaaccacctcccctattttgctataaaataggggaggaagtgaagaagaaaagggaatctcgcaaaggttttgaccgttcttcgacgttcttcattcgttcttcatcgttcttcgatcttcaacgg

SEQ ID NO: 47449 - DNA, 228 bp, Glycine max
  Peptide Sequence Number=SeqID_139134
atggcatttaggactacatgtatggcagtgttaaaaatggcacgcaacgtgtttgctccatgcccctattttaggaacctacatggaaggaaactaaaagggcttttagtgataattcccaaggtggtcatatctctcttgacggtctctagaggtatcatccccttcgaagaacatattgcggtagtagggactactagcaacaatacgttatcaaagatgttttga

SEQ ID NO: 47450 - DNA, 294 bp, Glycine max
  Peptide Sequence Number=SeqID_139135
atggtgcaagtgtgcacaattaaatttcgaacagcatatccaaatttcatgaaaatccaatggctacaatgcgaagggttttcctctaagctcagatgtaatattgaaatacccaacggtgaaaattctcagaattgggttgcgaacatggtgctcaaatttcacgacgatccaacggtgaatgtgtccaagatcgtcgtttttctaagacaggtttggtggactgcgggaaaaagaaagggttttgagaggagaaagggaaaaacaaaaatgaggccaaaaagagccacctga

SEQ ID NO: 47451 - DNA, 270 bp, Glycine max
  Peptide Sequence Number=SeqID_139136
atgggggtgcaaatagcacccagccactgggccctccagatattcctccagaaggctgttgcttctggaggaagtaacctggctcgcctgggcgagctgggcggcaaccacctcccctattttgctataaataggggaggaagtgaagaaggaagggccgaggcgcttccgaaacgtttccgtaacgttttccgtgaggaatttcgcaaaagtttcaaccgttcttcgacgttcttcatccgttcttcatcgttcttcgatcttcaacgg

SEQ ID NO: 47452 - DNA, 183 bp, Glycine max
  Peptide Sequence Number=SeqID_139137
atgccaaaagatagggggacttgtcttgatttcagggattgtcatcatcaaaaaaggggagattgtagacaaaggatcaagctgaatgctttgatgatgccaaagtttcacatgcgtctcaaagctttattcaagacaaagaaattaaagatattcaagatggatgatcaagacaatctctag

SEQ ID NO: 47453 - DNA, 534 bp, Glycine max
  Peptide Sequence Number=SeqID_139138
atggaagatggattttctcaaggatcagttcccatcattctaggcagaccctttatgaaaactgctagaactaagatagatgtttatgcagacacactgtctatggagtttggtgatataactatctttctgtatttcgtgctgaaaccccttgaccatgttgttgatgaatacatgactgatctttattctaatctgcatgcctctcactcttcatgcattgagtctgaaattgtacttgatcatatgtctgaatttgatgctgagagtgaatctgagactaatattgattgcatgtctggtggtggtgttttacctctcaagattgattttatagagtcagataggactaaccatgtttcaggaagtacacatacctctgactttctttatgaggtaaaggctgagaaagcatctccttctaccactgtccagccgaccacaccagaattgaagcctcttccatcaaatttaaatacgcttacttggatgatagcagagttttccagtgattatatctgcctccctttctga

SEQ ID NO: 47454 - DNA, 487 bp, Glycine max
  Peptide Sequence Number=SeqID_139139
atggctctcactcttatccaaagaaaagaccaaggtcaaggaatcttaggggtgagaccttctaagcccaaagatgataaggggaagacaatagaaaagcaaccccttaaggctagtatgcaagagaagactatctccatgaagtgctttaaatgtcttggaagaggacacattacttctcaatgccccaccaagaaaaccatgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggaggtattattaggcaccaaatcccctcaaataggtggtgtgatgaatgctttgggtggtgcaacactcgtttgtaaaatcactcgtgcacccaacatcttcatgatttgtgtacatagggactcattag

SEQ ID NO: 47455 - DNA, 246 bp, Glycine max
  Peptide Sequence Number=SeqID_139140
atggtgtgttttggtgggaaatttggatctgagtgttttggcctttccctttttctgtttttgtttagcgtgggacgagaaagtcgtcagcacacaggatttgagttggcaatcaaagggaaaggaccacttcaagtcgtggcatgtagaacggccggacatgatgtatgccaaggtgttggtttggccagtggttcagggataaaggggatgtcccacattatttccatgacacatatgcaataa

SEQ ID NO: 47456 - DNA, 312 bp, Glycine max
  Peptide Sequence Number=SeqID_139141
atgggcagttcagatagaatcgaactttcgattgattcgggtacttggaatcctatggatgaagacatggtttctctggatcctattgaatttcattccgaagaggaaccttataaagatcgtattgattcttatcaaagaaaaacgggattaactgaggctgttcaaacagtatggggatccgcagtaggtgagaaaatcacccgtttggtagaatatgctactaatcaacttttacctcttattctgggtatgtgcgtccggaggagcgcgtatgcaagaaggaagtttgagcttgatccaaatggctaa

SEQ ID NO: 47457 - DNA, 1161 bp, Glycine max
  Peptide Sequence Number=SeqID_139142
atggcgagccaagagaagtggggcccgtttgcggatattttagctttgctgatttttggggttgtcctctttccgaacgttggcagtttggtagacttagccgccattgatgctttcctcgcatatcaccatagcaaggaaagttcagtggtggctatcttggcagatttgtttgacacctttgaccggagcgcgatcaattggtttcctcgttggaaggaaggcaaggaaggagttcttttctcgtgtggggactaccctaatgttccactgatagggactaggggttgtattaattataatcctgcactcgccataagacagctagggtatcccatgaggggagcgccaaccgaagaaagtctctcgcctttccttgtgagggatctaggcgcacaaggtctcaaggttatacaaagaatccacaaggcgtggaggagtccgttgaggaaagacaaggagcttagaggcatccgaaatggcgtcatcggaggttatcatggatggctaagaattcatacgcgagggttagattggctctccaaattgaaagttatcgatgaggagaacttcgaagctctggaggaagatgaagaagtccgagctctaaaattagagctagggaaggcgagactcgccaaggacaagttcaaatcagctgctacacacatccggaaagagtgtaccgagttacaagaggaaaacgcggccactgcaagagcccttgaacaagaaaccaaaagggcccgcaaggaggaatatggccgagagaaattccgaggagcattgtggggtagcaaaaatgagctcaagctccgaagagaggagagagatcggtcacgagtgcatggcatgatcttaaaagaagagttagttgcttgcgcgagctccaaaaggagtttggctcaacacttggaagccacggagcaaagcatgctggctatcatagggcaatacaaggaagaattgaaccagtccatggcccatgaacaaaagctagtggaggattttgcacaagtgtatgccgaaaaagaagcaagggggagggtgattgatgcactgcatcaagaagcgactatctggatggataggttcgccttgaccttgaatggaagtcaagacctcccgcgtctattagccaaagcaaaagccatggccgaa

SEQ ID NO: 47458 - DNA, 405 bp, Glycine max
  Peptide Sequence Number=SeqID_139143
atggcgtatgtagatgatgtcataggggttagcgttgacaaagtaattgatggtaaagctgaagtcccgttcccaacatccgaaattaagtatgtcaggcaagcccttaacatattcattgcatggccaacacctcttgtaaaactggattcagccattagtccaaagaaagtcgccgaagctgttgacggggtcaaagatgttgttgtggatgaccccttgcgtgagttgattaagtgcctggttgacatttatgacaaccctattcagtttgtgtgggatggtagcaaatttgggattccaaatgtagattcaaccttgttctttacatatgctgatgtcaacgaaataacaacaggggacaaatggttgaacatagccatacttcagttgtggaccatgtaa

SEQ ID NO: 47459 - DNA, 517 bp, Glycine max
  Peptide Sequence Number=SeqID_139144
atggagaggaggttcccgcctacttgcccaggaattttatggaagcattacgaaagccccgaaagccatttttcaacaaaggagggaggtgcttgccgcctatctcgcccagacttgtttgcctctggacgaccatcatcatcccgatatcatcggacttgttcgcctctggctgacgaagatgcggataaccatgagatgaccacgttggtctctgcgtgctaccggacccttgagtctgacggtagaaacgagactttttcgcagtctcggccggaagatgctgacatctccgagaaaggaaaggtgcagatgaccatgttggtctctgcgtgctaccagacccttgagtctgaaggtagaaaagagactttttcgtggtctcggccagaggacgctgacatctccatgaaaggtgcagatgactacccggaagacgctgacatttccttgaaaggtgtagaagaccacgttggtctctgcatgctaccggacccttgggtcatgatagcaaaaa

SEQ ID NO: 47460 - DNA, 309 bp, Glycine max
  Peptide Sequence Number=SeqID_139145
atggagcatatcattttgattgcaaaaaaagcacaagaatataattgtaatgagaccagagctggaagaggtgtagaagcaaagcttcatggtgaatcaaaggtgattcaaagaacaattcaagagaatccaagatcaatcaagaacaattcaagacttcaagataagaatcaagaagaattcaagactcaagaagaaagtctagagtcaagaatcaagaatcaagattcaaggttcaagatctcaagaatcaagatcaagattcaagactcaagattgaagaatcaagagaaggctcaatcaagataa

SEQ ID NO: 47461 - DNA, 429 bp, Glycine max
  Peptide Sequence Number=SeqID_139146
atggcccataccaagaaaacaggggagatgacgactgaggccgcaaaggaaatcgctgagaagatcgggacacagggatccttcatcccccatggacgtcaggatgttctcactgctgctattggacgtccagagcaccttggacgtgtctgtgctgctggagccggggtcaccatcaagcaatacttcggatcggctccacggacgtcccgcagctcatccttcttgcctcctgaagaattgcagcagttgacccagcaaatcagggaccaactagaggagtcgatcacagaaaaagtgactcggcagctcatggcattgttcagccagatgcagtcccagatgcaatctcagggacttgcactgcctcctgagcctttggttggtcccctcaggtcctcgagtgagcacaaaggggagttgtattga

SEQ ID NO: 47462 - DNA, 300 bp, Glycine max
  Peptide Sequence Number=SeqID_139147
atgtctcagcatatcagtgttacattgtggattctgccatacaactaccttaaggcgataattaacagtgctttaaaaggtcttgatgatgctccacagcctaaatcaaaggctactgctaggtggattgtcgtcaagtgtaatagacaaaaaggaagcactgagtgcggctattatgtcatgcactggatgtccaccatcatattaggaagttttagtaataattggaaagcgatcattagagccagagagattaaaggcacttcggatctagtgggcacagtattatctccgagttag

SEQ ID NO: 47463 - DNA, 132 bp, Glycine max
  Peptide Sequence Number=SeqID_139148
atggcgacaaaaggcggtgtggtcgacaaaagcgaggctcttgctcctacgtatcctccaatgaggaactcagacctactgcggggcgagaaaaaagggtcgctagcgcacgggattttggttggtaattaa

SEQ ID NO: 47464 - DNA, 84 bp, Glycine max
  Peptide Sequence Number=SeqID_139149
cgattttgtggaaattcttcatcgttcttcgtcgttcttcaccgttcttcatccgttctttgttcgtccttcattcttcaacgg

SEQ ID NO: 47465 - DNA, 201 bp, Glycine max
  Peptide Sequence Number=SeqID_139150
atgacattcatggggctccgaagaatcaatggagaatggagaattggcgtacagcgctacacaagaacttcgcggggctccagactcgttattggaggatgcatgaacagcgctaggcaatggcattcatggggctccgtaaaagagacgaggttggagaattgcactaagcaatcactacgcatggctccaaactcatag

SEQ ID NO: 47466 - DNA, 336 bp, Glycine max
  Peptide Sequence Number=SeqID_139151
atgaaccctaaaggaccttcctcctttgtgttcagtgattacaccaagaagaaaatttcacttcttgcaatgaaccccaaaggacgttactcctttgtgtccagtgattcaaccaaggaacaaacttgttccttgaaccaagtagaccatctcttgaaaacttttataaccaagacatcatcaaaatcctcttggaagctttgcttctacagaatggtggagctagaagaaagggaggtgaagccgcaccgagaggagacagaggttgtgaatttaggaattggcagagagaaaaaggaggtcaaggttgccagttgtatctgcacgaacgcctga

SEQ ID NO: 47467 - DNA, 459 bp, Glycine max
  Peptide Sequence Number=SeqID_139152
atggcgctgactaggcaccctttggacccggataagtccaatagggccctgggatttcccgcattgatcacaggactctgtcagttgttcggagtccccgtcgcacctagcaaggtgattcagccacccatcacccaggcttttattgagaagtattgcacgcagagaccggcccagggtgatgcaacacaggccgcagaggcgccgccacctcatcaggctggtccagctgggtcatttgattcggagcagtatttacggcatgtgagccagggttttacttcttttccatgccctactccggatcagtttagggcaaaggtcgcatggcccggagattggcctgaggcccaggcaggggaggcacccgtagaggctcccggcgaggcagatgaggctcgcgaggacgaggagatgaccgatgtgcttgatttcttgggagggagcggagccacatga

SEQ ID NO: 47468 - DNA, 553 bp, Glycine max
  Peptide Sequence Number=SeqID_139153
cgtatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatacccactgggaggaaggaagccatatcttttctctgggttctatccctccacgacaagagttgccaaggtggtgaaaatctcagcacaagagttggaccgtgcgaattggctttcttttattgacatcttggcgcttttgatctttggagttatcctctttccgaatatggaagggttagtggacctagcagcgattgacgctttcctcgcctttcatcatggcaaggaaagcccggtcgtcgccattttggccatgtatgacacgattctatcttcatgcgaaggatgtcccatgagaggagtgccatcagacgaaagcatcacgcctttcatcgcacgaggtttcagtgaccacaacgcgagggtactccaaggagttcgcaaggcatgggatgtggc

SEQ ID NO: 47469 - DNA, 843 bp, Glycine max
  Peptide Sequence Number=SeqID_139154
atggccaagttcgatccagacatagtcctcgaattttatgccaatgcttggcctacagaggagggcgtgcgagatatgaggtcctgggtgaggggtcagtggatcccgtttgatgcagatgctatcagccagttcctgggataccctttagtgctggaagagggtcaggagtgcgagtatggccagaggaggaactggtccgatgggttcgatgaggaggccatcacccatttgctatgtataccggggcaggattttgcccggactgctgccgggagacgggtgcggatcatgcacaccaacatgaccaccctgactcagatctggatgactttgctgctcaacaacatccagcccagcgatcataattctgacctccccctgccaaagtgtcagctggtgtacaccatcctgacatggatgagcattcacgtggctcagttaatcgctgatgccatctatctatttgcaggtatggcgcctaccaggcaccctctggacccggataagtccaacagggccatgggatttcccgccttgatcacaggactctgccagtcgttcggagtccccgtcgcacctagcaaggtcattcagccgcccatcacccgagcttttattgagaagtattgcacacagagacaggcccagggggatgctcccgcagcctgcagacgcgccgccacctcatcaggctgggcagaggtcgcatggcctggagattggcctgaggcccgggcaggagaggcgccagcagaggctcccgacgaggcagatgaggcccgcgaggacgaggagatgaccaatttacttgatttctttggaggaagcggggccacatga

SEQ ID NO: 47470 - DNA, 557 bp, Glycine max
  Peptide Sequence Number=SeqID_139155
ggcagtagcgtccattcttgaggaaggaactcatttttctaattcgtcatcacctgattcaccatcatcaagggaatctgcagcccacttgccagaagtcgcttctatggcggatgaacaccaacagagagttacccttgaggactattcaagcagttcaatgtcgcaattctttaccagcattgcacggaacttgttcgaaggattaccaaatgaggacccctatgcatacttggcaacattcattgaaatttgtaacactgtaaagattgcaggcgtgccagatgaagctattagactcagtctattcttattttccttggcaggagaagccaagaggtggctccactcatttaagggttgtaccatctatggtgaggttcatgaaacaggccaatgtattcccattgaagaaaacaatcaagaagttctctatatgggaaatcaacagagacaaggatatactcaaggaggattcttaggcttccaacagggtccttataaccaacaaggacagtggagatcacaccctggaaatcaattcaacaaggaccagg

SEQ ID NO: 47471 - DNA, 606 bp, Glycine max
  Peptide Sequence Number=SeqID_139156
ctagacgcctttaccttcagaggactacacgccttcaccttcacaggactacacgtcctccccatcagagggctacacgccctcaaccttagaggactacacgtcctccccatcagaggacttcacgtcctcgtcttcggaggaccacacaggactacacgtccacgccttcaaagggctgtacgacctcgccatcagaggcaacaggccctaacctttagaggactacacgtcctcaccatcagaggactactagtcctcgccttcagaggactacacgcccttgccatcagagggctacacgccttcaccattagaggactacacgtcctcgccatcacaagactacatgtcctcaccatcagagggcaacacgccctaacctttagaggactacacgtcctcgccttcagaggacttcacgtccataaccttcataggaattcacgtcctaaccttcatagggctgtaagacctcgccatcagagggcaacacgtcctaacctttacagggctagacgcctttaccttcagaggactacacgccttcaccttcacaggactacacgtcctccccatcagagggctacacgccctcaaccttag

SEQ ID NO: 47472 - DNA, 601 bp, Glycine max
  Peptide Sequence Number=SeqID_139157
aggactacacgtcctggccatcagagggctgcacgcccttaccttcagaggactacacgtcttcgccttcagaggttcatgtaccttcaccttcagaggactacacgtcctcattatcagagggatacacgccttcacctttagaggactacacatcctcgccttcaaagggatacacgccctcaccttcaaagggctacacgccctcatcttcaaagggctacacgccctcaccttcagaggacttcacgccctcaccttcaaagggctacacgccctcgccttcagaggactacacgtcctcgccttcagagggctacatgccctcaccttcagagggctgcacgccctcgccttcagaggactagacgttctctccttgagaggattatatgtcctccccttgagaggactacacgtcttcgccttcggagggctacacaccctcgccttcagaggactacatgtccctcttttcagaaggggacatgctctcgcctttagagggcgacacgtcctcgccttcgaagggctgcgctctccctcgccttttgagggctacgcgtcctcactttcagtgggctccatatccacaccttaa

SEQ ID NO: 47473 - DNA, 532 bp, Glycine max
  Peptide Sequence Number=SeqID_139158
atgtttcagcctcaaactgttttagattcaaatggctatccagtctatcatagaagaaatgatgatcgtacaatctcaaagaatggagttattattgataatagatatatagtaccttacaatgcaaaattgttgaagaaataccaaacacatataaatattgaatggtgtaatcaaaatacttccattacatatctatttaaatacataaacaaaggttatgacagagtcactgttgtttttgtttatgatgctaatggtggtgcacttgagaatcctatcactcaaaatgatgagattaaagaatatgcagattgcagatatatttctccctgtgaagctacttggagaattttttgttttccaatacatgctagaaagcctgctgtcgagaaattacattttcatctgctaaggcaacacagtgttatttatgaagacgatgatgatatagatgatatcctatcaaagccaagcatttcagattcaaaattcttagcttggatgaataacaacaaatatttttcagaag

SEQ ID NO: 47474 - DNA, 288 bp, Glycine max
  Peptide Sequence Number=SeqID_139159
atgtccggaaagagtgtgccgagttacgagaagaaaatgcagctatcgcaagagcccttgaacaagaaaccaagaggactcgcaaggaagagcatggtcgagacaaatttcatggagctttatggggcagcaacagtccaagagaagcttgtctcaacatttatgcgagacaaagaccaacatgttagccatcatcagcaagtaccaagaagaattaaatctagccacggcccacgagcacaaagtggtggacgagtatgcctgagtgtaagcgtaaaaggaggctag

SEQ ID NO: 47475 - DNA, 273 bp, Glycine max
  Peptide Sequence Number=SeqID_139160
atgacatctgaggcagcaaaggaaatcgttgagaagattgagcaagcgtcacagggttcgtttgtcccccatggacgtcaggatctcctgactgctgccattggacgaccagaacaccctagccatgtgcgtgttgctgaagtcggtgtcaccatcaagcaatactttggaccagctgaacggacctcccgcacttcttcctccatcgctccagaagaactagagcagctgactcaacaaattagggaccagctggaggagtcgatcacataa

SEQ ID NO: 47476 - DNA, 327 bp, Glycine max
  Peptide Sequence Number=SeqID_139161
atggtcgcacataactttcaaaggtttctagagatatcatcctcttcgatattaaacattgtggcggtagggactaccaacgaaaatgtatcatcaaagagaaaaactctagatgaggcttcactatcatcaagcgagtcggagactcagcatgaccacagatcaacctccacttcctatgtctccatggactcgggcctaggatcttcttcatcaatggattcctttgcttcttggaagatgaatggcaacggaatggagaaggaagagagagaggagaagccacttcaaggagaagatgagtctagaagaagcttaccaccatag

SEQ ID NO: 47477 - DNA, 390 bp, Glycine max
  Peptide Sequence Number=SeqID_139162
atggagcatacaccaattgttgttttggcccatgcatatgacacattcaacctaagatgcaaaaagagcagtgtagacctgtctgtcccctgcaaaggcattgcatgtgtgccaaaaagggaaaagaaaattgggaggaactcttggcaggatcctaaatgcccccttgtcgcaatctacccttcagcggaagggcgacgcgaaggctcacggtgtgaaaggtttgggagttgtttttacgcatggggaaggagagaaacgttaaggcattggaccattaactatctcttggtttttgacaaggagagaaacgttaaggggtgttcgacaaaagcggggattttgctcctatgtatcctcgattgcgatgaggaacttagacctacgtag

SEQ ID NO: 47478 - DNA, 144 bp, Glycine max
  Peptide Sequence Number=SeqID_139163
atgaataaaaaacaatggaagagaagcggaaggaaaaggagaagaggagaggggaggcaccatccactagggaataagccaaggaagaaggagcttcaccaccaagaattgccttggataagaagcttgaagaggatgctttaa

SEQ ID NO: 47479 - DNA, 203 bp, Glycine max
  Peptide Sequence Number=SeqID_139164
gtgtagctgattcagatgatgaggggtctactaatttaaggacaaatcctcttcaagagggaggggatgatgcaatccttccaaggaggggacccatcactagagccatggctaggggacttcaagaagattgggccagagatgtaggagaagaccctagggttctcatgagccttaggatagattttgggtccatgggctaa

SEQ ID NO: 47480 - DNA, 591 bp, Glycine max
  Peptide Sequence Number=SeqID_139165
atgcttgtgcaaatgaaaggaactttctacctgaagctggtgaaagttttctatacttgtgcccgtgccgatatggaaggtaatctgttttctactattaatggcgtagaaatggttatcaatgctttagtttggaaagtagtagtcggactggacatggctagaattcgcaagtttgaagaatctgttgatggttacaacaagatgcagacttacagaggtatgctccttgacccagcaaggaatttgagaaatttcctaggtgtaggtagtttaactactgaaaatagaatgctcatgtaccttataacctacattctcacactaaggtccatcaaccatgcacaagtgactgacgatgatttaaagatcatgtatggtctaaaatcagcctgtagattcattgattattttaatatcgatgtttctaataagatcgtagacttcaccaaagcatttaatgaggtaaccgaaaggcatctcaagaagcttaggatgaggttttttgaacacaaatggatcatggctagagagccaccagcagcagcaaacatggaccaaatggaagaagaagcgaaagatgaatcttag

SEQ ID NO: 47481 - DNA, 213 bp, Glycine max
  Peptide Sequence Number=SeqID_139166
atgggtcaacttcaacggcaagccttccgcaaagcctatggaattagaccgccaaaggcaagtcgaaaatggggtggtcggaataccgagaaaatatttggagcgatcgacgtttttctcgcctatcataaccacaaggaaagtccggttgtcgctatgctagccgacctatatgacaccttagaccgaagatgtgaaggtgggatcctctag

SEQ ID NO: 47482 - DNA, 447 bp, Glycine max
  Peptide Sequence Number=SeqID_139167
atgaagttatgggatgaagtagtagaaaatttattgaagaagtacttccctaaattgaagactgcagaaggcaaagttgccatctcttccttccaccagttaccagatgaatcattgagtgaggcacttgaaagatttagaggtttattgcggaaaacgcccactcatgatgggttgagaccacaatctaaacaactcttggatgcttcaaccgggggatgtacactttgtggtggagctcatgaatctggatgttgtatccctaatcaaaagaaaattgcacatgaagttaattatatggggaatcagcccagaggcaatttcaacacaagtggatttccaagatttcagaacaaccaacagtatcaacagcagagacagtggcaaaatcaccctggtaaccaattcaatagagaccagggtggttcatctacaagaccacaatag

SEQ ID NO: 47483 - DNA, 252 bp, Glycine max
  Peptide Sequence Number=SeqID_139168
atgaagcacttgaagacttatcaaggtaatccttgtggcgtctaccttgacttatcttccttcacgggaagtggcgtctacccagacttatcttccttcaccggaagtggcgtctaccctgacttatcttccttcattggaagtggcgtctacccagacttatcttccttcaccggaagtggcgtctaccctgacttatcttccttcacgggaagtggcgtcatccaaatctctggaacctgtatcaaatga

SEQ ID NO: 47484 - DNA, 562 bp, Glycine max
  Peptide Sequence Number=SeqID_139169
atgggatcaagtcaaaagccttcgcttaaaaagaggttctatcaagtcaaaattaagagcttagaggtcactagtttacgagagttggggcaattaatgggtcaacttcaacagcaagccttccgcaaagcctatggtgagatttgggacctagctagggacttccagctagtgccgactgtggaagagtttgaagaaatcctgggattcccactgggaggaaggaagccatatcttttctttgggttctatccttccacgacaagagttgccaaggtagtgaaaatctcagcaccagagttggaccgtgtaaagcaaaacagaaatggagtagtcggagtaccaaggaagtttgtcctctttccgaatatggaagggttagtggacctagcagtgattgacgctttcttcgcctttcatcatggcaagaaaagcccggtcgtcgccattttggccatgtatgacacgttcgaccggggatgtgaaaagagtggcacaagaattgtttgttgtgcactggctctctatgtgtggctggtttcacacctttttctccaagaag

SEQ ID NO: 47485 - DNA, 70 bp, Glycine max
  Peptide Sequence Number=SeqID_139170
agtatcatctcgagtagctcaaggcaataatagcaaagccaagttaaatgagaaattcacgggtacttag

SEQ ID NO: 47486 - DNA, 408 bp, Glycine max
  Peptide Sequence Number=SeqID_139171
atgctgcaggtcgactctagaggatccccaggctctctacttggattgagtcattctatggtggctcactcaagcttgaggatagagacttctcaagctatttatcttctctctcagagaggctctctacttggattgagtcaccctatggtggctcactcaagcttgaggatagagacttctcaagctatttatcttctctctcagagagacttactcaagcttgaggatagaaacttttcaagctatttatcttctctctcagagaggctctctacttggattgactcactctacggtggctcactcaagcttgaggataaagacttcccaaactatttatcttctctctcagagaggctttttctcactctaagaagtggattcactcttgtcttggatggatag

SEQ ID NO: 47487 - DNA, 1719 bp, Glycine max
  Peptide Sequence Number=SeqID_139172
atggcgaccgagaaagtgaccgtttatggtctgccggtggtggccgcacgtaaggtcaactacagccagatcgatccggcgctgtgccgcgagctgtttatccgccatgcgctggtggagggcgactggcagacgcgtcacgccttcttccgtgaaaacctgaagctgcgcgccgaagtggaagagctggagcataaatcccgccgtcgcgacattctggtggatgatgaagcgctgttcgagttttacgaccagcgcatcagccacgacgtcatctccgcccgccacttcgacagctggtggaagaaggccagcaaagagacgccggacctgctcaacttcgaaaagagcatgctgattaaagagggggcggagtcggtcagcaaactcgactacccgaacttctggcaccagggcaacctcaagctgcgtcttacctatcagtttgagccgggggcagacgcggacggcgtgaccgtccacattccgctgccgctgttaaaccaggtggatgagagcgggtttgaatggcagatccctggcctgcgtcgcgagctggtgattgcgctgatcaaatccctgccgaaaccggtgcgccgcaattttgtgcctgcgccaaactatgcggaagcgtttttaggccgcgttacgccgctggagttgccgctgctggatgcgctggagcgtgagttccgccgcatgaccgggaccaccattgaccgcgacgactggaactgggatcaggtgcccgatcacctgaaaatcagcttccgcgtggtggacgacaaaaacaaaaagctgctggaagggcgttcgctcggcgaactgaaagaggcgctgaaaggcaaagtccaggagacgctctctgcggtggcggatgacggcattgagcagagcgggttgcatatctggagctttggtcagcttccggaaagctacgagcagaagcgcggtaactacaaagtgaaggcctggccggcgctggtggacgagcgcgacagcgtggcgatcaagctgtttgataacccgcaggaacagcagcagatgatgtggcgcgggctgcgtcgcctgtctgctgaacatcccgtcgccgatcaactggggctctactttaacccgtacggcaaagtgctggatctgattgacgactgcatctcctgtggcgtggacaaactgatccacgaggcgggcggcccggtctggacggaagagggctttgctcagcttcacgagaaggtgcgtgcggagctgaacgacaccgtggtggagattgccaaacaggtcgagcagatcctcaccaccgtgttcaatatcaacaagcgtctgaaagggcgcgtggatatgaccatggcgctggggctgtctgacgtgaaggcgcagatggcggggctggtttaccgcggctttgtcaccggcaacggcttcaaccgtcttggcgatacgctgcgctatctgcaggcgattgaaaaacgtctggagaaaatggccatcgacccgcatcgcgaccgcgcccagatgctgaaagtggagagcgtccagcaggcgtggcagcagtggctgaacaagctgccgcctgcgcgccgcgacgatgaagacgttcaggggatccgctggatgattgaggagctgcgcgtcagcttctttgcccagcagctcggtacgccgtatccgatttcggataaacgtattctgcaggcgatggagcagatttccgcttaa

SEQ ID NO: 47488 - DNA, 228 bp, Glycine max
  Peptide Sequence Number=SeqID_139173
atgaagatgctcttgataccacatgatgtaagctccattggagcttcggaatggagaatgaagagagagaggagacgccacttcaaggagaagatgagtctagaagaagctcaccaccataagagaccatggataagagcttggaggaagaaggagatgaatgaagggagaggaagagaagagcacgaaattatgtgctctaaaagagctcttaaatctgaagtttaa

SEQ ID NO: 47489 - DNA, 1136 bp, Glycine max
  Peptide Sequence Number=SeqID_139174
ctgtctgccgtggccggcgtgcgcagcgtggcgcaggtgagggtgcgtgccgcccgggcgttgggcgccacgcgttggcaggtgctgcgtttcgtggtgctgccgagcgcgctgccggagatcctgaccggtattcgcatcgggctgggcgtcggctggtcgacgctgtttctggcgaccgacgtggtgttggccggcatcggcgtgattgcggtgattgcatttgggctggagctggggctgcgtgccctgcagcgccgattgaccccgtggcatggagtacagcaatgaacgaacgtctgaatatcaccccgctggggccttacatcggggcgctggtggaaaacgtcgagttggcccggccgctgggcgacggccagtttgagcagctttatcacgccttgctgaagcatcaggtgctgttcttccgcaatcagccgatcaccccgctgcagcagcgcgatctggccggccgcttcggcgatctgcatatccatccggtctatccgcacgccaccgacgtggaagagatcatcgtgctcgatacccacgacgacaacccgccggacaacgataactggcacaccgacgtgacctttatcgacaacccgccgctgggggcgatcctggcggccaagaccttgccttccaccggcggcgatacgctgtgggccagcggcatcgcggcctacgaggcgctgtcggcgccgttcagaacgctgttggcggggctgcgtgcggagcatgacttcaccaagtcgttcccggaacacaaacatcgcggcagtgtagaggagcatcagcgctggcaacaggcggtgcagaaaaacccgccgctgctgcatccggtggtgcgcacccacccggtcagcggccggcaggcgctgttcgtcaatgaagggtttaccacgcggatcgtcgatctggcgccgaaagagagcgacgctttgctgaacttcctgtttgctcacatcaccaaaccggagtttcaggtgcgctggcgctggcaggaaaatgacgtggcgatctgggataaccgcgtgacgcagcactacgccaacgcggattatctgccgcagcggcgcatcatgcaccgcgcgaccattctgggggataggcctttttacaaggcctaa

SEQ ID NO: 47490 - DNA, 245 bp, Glycine max
  Peptide Sequence Number=SeqID_139175
atgcagagactaacatcgtcttttgcacttctattaatcctgacccgtgaagtcaggtaccgtatggttatccacacctttcatcaaccaggggcaaacgagcccgttgacgcgcagagactaacgtcgtcttctgcaccttttgtcgtccagggacagcgagtcaggtggcaagcggagataccttatgatcgttcgctcctttcatcaaccaaggcaaacgagttcaacggtatcaagatgat

SEQ ID NO: 47491 - DNA, 306 bp, Glycine max
  Peptide Sequence Number=SeqID_139176
atgtttgaagttgaggaggcttatgatcctatgtctcaacgaggtggacaaaagtggtcagttaacttaaacgactgttactatcaatgcgggaatgaggatgcgattcttccatctgatgagtcgtggacacttgttcctgatccaagttttattcgtatgaaaggaagaccaagatcaacacggttaaggaatgagatggattggagggaaccttctcaaactcgtcaaaaatgtggtagatgtggtgtacaaggacacaatcgacgcaattgtcctctacaatctaatcagggcagttgttaa

SEQ ID NO: 47492 - DNA, 409 bp, Glycine max
  Peptide Sequence Number=SeqID_139177
gctcatgaatcaggtcattgcattcccattgaagaacacacttaggaagttcattacatgggaaatcaacagagacaaggatacaaccaaggaggattttcagggttccagcaagaggaccaccaaactggaggagacactagctcagtttacacaagtgaccatgtccaaccataagagtattgagtcaaccctgaaaaaccttgagatccaggtgggtcaactggccaagcagttagctgagaagtcatctagcagctttggagcaaatactgagaataatcccaaagaagagtgtgaagcagttatgacaagaagcaggaagcttgtggcggctgaggataaggatgttgttgctttgaaggagcaatttgctttgaaggacactactgataaaaagaagaatgag

SEQ ID NO: 47493 - DNA, 189 bp, Glycine max
  Peptide Sequence Number=SeqID_139178
atgatggaagcttgcttgtggggcttctatggaggctggatctttcagcttcaatggggtcttttaatggtgattttccaccatggagatgcaacggaagacaaaggaaaagaggtagcttccttgagaagctttcttgagaaaacttccttgagaagcttctttgagaaaacttccttgagaagctag

SEQ ID NO: 47494 - DNA, 294 bp, Glycine max
  Peptide Sequence Number=SeqID_139179
atggaatcatgtgccctaacccacatcgcacttatcgtcgttttattcatcgtccttcttcgtcagcagctaaggcatcacatccatctattaatatcgaaagagcaaaataaatcaagagaaaaattggggaagcgaaaaagagagaaaatgaaaggtagagttcgaagaaggaatggttcgtggtggccaggtcaaatacttggccttgatcacctttctacttctcatcttacttctcctcattcaggaactcccgttaagcttctcagaaaggaagattccaacaagtaa

SEQ ID NO: 47495 - DNA, 444 bp, Glycine max
  Peptide Sequence Number=SeqID_139180
atgttagtctctacgtgctaccatactctgagtttgacggatagtaaaagagtgtgtgcgggttaccgtatagggcgtctccgcgtgctaatggactcacaagtcatgatagcgaaaggtggggtggtcgacaaaagcgaggcttttgctcctacgtatcctcaatttgtgatgaggaactcagacctacatgctgacatcttcggaaagggtgtagatgaccaccttgtttgttgggtatcgataagccttggggtctccgaaggacgaggtgcggataaccgtaaggtgtctccccatgctaccagactctcggatcgctggatagcaaagatgtgtgcgggttaccgtcgggtgtctctacatgccaccgaactcttgggtcacagtaacaaaaggtggggtggtcaacaaaaagagggcttttgctcctacgtatcctaa

SEQ ID NO: 47496 - DNA, 300 bp, Glycine max
  Peptide Sequence Number=SeqID_139181
atgaaacgactaaagcagagtaacgcggccaccgccgtcgccactagcacggttgtcgaggcagacccggctctcctgactgctacgcaccatcccattccaaacattgtgggacgagagagaagtacactggggcatgtcagcaacccccatccagggtacaaccgaggtgcttacccctacgatttaccacctaagtacacaccaccagccatgcatgaagacatgggtcacattactcccctcatccttgaaggggagcctccttggcatcctgacggggtccacgagaatccttga

SEQ ID NO: 47497 - DNA, 54 bp, Glycine max
  Peptide Sequence Number=SeqID_139182
atgggtttgtatttttgtgggctgccttcggtctctcctaatgggatgcagact

SEQ ID NO: 47498 - DNA, 573 bp, Glycine max
  Peptide Sequence Number=SeqID_139183
atgtcatcattttccgatggagacttttcaagtctcacaagttatccagaactacgtaggtctgaattcctcattggaggatacgtaggagcaagagcctcgcttttgtcgaccataccgccttttgttgccatgactcaagagctgttgtgtccgatggcaagcagagaccaagttttggtcattctgcacccaagatacgcggagataccttacggtttatccgcacccttttgtcatccagaggcggcgggcccgatgacaagcagagaccaaaggctgacacagtcttctgcaccttttgttcctccggggacaacaaagtcatttacatgtggaaatttcatggtcacccgcgactctcgtcagccgagaggagcgaaattagtgtcatacgctgattttcggggacctttgcttgaagacatgcgaccattctttggtccttgtgaggaacgacaagtcacggtcacccgcgactctcgtcaaccgagaggagcgaaattagtgtcatacactgattttcgggtacctttgcttgatgacatgcgaccattctttggtccttgtgag

SEQ ID NO: 47499 - DNA, 300 bp, Glycine max
  Peptide Sequence Number=SeqID_139184
ggtacatcctttgtggtacaagtagagggtacatctacttgggttgttgtaactgagaacaagagagggtacatctcctgtggatcagttcaagtggagggtacatctacttgggttgttgtaactgagaacaagagagggtacatctcttgtggatcagttcaagtggagggtacattcacttggttgttcaaagagaacaagggagggtacatccgttgtagatctttgcttgtaaaggcttttacaaggttgaaaagaaatctcaaggaccgcaggtcgcttggggactggatgtag

SEQ ID NO: 47500 - DNA, 378 bp, Glycine max
  Peptide Sequence Number=SeqID_139185
atgtcacgccttctaactccgaagcaacagtgccgtccaagcatttgcataggggaaatcgacaacaaagttgacaccgcacacggccatgactcacacatgtgccgcctgagcatgcttaaacacaacctcactctagacgaaactaaactggagttgcacaaggctaaaccacatggtcagatcagagaaggggctgatgtgcgttcatgcgcagcaatgatcatgaatgagggacaaatgcgaataagtcaaagcaaaggagagataatcacttttagaaatttaaacctgaaagaaccttgttttttcccctttcttcatgagatatttcttatcccgtggaaaaattccactttggtgtcatttgcattctag

SEQ ID NO: 47501 - DNA, 318 bp, Glycine max
  Peptide Sequence Number=SeqID_139186
atgtccaaatcttgtggatttgggatgaccgaccctcttgatgagtcgatctcttgctttctcaaaagagtggacccttgggtacttatacctatcgccttcagaggactgcacgtcctcaccttgagaggactacacgtcctcgccttgagaggactacacgtcctcaccaccagagggctgcacgccctcacctccagaggactacacgtcctcgccttgagagggctacccgccctcgccttgggtactagttaccctcaccttcagaggactacatgtcctcactttcagagggctacacgccctcaccattaa

SEQ ID NO: 47502 - DNA, 312 bp, Glycine max
  Peptide Sequence Number=SeqID_139187
atgtaccctcccttgttctctttgaacaaccaagtggatgtaccctccacttcaactaatccaaaagagatgtatcttctcttgttctcagtcacaacaacccaagtagatgtaccctctacttgtaccacaaaggatgtaccctccaatgtgttaagacaaagttctcaagcagttagtcctttgaaactttgtaaaggggaaacaaaagatatctcaggcgggagaagagagacacgaaaagaattcaggcggttagtccttggcgaattctttttggcaaagggagaagagaatgaaaaagatgaatag

SEQ ID NO: 47503 - DNA, 51 bp, Glycine max
  Peptide Sequence Number=SeqID_139188
ggagaaagaaaagttgaggaaatgcttctcaactggggcaaggcaaaatga

SEQ ID NO: 47504 - DNA, 597 bp, Glycine max
  Peptide Sequence Number=SeqID_139189
gctgccatcgacgcgttccgcaaagaggggcacggcgggaagatcatcaacgcctgctcccaggcaggccacaccggcaacccggaactggccgtgtacagctccagcaagttcgcggttcgcggcttaacccagaccgcagcgcgagaccttgctccgctgggcatcaccgttaacgcctattgcccgggcatcgtcaaaacgccgatgtgggcggaaatcgaccgtcaggtctccgaggcggcgggcaaaccgcttggctacgggacggaaacttttgccaaacgcatcacgctgggtcgtttgtccgagccggaagatgtcgccgcctgcgtttcataccttgccgggccggattccgactacatgaccggccagtctctgctgattgatggtgggatggtggtaacagcgatgaacggaacaatcacaacgtggtttaaagataaaggctttggatttatcaaagatgaaaacggcgataaccgctattttcatgtgattaaggtcgccaaccctgatctgattaagaaagatgcggcggtgacgttcgaaccgacgacgaataacaaaggcctttccgcctatgcggtgaag

SEQ ID NO: 47505 - DNA, 67 bp, Glycine max
  Peptide Sequence Number=SeqID_139190
atgacactagctattatgaacctttggacactgctcctcggcaacggcgccaaatttgatcgaggcc

SEQ ID NO: 47506 - DNA, 596 bp, Glycine max
  Peptide Sequence Number=SeqID_139191
atggaatcgagagctccaagtgggccatttttggtaagcagaactggcgatgcggggatgaaccggaagctgggttacggtgcccaactgcgcgctaacctagaccccacaaagggtgttggtcgattaagacagcaggacggtggtcatgggaagtcgaaatccgctaaggacgcgcgacctataccccggccgtcgggggcaagggaccaagccccgatgagtaggagggcgcggcggtcgctgcaaaactccagggcgcgagcccgggcggagcggtcgtcggtgcagatcttggtggtagtagcaaatattcaaatgagaactttgaaggccgaagagggggaaaggttccatgtgaacggcactttgcacatgggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactg

SEQ ID NO: 47507 - DNA, 180 bp, Glycine max
  Peptide Sequence Number=SeqID_139192
ggatcgcgccccccaagacacccagtggacccggaaaagcccaacagggtcttggggtttccagctctgattacgggcgtctgtcagttctacagagtgcctgttgcccccagcaaggtcatcaggccccctaccaatcgagctttcatcaagaagtactgcgcccccaggcaggcgtag

SEQ ID NO: 47508 - DNA, 567 bp, Glycine max
  Peptide Sequence Number=SeqID_139193
atggaagacctttataagaggtggactgagcatcttaacagcacacgaccaagagtcagcataccaccactggagttaagtccttacaatcaacatgaagaagaaagaaatcctaatcttgaagaaggaagtcctaatctagaaaaattgttgacgcaattcaaggaaacaactgaatccactcaacaagcaatagctaatgcagaaattcagattggtaagctggttgaagctcaagaggaaagccctgcaaatgagcatgattcaagagaagaagataaagagaaagttgaggaaaaagcacatcaagtggaggagtacttacaagtagacatgcagccagaaagtatcctccaagtcaagacctttcctcatcaactaattgtcaaggaagaaagacatggagaatatcagaatgccttaagcatcattctttccttgatcaatgatacctctcctccaatgatttggacaatacttccaaactacatgaggttcatggaatttctagctaaaaggagaaactgcaaggaagatatgttctttgtgaccttcatgccaccttga

SEQ ID NO: 47509 - DNA, 327 bp, Glycine max
  Peptide Sequence Number=SeqID_139194
agacaggcccagggggatgctccgcaggccgcagacgcgccgccacctcatcaggccggtccagctggatcgtttgatacggagcagtatttgcggcatttggttcgccaacaggcggccaaccaccgggcacatagccagggctttacttcttttccgtgccctactccggaccagttcagggcagaggtcgcatggcctggagattggcctgaggcccgggcaggagaggcaccaacagaggctcccgacgaggcagatgaggcccacgaggacaaggagatgaccgatttacttgatttcttaggaggaagtggggccacatga

SEQ ID NO: 47510 - DNA, 168 bp, Glycine max
  Peptide Sequence Number=SeqID_139195
atgaatttaagaggaagacaagtggagataactgatccattgtgcccattctacaacaatttggatgaagatgcagtgcaccttttcttcaactgcagcaaggaaccatatgtatgggatcctatctatgtacaaagtacctctggtacttcatcactatttacataa

SEQ ID NO: 47511 - DNA, 360 bp, Glycine max
  Peptide Sequence Number=SeqID_139196
gttttatacacaaaagttagtcgtattcatcgactaacaacaaccaagaaggattctcaggtttccagcaaggtccctacaatcagcaaggacaatggagatcacaccctgaggactaccaaactggaagaaaccctggctcaattcatgcaagtgaccatgtccaaccataagagtactgagtcagccctaaaaaaccatgagattcagaatcgcaaagaagagtgtaaagttgttgtaacaagaagcaggaagcttgtggcggctgaggacgaggatgttgttgctttgaaggagcaagttgctttgaaggacactactgttaaaaagaagaataaggtaacagatgcaatgagttag

SEQ ID NO: 47512 - DNA, 144 bp, Glycine max
  Peptide Sequence Number=SeqID_139197
atgcttgccgcccaggcgagctcagttcgcccaggcgagctcagctcgcccaggcaagctcagctcgcccaggcgagccaggttgcttcctccagaagcaacagccttctggaggaatattctggagggcccaagtgggcctgg

SEQ ID NO: 47513 - DNA, 156 bp, Glycine max
  Peptide Sequence Number=SeqID_139198
atgactctaagacaacatggattaagcctaggatcttcttcatcaatggattcctttgcttcttggaagatgaatggcagcggaatggagaaggaagagagagaggagatgccacttcaaggagaagatgagtctagaagaagctcaccaccatag

SEQ ID NO: 47514 - DNA, 872 bp, Glycine max
  Peptide Sequence Number=SeqID_139199
atggtgaaagttggaaccttacgtgccgatcaacgtctcattttcgccaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatattgggcaacgtgaccttagcgagactgcctataaggccttctctaactaccctagtcattctttcttgccctataatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 47515 - DNA, 312 bp, Glycine max
  Peptide Sequence Number=SeqID_139200
atgaccaagagcaagggcaaggatccacttgaaggactaggaggacctatgacaagggctagagcaaggaaagccaaggaagctcttcaacaagtgctgtccatactatttgaatacaagcccaagtttcaaggagaaaagtccaaggttggctttagttcaagttgtaataagggcccaattggcaacctaggcatcagccttttgggagaccaaatggtggctgacttgttggctgttgggggtgacttttggttgccaacaatttcagttacactcagccatttagtttgttttaattccctaggttaa

SEQ ID NO: 47516 - DNA, 264 bp, Glycine max
  Peptide Sequence Number=SeqID_139201
atggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcacggcggagtggacagctccttggattagttttgtgtattttttagggtgggtgtatctaggactgactgttagccaccactatggacacctttgctctggatga

SEQ ID NO: 47517 - DNA, 201 bp, Glycine max
  Peptide Sequence Number=SeqID_139202
atgactcgattagtatcacgaggacattttagagttggaccgttacaatttcttgaagcaagacttatgagtcaagtatacgaaagtgagaaagatcatgttgaaggaagaggcttagactcaaggaggagtcttgtgatcggagtaacggaaaaagagtttcaactagacacacaacttgatattgagaatcatatgtga

SEQ ID NO: 47518 - DNA, 714 bp, Glycine max
  Peptide Sequence Number=SeqID_139203
atgacaattgaggaatcaatacatgttacttttgatgaaactaatattacctccccgagaaaggagtttcttgatgatattgcagattctttggaagatacacaaaatgaagaaagaaatctaaaaaggaagagagatgaagaaaatgaggatgttcaagatgatatagtccaagaaaatgatgatcttcccaaagaatggaaaacttcaagaaatcttcctcttgacaacatcatcggtgatatctcaaaaggggagttttctattgatatgcaaagtgagtttgagatgtccatgatggcaaaatattgcaaagaactcattaagagatttggaatggaaaactcaaaacacttggctactcctatgaacactagttgttatcttgacaaagggtggtcatgctgctgggcaatggcctcctcatcaaagccagagacttgtctcctcctctggttgtactaccactgtgatgtaagctccattggagcttgtaggcctaggatcttcttcatcaatggattcctttgcttcttggaagatgaatggcagtggaatggagaaaggaagagagagaggagacgccacttcaaggagaagatgagtctagaagaagctcaccaccataggaggccatggataagagcttggaggaagaaggagatgaatgaagggagagggagagaagaacacgaaattttgtgctctaaatga

SEQ ID NO: 47519 - DNA, 447 bp, Glycine max
  Peptide Sequence Number=SeqID_139204
atggggacgaggggttgcatcagctacaatctcgttcttgctataagacaacttggctaccctatgagaggggcgccactagaggatgagctcacgcctatcatttcgcgaggcttcaataagaccaacatggagacacttcaaaaggacaaggaactcaggggcagtaacaatgggcccatcggtggctatcgtaagtggttaaaagcccacgtgcatggtttggattggcttccaagtttgagaaccgctaaaagagaggaagttgaggcaccagaggaagacgaagaagtgcaggcccttagggtggaactcgagcaagcccaaacagttaaagaaaggttcaaatcagcagctctgaagatccgaaaggagaatgccgaactgcgagatataaatgtagctaccaccaaagccttggaacacgaaaaccaagagggctcgtag

SEQ ID NO: 47520 - DNA, 342 bp, Glycine max
  Peptide Sequence Number=SeqID_139205
atgttacggaaacgttacggaagtgcctcggcttggattttcttcacggaaacaattttcctcaataatttcgagagagggagaagtgctaagaaggctgaaccctttttcttcttcactcctccccctatttatagcaaaaataggggaggagcttgccacccagcttgcccaggcgagcaaggttgcttcctccagaagcaacagccttctggaggaaagatctggaaggcccaactttcgaagaagttacggaaacttacggattgcgcaaaaacacctcttttcgatttccgccacattacggaatttcacggattgcgcaagcctgcctccttttga

SEQ ID NO: 47521 - DNA, 384 bp, Glycine max
  Peptide Sequence Number=SeqID_139206
atgcttagcgcaactgaagaatctggcagagcatcaataccaaggccgcacgctaagtgtgaaattagtgtgctaagcatagcgattgtcttcagccaggctcaacgcatgactggcgctaagctcaaatccacttactcgcactacgtgcgaggaattagggtacagtggcaaaatcaccttggtaaccaattcaatagagaccagggtggttcatctacaaggccacaacagcagatgccaagtctctatgaccgaaccacaaagatggaagatactctagctcaattcatgcaagtgtcaatgtctaaccaaaagagcacggagtctgtaattaagaatctggaagttcaggtgggccagctttgcaaagaagttagctaa

SEQ ID NO: 47522 - DNA, 327 bp, Glycine max
  Peptide Sequence Number=SeqID_139207
gagtacaggtcgcttgagcaaactgaccaatggcttgcactcacattccagtggaagttgaataagcaaagatgtgttcgtgagaggatgtccattttatccatatcatttagcattgtaactgtggattcaacaagcgattctcctcaaatttcagccagcccgtatcaattagacttcacactttatgcttcggggtcatacaatgctcaatggaatgccccggggctcctccatgataagcacacgttgcgttcgagtcgtatcctcagaaaaatggaggtggtcttcgtcattggaagtgcggtagacagactttgtggttga

SEQ ID NO: 47523 - DNA, 189 bp, Glycine max
  Peptide Sequence Number=SeqID_139208
atggggttaggcttcccacaaatcatggtttttctaggattcaacaacttaggttctaggagaggattcatccatagatccagtgctggagctgctgatgaatcctggataggctgctctggctccatgactggtgtagatggctgggtctcctcaggaacaggtgcaggagatggctcaggtatctaa

SEQ ID NO: 47524 - DNA, 949 bp, Glycine max
  Peptide Sequence Number=SeqID_139209
ggtgcgaggacaggtcgttcgttttgacgctgacaccattaacgacttcctcgacaccccggttattttggaggacggggaggagtatacagcatacaccagatacctcagcactcaccccgatcctgacaccatcgcggccacactgtgcactccaggggggcgctttgtccttaatgctgatggtctcccctggaagctcctgaggaaggacatgacgacacttgctcagacatggagtgtcctttcttactacgatcttgcgcccacttctcacacttctgatgttaatcttgacagggcccgcttgatctacggtttggtgagccgcatggacatggatgtgggcagctttatatcacagcagatcagccagattgcccagtccagtacctcgaggctcgggttcccagcgttgattacagcgctgtgtgacattcagggggtggtttctgataccctgatctttgagtcactcagccctgcgatcaacctagcctatgtgaagaagaactgctggaaccccgccgacccatcgatcactttccctgggcctcgccgcacacgtaccagagcttcagcatcagctcccgaggcccctcttcctacccagtctccgtctcagccatcccagcgaccgcgacatccacctgcttccacctcagcatccatggacatgcatgggcagatgctgaggtcccttcacgttggacagcagctcatcatggagaatatgcataggttgtccctacacctgcagatggaccccccgctcaccactccagaagcctatcgtcagcgagtcgcctggccaggagaccagccctccactgacaggggggaagagccttctggagccgctgaggatcctgcagtcgataaggacctcattgctgacttagccactgctgactggggcccatgggcggacttgggcggaggcagttga

SEQ ID NO: 47525 - DNA, 375 bp, Glycine max
  Peptide Sequence Number=SeqID_139210
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgattcgtgcctacagagtgtctcaggcccacagggggcagccaaaagtggcaggaaggcttgaaattggaggtcgagacacgtga

SEQ ID NO: 47526 - DNA, 291 bp, Glycine max
  Peptide Sequence Number=SeqID_139211
agccttgcggattacataatcatcccctttttgacttacggaatgttatggaacctcactaattatgcaacgatgcttccatttgatttccggggtgtcacggaaccttacggattcaccttacaaggaccaaacaaaggtcgcatgtcatcaagcaaaggtccccggacgaaattagggtatgacagtgtgcttaggtgtcatgaggcatataaagcatcaaggacatgcacaaaatggaagcttgcttgtggggcttctatggaggctggatctttgagcttcaatgag

SEQ ID NO: 47527 - DNA, 498 bp, Glycine max
  Peptide Sequence Number=SeqID_139212
atggtgaaagttggaacctcttacgtgccgatcaacgtctcatttcgccaaaagttggcccagggcttcccggttcacagggacctcagccgagctttgagcttcgagcacgattctgcgaacggagtccgatcacaggtacttattcgcaaagtgcgtcgggtgatgctccaccagctttctgatttagttggcttcatgtttctatcagctgtccctcctgttcagctactgacggggtggtccgctcacaattcgcacacaagcataccgagccggacatcagcgccaagtgtagcgggtccaagacgctgcgctaactcaccattacatcccgccttgcgcttacactgcgccgctttcacagtcggcgaacctgtcccattcgcgcattcaaggctgatcggcaactgttgggaagggcgatcggtgcggctttcgctattgccagctggcgctaaagggggatgtgtgcaacggcgattactagttgggtaa

SEQ ID NO: 47528 - DNA, 171 bp, Glycine max
  Peptide Sequence Number=SeqID_139213
atgtgcatcgcaacagactataatgttaaatcaataggcggcttcactctctcaattcacttatgggcatgggaacgatacccaacgttagccccgtcgtttattcctccacaacaacaaaacgcatcacttgcatacagtttgtttgggtcccttagtctggacatgtga

SEQ ID NO: 47529 - DNA, 306 bp, Glycine max
  Peptide Sequence Number=SeqID_139214
atgtcgctgcatgttctctatctttatgcgttttctagatttccccccagggatttccggtccgttgtatctcttgttacgatctttcaaagaaatgaacatggatttgaggcttttagtcctcacgggcaggatcaccttgggctaccttctggagtggagacaaaacatgaacggcagaaaccaatcaaggtacttaaggatgaacgcaagcggggatggggtcacgaccgaccgatcgttgcccttctctgtgcgaaacaagcagggaatgcctgggcgagccacccctgcaccaaattataa

SEQ ID NO: 47530 - DNA, 102 bp, Glycine max
  Peptide Sequence Number=SeqID_139215
atggatcccgtgaaatacatctttgagaaacctcccctcacgggacgaatcactaggtggcaggggatggcctcaggcctatgtggtattctgaaacaatag

SEQ ID NO: 47531 - DNA, 411 bp, Glycine max
  Peptide Sequence Number=SeqID_139216
atgtcccccattttcaaagggggacatgccctcaccttcagagggcttcacaccctcgccatcagaggactgcatgtcctcaccttcgtagggctacacgccctcacctttagaggaccacacatcctcaccttcagaaggctacacgccctcgccatcagaggactgcatgttctcaccttcagagggctacatgccctcgtcttcagaggactacgtgtcctcactttcagaggactgcatgtcctcacctacagacggctacacgccctcgccatcagaggactgcatgtcctcaccttcagagtgctacaagccctcgccatcagaagaatgcatgtcctcaccttcagaggactgcatgtcctcaccttcgtagggcaacacgccctcacctttagaggaccacac

SEQ ID NO: 47532 - DNA, 837 bp, Glycine max
  Peptide Sequence Number=SeqID_139217
atgaataaaaccgatgaactccgcactgcgcgcattgacagcctggttacgccggctgaactggcacagcggcatcccgtttccgccaccgttgcggaacatgtgacggcctcccgtcgacgcattgaaaaaatcctcaatggtgaagacccgcgtcttctggtggtgattgggccgtgctccatccacgatctggatgcggcgatggattatgctaaacggctgcaggggctgcgggataagtaccagcatcgccttgagatcgtgatgcgaacctactttgaaaaaccgcgcaccgtggtgggctggaaaggcctgatttccgaccctgacctgaacggcagctatcgtgtgaatcacggtattgagctggcgcgtaagctgctgttacaggtcaacgagctgggcgtgccgacggcaaccgagtttctcgatatggtgaccgggcagtttatcgctgacctgatcagctggggcgccattggcgcgcgcaccaccgagagccaaatccaccgcgagatggcttctgccctctcctgcccggtgggctttaaaaacggtaccgatggcaacacccgtatcgcggtggatgccatccgcgcagcccgtgccagccatatgttcctgtcaccggacaagagcggccacatgaccatctatcagaccagcggtaacccgtacggccatatcatcatgcgcggcggcaagaagcccaattaccatgctgaagatattgcggcggcctgcgagtcgctggccgaattcgacctgccggaacatctggtggtggatttcagccacggcaactgccagaaacagcatcgccgccagctggat

SEQ ID NO: 47533 - DNA, 965 bp, Glycine max
  Peptide Sequence Number=SeqID_139218
atggctacctcaccaaaagatactgcatctcctggttcaccctctgtaccatcatctccattatccaccaaagcaccatcaaaccaggaacaacctaaattccatatccaacccatacaaatgattcctggtcaagcccctgagaaactggtccccaaaagacaacagggagtgaagatttctgaaaaccctagccttgcaacaagtcctagggaagtagacccggagatggataagaagatccgcggtattgtgagtagcattctgaaaaatgcttctgtccctgatgctgatgaagataaaagaggaatcaacagagaagaggatcaagcctcagaggaaacccctgcaccacgggcaccagaacctgctccaggtgacctcattgacctaagaagtagatctgatgaggaacccattgccaacaggttggcacctggcattgcagaaaggttacaaagcagaaaagggaaaacccccattaagaggtcaggacgaatcaagactatggcacagaagaggagcactccaatcactcctaccacatctagaaggagcaaagttgcaatcccctccaagaagaggaaagaaatttcctcatctgattctgatgatgatgtcgaactagatgtctcgacatcaaagagggccaagaaatctgggagaaaggtgcctggaaatgttcctgatgcaccattggacaacatctctttccactccattggcaatgttgaaaagtggaaatatgtgtatcaacgcagacttgcggttgaaagagaactgggaagagatgccttggattgcaaggagaccatggacctcatcaaggctgctggactactgaagacagtcaccaagttgggagactgttatgaaggcctagtcagggaattcattgtcaacattccctctgacataacaaacagaaaaagtgatgattatcagaaagtgtttgtcagaggaaa

SEQ ID NO: 47534 - DNA, 204 bp, Glycine max
  Peptide Sequence Number=SeqID_139219
atgacaaacgaagaacaccgaacgaagaacgatgtagaagtcgattacggttgcgattcgccctcctcacgcctatttattggaattgaggggacttggttgatctgcagctcgcccaggcgagctggagcttgcctaggtgagctgttgcttcaatctgaagtaaccttgctcacccaggcgagttggttacttcacccctaa

SEQ ID NO: 47535 - DNA, 309 bp, Glycine max
  Peptide Sequence Number=SeqID_139220
atggtgaaagttggaacctcttacgtgccgatcaacgtctcattttcgccaaaagttggcccagggcttcccgctcactcctgtcccagcattgggtatcagcttattcgcaataccgtcgctcagggggagtgcccgggtgttccagtcgaacgtttctgtgaggaaaaactgacgggccagcatgaatatgtgaatacggactcactattccagggtccgaattggagctcctaccgcggtggcggccgctctagaactagtggttatcccccgggcgcaggaattcgatggaagagttatttttaa

SEQ ID NO: 47536 - DNA, 675 bp, Glycine max
  Peptide Sequence Number=SeqID_139221
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctggatgatcttcttgagatcgtttggtctgcgcgtaatctcttgctctgaaaacgaaaaaaccgccttgcagggcggtttttcgaagtggctgcggccagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 47537 - DNA, 213 bp, Glycine max
  Peptide Sequence Number=SeqID_139222
atgggaggaaaatgcgcggagtcgccaccaacgtttattcgaggaaaacgtcggaaaaaccggaaaagacgtggtctacgaactttaaatgcgaaaggtttgggagttgtatttacgcacggggaagggtgtttcccttactcctacgtattcctcaattgtgataaggaaatcagacctatgcagttctttcaaaagggacgaatcaagtga

SEQ ID NO: 47538 - DNA, 198 bp, Glycine max
  Peptide Sequence Number=SeqID_139223
atgtcagtgaaaaatctcgtcgggcgcctagaaggagaccagtcagggtcacagtattttgcgagaatgcttcaaccatatgggatcaacataggcttaaaggagcactcaaatcgggtgacccccaaggcctacactccgaagagtctgtcagggtctctccctcctgattcaggttcaatccagaaaacattttag

SEQ ID NO: 47539 - DNA, 729 bp, Glycine max
  Peptide Sequence Number=SeqID_139224
atggcaatttcatttatttccctgctagctatgtctgtggtgctggccacttgtttcttcgttcacaggcattgcataagaagagaaaggcctcgagctcctcttataactgcacatcaagaacatgtgctatatgccttgaagactattgtgttggtgagaagctcaggattccgccctgttgtcacatgtatgccaaatttttttcataaattcaatataaattctgcaccttgcaattctattccattggattctagtgttaaaaagtcgagtgaattttctcccggggaacttgaggaagaactttttagactattcctcaaaactcgatttcaaccaagttacggaatgggtgtgtcagaaaatagctggatgacactcatggatcgtcttttgacactaaacaattactgcactaatgagaatgagaaggaacgtgtgaaagaaaatatgctcaaattgatcgatatatactatgaggcattagatgctcctaaaagtggaagaaatttggaagctagttgggctaatgttcctgtatttcctaggcaaatttccccatctggggtagttttagaaactatttccccagatggggtcgtttctaaaataattacagcatggggcagttttttacgtgcatgcaagaccctaactggtgtcagtgagcaacccgccacacccagtggcgatatgaccgtgcagagcctaagtcgccggtcctaa

SEQ ID NO: 47540 - DNA, 1110 bp, Glycine max
  Peptide Sequence Number=SeqID_139225
atggaactcgtctacactattgctgcaatggtctgctctcgcttcttctgttggttgcacttctcgggatcggtgccaagatgggttttgtgtctcccactgccatatcagacagaggacttgagctgctgtccacaacttttgccttcagttttcttgtatgtaaccctgatattgcatttttccggttgcaagtcacaaagtaaaggttcatcactaaagcctcatctcagtggaaacctgatacacgattggtggtttggtatacaactaaatccacagttcatgggtatcgacctcaaatttttctttgttagagctggaatgatgggatggctacttatcaatttatctattcttatgaagagcattcaagatggtactttgagccagtcaatgattctctaccagctattctgtgcactatacatcctggactattttgtacatgaagagtacatgacatccacggggctgacattggaagtgcaaacacttggatggggaagtatatgtggcctagtggagggtcaaagtcaaaccatcaccatcacacctctaagtcctaaagacattagcagtgcttttagagaggggaggggctgggacataattgcagagagactgggcttcatgttggtctttggagatttagtgtggattcctttctctttcagcatacagggatggtggctcttgatgaacagtgtggagttaacaccagctgccattgtagctaattgctttgtgttcctgattggatacatggtatttcgaggagcaaacaagcaaaagcatgtgttcaaaaagaatccaaaggctcctatctggggtaagcctccaaaagtcattggtggaaagctacttgcttctggttattggggtattgctagacactgtaattacctaggggatttgatgcttgctctctcctttagcttaccatgtgggataagttcaccaattccatacttctatccaatttatcttcttattctgttaatctggagagagagaagggatgaagctcgttgcgccgagaagtatagagagatatgggccgagtatcgtaaacttgttccatggagaatattgccttacgtttattag

SEQ ID NO: 47541 - DNA, 1555 bp, Glycine max
  Peptide Sequence Number=SeqID_139226
atggaatcgttccaaggtgacagggatgacatttcctaccaaatgggtttgatttggagccaagtgaaggagccagtgatcgtgccaatgctgagagttgcagtgtttctgtgcttggccatgtcgttgatgatgctggtcgagagggtgtacatgggcattgtcatttgcttggtgaagctgtttagtcgaagacccgagaagcgttacaagtgggagcctatgaaggacgatgttgagttgggaaactctagctatcccatggttttggtccaagtcccaatgtacaacgaaagagaggtttatcagctatcaatcggtgctgcttgtggcctttcttggccttcagacagaatcatcatacaagttcttgatgattctactaacccaacaatcaaggagctggtgcaaatggaatgtagtagatgggcgagcaaaggggtgaacataaagtacgaggtgagggacaacagagacgggtacaaagcaggggctctgaaagaaggcatgaaacgcagctacgtgaagcaatgtgactatgttgccatctttgacgccgattttcaaccggagcctgatttcctctggcgaactgtcccattccttgtcaacaaccctgaacttggtctcgttcaggcacgctggaagtttgtgaatgccaatgaatgtttgatgaccaggatgcaagagatgtcactggattaccatttcactgtggaacaagaagtggggtcttgcacttacgccttctttggcttcaacggaactgctggtgtatggagaatttcggcgttgtatgagtctggagggtggaatcataggaccacagtggaagatatggacctggctgtccgagccagtctcagaggatggaaattcttgtacctacccaatttgaaggttaaaaacgaattgccaagtactttgaacgcctaccgcttccaacagcacaggtggtcttgtggaccagccaatcttttcatgaaaatgttcatggagattatgagaaacagggtgtccttgtataagaagatatatgtgatttacagcttcttctttgtccggaaggtcgtggcccacctcaacacttttatgttctattgtattgtgttacctgctactgttgtggtgcctgaggtggtggtccccaagtggggtgctgtgtacatcccttccatcatcacactcctaaatgctgttggaactccaaggtcactccacttgctggtcttctggattctctttgagaataccatgtctctgcatcgaacaaaggcaacgattattggtctactagagggtagtcgagcgaatgaatggattgtcactcaaaagggtaaaccacccaagagtcggtttaggataagtgcttacctatctatatttgttgtctttgtgatgaatatcgttaggattcatcacatgttggaacttcttgttggattctacctcttcttctgtggctgctatgatattatgttcgggaaaaaccgctactacatattcctatacatccaatcaattgctttcttcatcatggcctttggatatgttg

SEQ ID NO: 47542 - DNA, 1215 bp, Glycine max
  Peptide Sequence Number=SeqID_139227
atggaaccaacaacaacattgaacaacatcatcaacaacaacaacactgttcctgcagggtcaccaccaccaccaccaccaccctcagtgcctcagccaatgaacatgaatgtcaacatgaacatgaacgtgggaaacacagaaggaacaacaccagcagttccaacaccaacacccgcgccaacaccagcaccaacaacaatggttcctgcagtgccagctccaaccacaacaacaccggggagtttggatttgtttgggaagaagaagagagggaggcccagaaagtatgatgcagatgggaacctgagagtgagtgcaacaccaccaccaccaccgggtttcactttgtccacaccttcttctgagttctcctcttccaaaagagggcgtggtaaacacaacacaacttttggcaacaacaactaccaacaactctattcttcttttggtgaggtgtttgcaaacacagctggtggtgattttgtaccgcatgtggtgactgtttatactggagaggatgttgctggaaagatcgtgtcatttgcccagaagggtccaagaggaatatgcattctctctgccaatggagctatctcgaatgtcaccatacgccaacctggttcttctggtggcatattgacttatgaggcatggtctcttagatctaaatgctttttgaaagctgagtatcagttattggaggagatatgggccaaattagataaacttttcagggaacacttgtatgataaaaagatagtagttgctgacaacagtggcatgaaaagccgaactggtggattgagtgtctcacttgctggtcctgatggtcgggtgataggtggtggtgttgctggacttttaactgctgctggccccatccagattgttgtaggaagcttcatgcaaaatggttacaaggcccaaaagaggaagtaccaacgtgaacaacagatagtggccacccctacttcagctggtccagaaatagtgacagcagtaagacctatctcacaaacaaatgctgatggtgaaaactttctgatacctatgtctcaaatgccagaccaaaaccagagagaatctgtcagtgtttcaagtgacaaacagaacctagatgctactcctgatgctgctacttggaatggttctgaggaatattcagaccagaggacttccccagacatcaacatatctttgccagatgaatag

SEQ ID NO: 47543 - DNA, 441 bp, Glycine max
  Peptide Sequence Number=SeqID_139228
atggtggagcacgggaacgaatctacaaaattcttgctctgggattgcgaatgtgcagagttgattggtcaatcagttgatgaggtcaacagactgaaaatagaggatggtgatgttaatctaaatgtttcccctcaagcgcttgatagactgcttggttgtcttcttgcgttcaaagtcaaggttcagccaaagttcgggaatgctgttgttctcaaatattcacctgatttagatttgatcaatttcgtgctggatatgctgcctgatattgttgtcgtattagctatatattggactttcattattttgaatttgagggtggcaatgcacgttcatatgtcgtacgttgagaaaccgcgacaatggtggtggtgttgttgtggtttggggatgacggctctcaagagtgttcttccattcatctatcctgaagagtga

SEQ ID NO: 47544 - DNA, 213 bp, Glycine max
  Peptide Sequence Number=SeqID_139229
atgtctggccgaagttacccaccattatttatgatcgccggcggagtgcatggcgaaggagagaacgaaaacgccgttgtgtttggttgggagggagttatgggaatggtgttaaacggatggagatggagggtagcagtggacccaggattcccattcaaggtgttaatggaggaattgtggggccatgcaggccaagttcagtttgaatga

SEQ ID NO: 47545 - DNA, 483 bp, Glycine max
  Peptide Sequence Number=SeqID_139230
atgggtgttcagactcgtgtacaaacttcagttgccatgcaggagtttgctgaaccatacaataggcagcgggccatcagacatcttgagaaaggaagggtagttatatttggtggcattggttttggtgctggcactcctcttttctcaactgacatagctgcagctcttcgggcttcagagccatcagcatatatccccttgtatcttgcagttaatgcggaagcagtcctcaagggtactaacgtagatggtgtatatgactgcaactcacgagacaacaatttcacttttgagcacatatccttcagagagttgggttcaagaggtgtcacctctatggatatgtcagcgctgacattctgtgaggaaaatgccattcctgttgtggtttttaatctactggagcctgggaacatctcaaaagctttgtgtggagaacagtgggagatgcttgccatgactgagattcttgaagaataa

SEQ ID NO: 47546 - DNA, 1260 bp, Glycine max
  Peptide Sequence Number=SeqID_139231
atgaaagaaactgaagttttcaatgtctccaaacccgagttcaatttagctcctgtgaataaaccagatgaatctcacccaagactgaagcagaaaagaaagttcagtttcttagatagaaccgaagttgttctagcacaagctcgagctgcaatcagagaagccagaaacaggaatcgaacactagattcagattatgttccaacaggtccaatgtattggaatgctaaggcatttcacaggagctacttagaaatggagaaacagttcaaagtatttgtgtacgaagaaggggagactccagttttccacaatggaccttgcaaaagcatatactccatggagggtaacttcatacatgctattgaaatgaatgaccattttcgaactaaagatcccaagaaagcacatgtgtttttccttccttttagtgtagtaatgatggttcgatttgtgtatgaaagagactcacgtgactttggccctattaaaaaaacagtcatagactatgtcaatctcattgctacaagatacccttattggaatagaagccttggagctgatcacttcatgcttgcatgccatgactgggggccagaagcatcattctccttaccttacctgcacaagaactctattcgagtactttgcaatgccaacacctctgaaggattcaagcctgcaaaggatgtttcatttcctgaaatcaatctccaaaccggttcaataaatggtttcgttggtgggccatctgcatctaaacgttcaattttggctttcttcgctgggggagttcatggccccattaggccaattcttcttgagcattgggaaaacaaggatgaagatattcaagttcacaagtacctcccaaagggtgtttcttactatggcatgttgaggaagagcaagttttgcctctgccctagtgggtatgaggtcgctagccctagagtggtggaagcaatttacacagggtgtgttcctgtgctcatttcagagcactatgttcctccttttagtgacgttttgaattggaagtcgttctcagttgagctttcagtgaaagacatacccatcttgaaggacattttgatgagtatttccccaaggcagcatataagaatgcagagaagagtaggacaaattagaagacactttgaggttcattctccacccaagcgattcgatgtgtttcacatgatccttcattctgtgtggcttaggagactcaacttcagagtccgtgatgatcaatga

SEQ ID NO: 47547 - DNA, 309 bp, Glycine max
  Peptide Sequence Number=SeqID_139232
atggcaaagtcattagttggacattcatatgttggtcgattgactaaggataaaaagataattattgttgatatgacaaagtcaatggtgaaaccaagaaatatcttgctaacgctgaaggagcacaatgccaatagttatacaacaatcaaacaaatatacaatgcaaaaagtgcatacctttcttccataagagatagtacctacaaaacaaataggtacaaactcccgttacttgactttgttggtgtgacaccaatggggatgacattctctgttggttttgcctatttggagggagaaatctaa

SEQ ID NO: 47548 - DNA, 978 bp, Glycine max
  Peptide Sequence Number=SeqID_139233
atggttagaaccaaagatttgggtcgggctttaagcaaggttataggaagagccctgaggagaaaagatgttcaacacgtagatcatgcaattgacgaggtccacgaacaacctcaagaagtagctgctgatgatgaagttgttgatgccgggctatcctcccatggaaggaagattcagaaattcgacaggcctgttgtagagattgaaggcttagttgccgccacaagattaagtcctctgatcgcacgttccttggacactggcgatcggagacttatatcggcttttgcggagatgtgggataaggaaactagttgtttccatcttcctgtaggagaggtgactatcgcccttaatgatgtggcctttttacttcatctgcccatcacaggtgtgttccataactttgaaactcttcatgttgacgaagtggtgttgctattaatcaaattacttgaggtgagtgcagatgaagcaaacgctgagacgggttgtgcagcaatttgggtatgttcagaatattcctccacacacttcgacgtcaagattatgttagaagatattgatgacagatggatacatttttctaagtaccttgcatcagtgggtcggatttgtgttgtgcctggacagtgtgcagcagactacatcgaccgggatccagctagacatccacctgtcgtgcaagatgacacatatgttaaaccagatattcctcaatacctggtggcagcagcagctatgaaggaaggacctacagatgcacgttctcatgtagagcagcttcaacatacagtggatgcttgccaagcaatagctgaaaggttagaacggttgttgaacctgaggatagtgacagaaggtacagaaatataccgtgtgatggaagattgcttaaggatcgccagaggtgtcactacggaacgcaatgtatatgtgtggtcacgacgaaggcggcgtatggaagacgcatga

SEQ ID NO: 47549 - DNA, 270 bp, Glycine max
  Peptide Sequence Number=SeqID_139234
atgttgttatatatacgtgtctcagagagagataccatcttgctgagacctgaagttgacgtaaccgtaacagagcgagttcatcgtcacgcggtctctgcagacgcgaacggaagcgatgctcccgaactccacgaaagccgcgaagaggtggtgttcctggacgtctgggtggaggtctccgacagagaggggaagaagaagaaagggaaaagagtgcgagtgactgagtgtgaggaccttgcatgcacgcagacgaaggtggattga

SEQ ID NO: 47550 - DNA, 666 bp, Glycine max
  Peptide Sequence Number=SeqID_139235
cttcttgttatcatgcatacttgtggtgccttaatggggagtgagattgagcttaatttctttgacacggttggctcatccacagcagcgttgattccctgctcggacccaatatgcacttccagggtccagggtgctgctgctgaatgctctccgagggttaatcagtgcagctacacctttcagtatggagatgggagtgggacatcgggttattatgtttcggatgcaatgtattttagcttgatcatggggcagcctccggcagtaaactcttcggctaccattgtttttgggtgtgtgcaatcaatggaaggttgggaacacatgaagagtagaactgaatgggagagttggatgagtttgagtttttggagggaaatgtgggatatgcttggggaaaaaaggtgtagcatcagtcagtctggagatttgactaagacagataaagcagttgatgggatttttgggtttggccctggtcctctatctgttgtatcacaattgtcatctcgaggaataacacccaaagttttctctcattgcttaaagggagatggcgatggaggaggtgttctagttcttggtgagattttggagccaagtattgtttatagtcctcttgtaccatcacagaatgtacaaggcatttctgaaagaaattga

SEQ ID NO: 47551 - DNA, 249 bp, Glycine max
  Peptide Sequence Number=SeqID_139236
atggtatcccacacagagagcaaaggcgtgattcttgggatttctgaggcatctgtcaaacctgtcttcttccttgatgcatctttggtgcctttaacgaccttctatcacaagatgacaaatgtggtatccatgaccatccaaattggctcatccaaggctttcgggaggcagtatctgattgtgatcttcatgacattccaatggaaggctaaaaatgcacttgggctagaaggaaaggcagactag

SEQ ID NO: 47552 - DNA, 936 bp, Glycine max
  Peptide Sequence Number=SeqID_139237
atggaggagccttcagcatatgggaagttaggcctcgccaatctcttggaaatgagggaagagtgcttgagggaatttcagtttgctgatgcctatagaagtataaagcagagtgcaaattgtccaaaagcaatttacttagctcagaagaaattagctgcatttgttctcgccatgggatctggggaaaatgaggcatcgcttgctgttttacctgacttgctggtggaacttgatagtatggatgaggaatcaaggttgcttacgctaattgaaggtgttcttgcagcaaatatttttgattggggatctcgtgcatgtgtggatctctatcataaaggaactattatcgaaatttatagaatgagtcgcaataaaatgcgtagaccttggcgggtggatgattttgatgagtttaaagagagaatgaaaatgccctgtcataagagggctttactttttgtagataactcaggtgctgacattgttctagggatgcttccactggctagggagctcctccgtcgtggaactgaagtagttctggttgcaaactcacttcctgccttaaatgatgtcactgcaatggagcttccagatattgtagctgaggctgccaagcattgtgacattctaaggcgagctgctgaagctggaggcttgcttgtggatgcaatgattaatacttcagacagctctaagaaaaattcatcttcagtccccttgatggttgttgagaacgggtgtggcagtccatgtatagacctaagacaggtcagctctgagctagctgctgctgcaaaagatgctgatctgataattttggaagggatggggagagcacttcatactaacctaaatgctctgtttaagcaggatgctttaaaggtaatatcatctggtttatggctaatagctattattgttgttagatga

SEQ ID NO: 47553 - DNA, 1507 bp, Glycine max
  Peptide Sequence Number=SeqID_139238
atgcagaaccctgcaatgacaatgacatcgaagaagacaaagacaactataatgacaagtgctttgcatgagggtgatgacaatggtgatgttggtagtgttagtagcgacaacggtagagatactagtgatggttgtgatgacagtggcgtggtgatgatagcgatgtcaatggtgtcaatggtgatggtggtggtggtgataacgacgttgatggtagttgtggcaaaaatgttgttattagtggtggcgatgacaggtggtattggtggtggtagcgatgatggtaatgatggtggtggtggtgatagtagtaatgttagtggtgatggtgatattggtgatagtgacaatgatagtaacgacaatgatgatcatgatagtagtaatgttggtgggatcgatgacaatgacattgataatggtggtagcggtgttggtgtcgttgataatttggatggagcactttcttgtgcagagagaacaaaatctcttgatgccatttctgaaatagactgtttatctatatttacaatcggtgaagctgctcattcctctgaagttgctggatttagagtaggggaactctcacttcctaatggagaatcatattctgggtcctttcttggtaacattccagagggtcagggtaagtatgtatggtcagatggttgtgtatatgagggtgagtggagacgagggatgagaaatggatatgggaaaatacaatggccttctggagtaatgtatgagggcgagttctcaggtggctatatccatggtacaggagcatatattggccctgatagtctgacctacaaaggccggtggcgattaaatcttaaacatgggttgggttatcaagtttatccaaatggagatatctttgaaggctcttggattcaaggagcaccggaggggccaggcaagtatacctgggccaatggaaatgtatatttgggaaatatgaaaggtgggagaatgtcaggaaaaggaactctcacctggataagtggggactcatttgaaggaagctggttaaatggcatgatgcatgggcttggggtatatacatggagtgatggaggctgctatgttgggacttggacacggggtctaaaagatggcaaaggaaccttctacccgagaggcagctgtcttccatctgcacaagaaatatatctcaatgcattgagaaaaagagggctgttgccagatttgagaaaacagaaacaggtacatattcatcatgctgcttcggttgatatgggagatgtcaaggttggtgagagtcagagatcaaatcgtgtttcatctgataagctagccaaaggaaacctgttaaatctggaacaatctcgcagcaaaaatatttctctcgaaaggcgctggagtcttgaagtatctattgagaaactgattgggcatgattcaaaattaggatcaacagattctgtagcagaaaatggagataaagtcccaattttggaacgcgagtatatgcaag

SEQ ID NO: 47554 - DNA, 378 bp, Glycine max
  Peptide Sequence Number=SeqID_139239
atggtggatttgccacaaccacttttggtccgcatagacacaggtaggcacagggtacagggcgcaggtgctgcacagggcacagtggcgcgcaatgtatttgatatgacaagttcatcatcctcttcatccagttttgatgtgtacggagatgcagatagaaaattaagaatgaggcaagcgattccaacttatcagggtatagaacaatcaccgatagaaattattcctctgttacagcagtctggattatacacagcaataaaattgtgtagaatcaaaatcaatggaggaattgtaaatgcctttgttgaaaggtggaggccacagacacacacctttcatttgacgtgcgggaatgccaccatcacactataa

SEQ ID NO: 47555 - DNA, 126 bp, Glycine max
  Peptide Sequence Number=SeqID_139240
atgagtattccatggtggtcattagagcccacatattctagatacttgtacccctgctccacccacaagacatgccatcaggacccaccgccaagaagacttgtaaccgagggggagaatcaataa

SEQ ID NO: 47556 - DNA, 306 bp, Glycine max
  Peptide Sequence Number=SeqID_139241
atgaagagaggctactacatgaccaagggtcccatgcatgaaggtgcttctaatttgtggactattccacgtgactcaaacacacctttagcttcttcccgtctccttgaaccgctgaaaggtaaaggtccaagacaaggtgagaaggaagtggaggtgaatgaaaacgctattcctcagtcatctgatatggaagaactaataggatcagaggagtgttatatgaaggatgaagaatgcactagcagaaggatgatggtggaggctcacttggactacatctacacccaacaccataagcattga

SEQ ID NO: 47557 - DNA, 543 bp, Glycine max
  Peptide Sequence Number=SeqID_139242
atggagattgggatgttattgattttgggggagtgggttctcatgaataatcccatcaagcgtgacaaagatgttggttcaaatacaaagagattttctttgagggaaaggaggaaaaatagcatgggtcaaatgggagaaaatctgcctcccaaaggaagaggtgtcaaagaagcatattccagattaatcaaagaggagttcttggaagacttggacaacactttcaaaagcttgtggaaatctgccattcattcaagcgttctagcctttgcctggagacttttgttgaacagggtgcaaacaaagtttgcacagtccatgtgtgttgtccaaacttgtgacccacttaatcatcttcaacaacactacatagagggtctgagtaaggaagccaatgatgcgtggatggtgacttggtttgcagttgtttggttcttatggattcagcggaatgcaatcatcttcaacaatgagcagaaggatgaaggaaaggtgtgggaaacttatcaaaaccagagcgtggctatggctggtagctaa

SEQ ID NO: 47558 - DNA, 1263 bp, Glycine max
  Peptide Sequence Number=SeqID_139243
ttgatggtactagtagacgatgctggtggagcttatccacgcattgatcactccccgtggaatggatgtacattggctgatttcgttatgcccttctttcttttcattgttggggttgcaatagccctggcactaaagagaatccccaaggttaagtatgctgtgaagaagataatccttaggacattgaagcttctcttttggggcatacttttgcaaggtggatactctcatgcccctgatgatctatcatatggagttgacatgagatttatccgatggtgtggcattctccagagaatagcccttgtatactgtgttgtagctctaatagagacatacaccaccaagcttagaccctctaccttgaagccaggacacctgtccattttcactgcctatcgatggcaatggttggggggctttgtggcatttgtcatttacatggtcacaatcttcagcctctacgttccagattggagtttcgtggattataacagcgacaaacctaagagatacacggtggaatgtgggatgcgaggacacctaggtcctgcatgtaacgctgttggatatgttgatagacaagtttggggcgttaatcatctttattcccaacctgtttggacacgcttgaaggcatgcacactcagttctccagctgaaggccctcttcgtaaaaatgctccagcttggtgtcgcgctccctttgaacctgaaggctttttgagttccgtattagctatcctctctggcaccattggcatccactatgggcatgtcttgattcacttcaagggtcactttgaaaggctcaagcaatggctctcaatggggtttgtgttattgaccctaggcctcatccttcattttacagatgctatcccgattaacaagcaactctacagcttcagctatgtttgtttcacagctggggcagctggaattgtcttctctgtgttctacctactgatcgatgtttgggggcttcgtactccattcttattcttggaatggataggaatgaatgcaatgctagtgtttgttatggcagcacagggcatcttcgcagcatttgtaaatggatggtattacaaagacccagataactcactagtatactggattcagaatcatgtgtttaccaatgtttggcactcagagaggttgggaactctgttatatgtcatctttgcagaaatcaccttctggggtgttgttgctggcatcttgcacaaattaggaatatactggaaactataa

SEQ ID NO: 47559 - DNA, 792 bp, Glycine max
  Peptide Sequence Number=SeqID_139244
atggaagcagagactttgaatgcaaatcaccctcccggttttcttcaccggtcgctccccgctgttgtgcctatccttttgatttcaataggatatgttgaccctggaaagtgggtggcaattgctgaaggaggtgcacgatttgggttcgatctgatggccttcatgcttatctttaattttgcagccatcttctgtcagtacatatcagcaaaaattggtgttatcacaggaaaggatcttgctcagatttgcagtgatgagtacgataattggacatgcatgcttcttggagttcaggcagaactttcggtgattatgctagaccttaacatgatattgggcatggcacatggattaaatattctttttgggtgggacttgttcacttgtgtctttttaattgctactggtgctgttttccatctccttctttttgccctcctggacattgagaaggtgaagatcctgggcctgtttgtgtcaggttttgtatttctttcgtttgtacttggaacactcattaatcaaccagacattccattatccattaatggaatactaacaaagttgagtggggagagtgcatttgtgctgatgagtctattaggagcaactcttgtgcctcacaacttctaccttcattcctctattgtacagatattacatgcttgggaaagtttgctcattggtgggtataaatcaggaactgttctaaaattgggtgtcatgcaaaaactagagggaaaaactaacattttattgctagatatttttgttggggaaatctag

SEQ ID NO: 47560 - DNA, 435 bp, Glycine max
  Peptide Sequence Number=SeqID_139245
atgggtgaaattgtccttctgcaatcccttcttccggaagaacctacttcctggaaaaattccggaagacgtctttccgaacaactttcggaagaagacggtgggcttccagaagaactcccggaatgcgttccgaaaggacgtgtttcgagcttattccggaggaagattcttccggaagaccaccttcttcttacggaagaaccttcttccggaagtgctttttttttagagaagatgaacagtaaaatgataaaaaaaatttccggaagaactttgaactaccagaggaagttgttctgcaagaacaattgtgaaattccggaacaacttattccgaaagttgatctgtcaacttccggaagaagtggttccggaagagacttccggaacaacttctttcagaatttcagtgttgttcttccggaatgttag

SEQ ID NO: 47561 - DNA, 5982 bp, Glycine max
  Peptide Sequence Number=SeqID_139246
atggaggttggggaaatggacagaaaggagccacaagttgaggttccttggagccccggcacccctattaaggccgttcctatgaaaccaatgccgatctgctcgcctggggagagaaatcaaatgggtcatcatgcaaatggagcagttgcatgtgatgaattttcacacggccaagacaaaattggtgggttaggtgatgggtcaaatgttgccactgacggtggcaaaacttgtgaaccgacagattcggatgctgtttccaactatagcaaacttgggttttgtgaacaattgtttgcggttgaggctgaatcgaggaactctagtgtgacacaagggaataatgatggattgaagaatccttttgttccttcattcatccttgacaatgtccaagaccctcaggaaacatacattgcttgctgtagcatgaaaacttcacaggataccctatttacacttgacaatgccaacaaagaaggcataaaaatagcatcaatgcaagtcaatatggaagaaaaggatccaggaggggaagagagaaatgcccctgccaataagcttgacaataatgtaccgccaaacagcaaagaactctgtgaccctgcaatggaatttgctgctgtttcttcaccattgaaagagaatcacaacccagataagggaagcagtcatgatactgatcttaataaaacaccacaacaaaaaccaaggagaagaaagcaccgtcccaaggtcatcaaagaaggcaaacccaaaagaactcggaagcctgctaccccaaagcctgttcaaccaaaagaaaacacacctgtcaagaggaagtatgtgagaaagaatacagtgaacaagacttctactcctcctaccgaagaggctagggaattgagtaaagaaatgtcttgtaaaaggtccttaaatttcgacataggaacaacagatgaaagttctgctgccatagataatacaactgcactattgggaaaagaaaatggtattctcgttcaagaaacaaatgtaggttctgcatttgatctaaacacgtccatgaagcaggcatcaaacagttacatgtcactaccagaagacaaacaagcccttaatacatctccttcgagaagaaaaagctcagggacaaagccagaggaaaacacgcctcccaagaggaagtatgtgagaaggaaaggagtgaacaagacttctgctcctccaatagaagttcctggaaatttgactaaagaaacaatgtctgcatctgcccaaacatcatgcacagagtccatatttgatgaaagagcaagagatcaaagttatacagtcaaagagaatccaactgggcatccaggcagtgaaattggtgtactcatgaaggaaatgaatgtgggccttgcctatgatttaaacacttccaggaagcaggcattaaatgatgacgcgacattacctaaggacacacaagccccaagttcatcttcaaaaatcaatctccctgggacaaagagaaaagaaaacctgactggcaagaggaagaatgcggggaaaaaaggatcaaatccgtctcctattcctccaacagaaattacagaattgactgaagcaaggatgcttgaatctaacatgtcatggagaagatccttaaatttggatatgggaaatgtaggcagagaaaatttggatttgcacacagggaaggaaaatctggtgttagaggaaagaatagtaggtcccacctataaagacacttggttgaaagaggcagtaaatatttgcatgtcattacctgaggaaacacgacgcccaagtacatctatttcaaaatgcacttctgctgggtcaaagctgaatgccaactctgtagagaagaaaaacaaaaaaggccgggcaactgctcggggtggaaacatcagtaatagtcaaagttcatcaataaggtcacaaatggttggttcaaagagaaaacattctggcacctttaatcgtgcagatgacagcagcatgaatctgattggagtgcaatataatggactgccctcataccaaactagcatttgccttcagtttccaaaaatacagaagaaaagaactgaaacggggaatgcaacaaaagaagtccaacagacatgccctcaggaagatgctctaggacatccatatgcatcaagctccagctgctggacttatggttctggatataatacagctagagtcccagccacaagtggatcgacagaaaaattaaaaattgataatactcaaacattcaatgagttcgtcttgtctttgaaaaggctggcagaaagatctcaaacctctacttgtgatcatggttctctaaccagaattagaaactgtgatactgaaccaaattatactgcaaaacaagtaggcgtctctggcagagaaacatttggggatgcaattggtgctttagttgcagagacatgtacaccacccacaaaaaagaagcggaatagaaagaaaagtgttccttccagttcagcacattctaccacaaatgagatgctacagaaccataattttacattggaaaattaccctctgccaatggggaagccatcagacattgttcctgaagtactatggaacaccatgaacaatattgatgcattaacattgcaatttagacaactaaacttaaacacagaagtcagagaccttgcatttcatgagcagaatgcacttgtcccttataaacagcaaaacagccttatccatggagatggggtcatcgttccctttcacattaagaaacagcatctacgaccaaaggtcgaccttgatgatgagactgatagagtgtggaagcttttgctgttagatataaacagtcatgggattgatggaacagatgaagataaggcaaagtggtgggaagaagaacgaaatgtgtttcgaggacgagccgactcttttattgcacgaatgcatcttgtacaaggagacagacgattttctcgatggaaaggatcagttgtggattcagtggttggagttttcctcacccaaaatgtcactgaccatctttccagctctgcattcatgtcccttgctgctcgatttcccaaaatttcaagcagcatgtgcaaaacacaccatgcagaagacacaagactggtagtcaacaaaccacaagtgcatatagtggaaccggaagagagcactgaatgggatgtaaaattattgaatcaatctgtttatgaccagccttctccaacaatagatatagttgagcattctcgagaaaaagaagccttcaacagcaatgaatcctgtggaactaccagcagtgtaattagcttaacagatgaatcaaactccagattgtcagaattacctcaaaagaatattaaggaacactgtagtccaatgagaagtggactacttagtgcttcaattgaggaaggagaagaaaaatcatgttacgatggtgataggaaagagttaaatgacatagtttcatcccaaggctctgttatttcatctcaaatatctggagatttttcaaatgatcaaaatcctgagaaaataggatcatgctcagatagcaactcagaagtagaagttttgtccagcacagcaaagtacaaccattttggtagcaacacttccttcagtaaactcctcgaaatggttagttcaaccaagttttatgcagataacagtcaaaaaagcgaatcaattgagaacttaagagatgcatatgatcaacatatacacaggcagcataacaacacaatagaaagcttgaaaaaatcaagtgctactcagggctctgcagaagcatccatcatcctatctgatgaatatactttgaaactcgcccccaacttaggaatgcttgatgttaactgctttgatcctttcaaaacagaagcatcaacaagtgacttcttaaaaaaaaaggatgaaaatagcatgaacagatctagtcttcaaacaacagaacctggaggccaagttgcaactacccattctcaaagtattgtatctcaagtccatcctcaggaacaaagcaatcaccagcagcaaagttttttcaacatttctggacaaactcaagatcttatgcagaaaggaagggggtcagatcttggtgagcaaaaaaatgccatgaggaatggaaccaatgagataagttctgccccaataaaatttaagagcaaggaacaagaaaaagagaaaaaggatgattttgactgggatagtttaagaattgaagcacaggctaaggctgggaaaagagaaaagacagataacaccatggattctttggactgggatgctgtgagatgtgcagatgtcagtgaaatcgctgagaccatcaaagaaaggggcatgaacaacaggcttgcagatcgtattaagaatttcttaaatcgattggttgaagaacatggaagcattgaccttgaatggcttagagacgttccacctgacaaagcaaaagaatacttgctcagcataagaggattgggactaaaaagtgtggaatgtgtgcggcttttaacactgcaccatcttgccttcccggtagacacaaatgtcggacgtatagcagtacgactgggatgggtccctctacagccactgcctgagtcactgcagttgcatctcctagaattgtacccagtgttggagtcaatacaaaaatatctctggcctcgactatgcaagctagatcaggaaacactatatgagctacattaccagatgattacatttggaaaggtcttctgtacaaaaagcaaaccaaattgtaatgcatgcccaatgagaggagaatgtagacacttcgctagtgcatttgcaagtgcaaggcttgcactgcctggaccagagcagaagagtatagttagcacaactggaaatagtgtgattgaccagaacccatctgaaatcatcagtcagttgcacttgcctccccctgagagcacggcccaagcagatgatattcaactaacagaagtgagcagacagttggaatcaaaatctgaaataaatatttgccaacctatcattgaagagcccacaactccagagccagaatgcttgcaagtatcacaaactgatatagaggatgctttctatgaggatttatgtgaaattccaaccatcaatcttaacatagaagagttcactatgaatttacaaaattacatgcaagaaaaaatggaacttcaagaagctgaaatgtcaaaggcattggttgctttgaatccagaagctgcttccattcctatgcccaagctaaagaatgtgagccgattacgaacagagcattgtgtttatgaactcccagatacgcatcctcttctccaagggtgggacacacgagagcctgatgatccaggcaaatatcttcttgctatatggactccaggtgagacagcaaattctatacagccaccagaaagcaaatgcagctctcaagaagaatgtggccaactctgtaatgagaatgaatgtttctcgtgcaacagtttccgtgaagcaaattctcagatagttagagggacactcctgataccatgtcgaacagctacacgggggagctttccactgaatggcacctatttccaagtcaatgaggtatttgctgaccatgactcaagtctcaacccaattagtgtgcctcgaagttggatctggaacctcaacaggcgaacagtatattttggaacctccgtaacaacaatatttaaaggtttaacaacacaagaaattcaacaatgcttttggagagggtatgtctgtgtgcgggggtttgacagggaagcacgagcaccccgtcctctgatggctagactacatttcccagctagcaagttggccaagacaaaagagaggacaaaaaaggagtcgagttcaacggcaaaatcacggggatcgaaaccaaatccagaacagccggaattgattgccaacagtagcaaccttctacagacgggaagagactga

SEQ ID NO: 47562 - DNA, 399 bp, Glycine max
  Peptide Sequence Number=SeqID_139247
atggagtgcctattgggtgttttggagaccctcgaaggcaatgagaggtgccgatttcatggcacaattcgactcactgctacttcgctagtacatccggagcagcccgcgcgcacacttcaacaacctttggagtggatactacgtacacccactccatatcgactagttgagccggttcaagtgatagaggtgtcatcctctgaagaggatcttgaagaggacccagaggagttagctcttgaacctgctatggacgcccctgatctaccagaggatgatgaggacccactccctgatgttgattctctagaggatattatgtcagcgtctgaggcagactttacagaggagagtggccctggagggacagcgaatagtgacgactcttcatcatag

SEQ ID NO: 47563 - DNA, 117 bp, Glycine max
  Peptide Sequence Number=SeqID_139248
atgggaaccaagcatgcttttacaaaaaggcttcatcaagtacaagttaggtctagccacggcccaaatagaatcgcggaagtatgctcagtgttgcaaaagaggctaaaagggtga

SEQ ID NO: 47564 - DNA, 153 bp, Glycine max
  Peptide Sequence Number=SeqID_139249
ggaattggaaaggacgattggtgccgtcccttgaagaatttgagtcaagaagcaagggtaaaccaccttaagagctattggactaagaagcattccgaattgagtgaatcaccaaagagagaacaaccaccaaaattgaggacatttttgtaa

SEQ ID NO: 47565 - DNA, 498 bp, Glycine max
  Peptide Sequence Number=SeqID_139250
atggtcttaaaggaggagttagctgcttgctcaagatccaagaggagtttggaccaacacttagaagccacggagcaaagcatgctagctataatagggcagtacaaagaagagttaaaccaatctttgacccatgaacaaaaactagtagaggacttcgctgacttcgcacaagcgtacgccgagaaggaagcaagagggagggtgattgatgtattgcatcaagaagcgaccatgtggatggatagggaactcaccataactaaaaaagcgcaaaggcacccctgtaacacccgatccagaagtaagatggataacgaagagggagtgcaagaacagatgaaggccgacctatcagccttaaaagatcaaatggcttctatcacggaggtcatgctaaagcttcaaaaaactatagaagataatgctacggcggccgcttccaatacaactagggaagcggaatcggtgctacagcccgtagtaaacttgggttga

SEQ ID NO: 47566 - DNA, 291 bp, Glycine max
  Peptide Sequence Number=SeqID_139251
acgcgttgggtgctaataccttccccgtgcgtaaaaataactctcgaacctttcacacttaaagttcgtagaccacacatttccggtttttccgacatttttcctcaaataagcgtgggtggcgactccgcgcattttcctttcttggaagatgtacccgtgagccccgcatcgccctcccgccgaagggtaggttgcgacaccgtgtcataccctatttttccggggaccattgtttggtggcatgcaaccccttcgcttgaccgcttcaaggaacttaaccatcgttag

SEQ ID NO: 47567 - DNA, 120 bp, Glycine max
  Peptide Sequence Number=SeqID_139252
cattttgctgactactgcttatgggaagaacaaagcaattaagttcaaaggtgctaatcagaaggggaatgggacaatgaagattggatgccccgggttccagaaatggctagaagaaag

SEQ ID NO: 47568 - DNA, 567 bp, Glycine max
  Peptide Sequence Number=SeqID_139253
atggaaggaaggaaaggagggagtccttttctcatgtggagggaaaccccgttaaggaaagatcaaaaacttaggggcattcgtaatggcatcattggtggttaccatgaatggctgaaagtccatatacgaggtttagattggctcgccaagttaaaagtcgtcagcgaagagagttttgaagcaccggaagaggacgaagaagtccaagctctcaaaagcgagttaggaaaggcgaaacttgccaaggagaagttcaagttggtcgctacacacatccggaaggagtgtgccggattacgggaagagaatgcaactaccgcaagagcccttgaacaagagacaagagggctcgcaaggaaagagtgtggccggaataaatttcgtggagctctgtggggtagcaatagtgaactcaagctgcgaagggaagagagggaccagtcgcgagcacatagcatggttctgaaagaggagttagttgcctgttcaaggtccaaaagaagcttgtctcagcgtttatgcgagacggagaccaacatgctagctatcatcgccaagtactaa

SEQ ID NO: 47569 - DNA, 456 bp, Glycine max
  Peptide Sequence Number=SeqID_139254
atgtatgtcacattacagggtattaggaaacgagcacaatcaattcaaaaacacaatgactgcccccacgactccttagaagagcaggtaacgcagggctcgtttgtaccccatggtcggcaagacattctgaacactgcgattggccgacctgagcatgggggtcgcgttcgggcagcaggcttaggtgtcactattactcagtactacggaagggcatcaaggacatgcagcagctcatccacatccatcagccaacaacaactagatgaagttgttgcaaggcttagggaagacatgactgggcagattagggaagaattgaggactcaaattaaggaagaattgaggactcagctagaagaggaaaataagaggagcttggaaataatgaccaatgcattgaaagaggctattaaaaaagagttcttaaggatggtacaacaaggtttgtag

SEQ ID NO: 47570 - DNA, 300 bp, Glycine max
  Peptide Sequence Number=SeqID_139255
gttacaggttgtaccatctgtggtgaggctcatgaaatagaccaatgtattctcactgaagaaaacactcaagaaattcattatatgggaaatcaacagcgacaagggccaatccaacaaggacctaacatattccagaggactactaagctggaggagaccttgactcagtttatgcaggtaacaatatcaaatcataaaagcactgagtcagcactgaagaaccttgaggtccaggtggaacaactggccaagcagatagctgacaagtcatccaacagttttgtggcaaatacataa

SEQ ID NO: 47571 - DNA, 245 bp, Glycine max
  Peptide Sequence Number=SeqID_139256
atgtcacggaatttcccggattgcctaatgatgggtatcaagtacctcgaagtggtcaagcaaagggtacatctacttggggattgttatactgagaaaaagaaagggtacatctcttgtggatcagttcaagtggaaggtacatccacttggttattcaaagagaacaagggagggtacatcccttgtggatctttggcttataaaggattttacaaggttgaaagaaatctcaagaatcgcag

SEQ ID NO: 47572 - DNA, 220 bp, Glycine max
  Peptide Sequence Number=SeqID_139257
atggccaagagcaagggcaaggatccacttgaaggacttgcaggacctatgacaacggcgagagcagggaatggcaatgaagctcttcaacaagtactgtccatactatttgaatacaaacccaagtttcaaggagaaaagtccaaggttggcccaattggcaacctaggcatcagccttttgggagaccaaatggtggctgacttgatggctgttgggg

SEQ ID NO: 47573 - DNA, 746 bp, Glycine max
  Peptide Sequence Number=SeqID_139258
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggaactggagactaggaaattggcactgaccattaggaacaacatcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 47574 - DNA, 165 bp, Glycine max
  Peptide Sequence Number=SeqID_139259
atggtgggtttatacgtgatttgtggatgtggagaattgtcttgcaccatcgcccgaccgccacctagtaccacatgtgatggagtggtacctggaggtatgtcgcgggggtcaagagaccttggggacgtcaggtggggtgctattgcccaaaaccaagcttga

SEQ ID NO: 47575 - DNA, 642 bp, Glycine max
  Peptide Sequence Number=SeqID_139260
atggccagaacacgaggtttaggtcgtgccataggtagacttaggcgtaggcctactgcctcagcccgtaggctacgcgttcatcagatgactacggagggacgtgatatggctgaggacgttgctgacatgactgacgatgttcctgagctggctgcggaggcacctgagatgcgtgcggacgcacatggtgctgatagtggtgaggggtcagatggtaatgatgctgctgagggattccctagtggtccacgtgacccgtcagtgctcacatcatttgccgagcatgttgcacatgctgtttggagtggacaggaacttcctgatttgaagttagtgtcacatgggaggaagctgacactgattgggaggccagtgcctgagattgaaggtctggtggctgccacaggattaagtccactgatcgatttttcaattattactggcgatcctggactgatatccacatttgtggagaggtggcacggtgatactagcaccttccaccttcctgtaggagagctgacgatcacattggatgatgtgtcgtcaatccttcatttgcccatcattggcgccttgcacagtttccacgctctttcgacggaggaggccagatttttgctgacggagttgctcgag

SEQ ID NO: 47576 - DNA, 350 bp, Glycine max
  Peptide Sequence Number=SeqID_139261
gtatgctagaagtagtgtctaatccttggaggtttacagtagggaactggttatgtgactcagatctggttagtcctactggaattgaacgggttctaaccgaaaaagaccttctggctgactcgtattcagacctagaggcttttatccttgatgaaaaagaatttctcctattgaaggttatctctacctttccggagttatcttgcttaatatgctctatggttggagcgggtcggggaatagacggttttaataggactctagatgcacaagtattcatgaccttgtactggatcctatatattaaggctgctgggattgatccttctttcatgtcaaggccatga

SEQ ID NO: 47577 - DNA, 156 bp, Glycine max
  Peptide Sequence Number=SeqID_139262
atgtcgatctccccctgcggaagtatcagttgggatcgtgcccacaaggcacccagtggacccgaaggagccctacagggccctggggtttccagctttggttacgggcctttgtcatttctacagggtgcccgtcccccccagcaaaaggattag

SEQ ID NO: 47578 - DNA, 198 bp, Glycine max
  Peptide Sequence Number=SeqID_139263
atggagctactccctttaagagttggacttagggaggaggaaagaacaagcgtagctagggacctagatgagctagtccaactttttataagagtggagcaacaacttaaaagaaagtcttcttcaaaatcttatggctttcactcttacaaagaaggaccaagcccaaggaattttaggggctgccaagatctttaa

SEQ ID NO: 47579 - DNA, 558 bp, Glycine max
  Peptide Sequence Number=SeqID_139264
atggcatactccgagttatggccttcattattggagaatcatttggtggtggccatacccgggaaggttctccagccaccctaccccaagtggtatgacccgggtgccaagtgtgtgtaccatagtggagttctcggacacaatattgactcttgcatcccccgaaagttgggaccgactccacacccatatacccccggacggcgcccaagccaatgccatttgcatatcaaagtaataaggccgttccatggaagggcgtccagcgaaagagttgcaaccaaagttgactccctatcagctaaggtaaccaacatcaccggtcttagtggcgtaacccgcagtggtcgggtgttcgcttcccctcacccgacggaattgccctctaaagggaaagcacccatggtcccagagtccatagatatagccaccccctcgaaagaagtagatcctccagtggtaagaggggtcgaaaagaaagaaggtcttcaaggaaaaacagtgactttggaagaggcccatgagttcctccgcctcatccaacaaagcgagtttaag

SEQ ID NO: 47580 - DNA, 234 bp, Glycine max
  Peptide Sequence Number=SeqID_139265
atgggtgagaaggaagagaaaaaagaagaaagtcaagtcctatatgcttctaaagtggaagcaatccagctcgcctgggcgagctgggcggcaaccacctccctcttttctcctataaataggggaaagagggcagagctaaaatgttcggcccttctggtatttaggattctctcgaaattagagaggaaaattgtttccgtagaaaaaatccaagtcgaggtgcttccctaa

SEQ ID NO: 47581 - DNA, 462 bp, Glycine max
  Peptide Sequence Number=SeqID_139266
atgaagcttgcttctacacagacttctgatcttaatctggatagggccaagttagtctacgggccattaatgaagatgaacatgaacttaggttcacttatttctggtcagatttcacttattgctcagtctaacttctcgcggcttggatttccagccctgattactgccttgtgcaaggcccgaggagtcatctcagattctcttacctttgagtcactcagcccagccattaatttggcttatattaagaagaattgctggaacctggatgaaccttcagtcacttttccagggacccaaaaattcagggctagaagatctaaggccccatctacatcagctgcccttgctccccctacattagctccatctactttttctcttccctcaccaccatcagctctagttcttccaggtcccttcgctcaaagcttagagtcttccttgtctatgctatag

SEQ ID NO: 47582 - DNA, 66 bp, Glycine max
  Peptide Sequence Number=SeqID_139267
atgactccattggtgaagaagatccaaggcctacaagctccacatggagctacatcatgtgagtag

SEQ ID NO: 47583 - DNA, 189 bp, Glycine max
  Peptide Sequence Number=SeqID_139268
atgagtcttcattcttcatctagtgttattggtgagggttctactcgtaaggaccccttgtataagatattagatgagttgagatcccttaagttctggaaagaaaaacaagagagaaaagaaaaaggaattaatgaaacattgggcttaatccggattttggttatggacttgaagaggacaaattaa

SEQ ID NO: 47584 - DNA, 443 bp, Glycine max
  Peptide Sequence Number=SeqID_139269
atgactaggggcaatccaggtgatttacaaccctttgatcctgaaatagatagaacctttcatagattagttaggcatagtgtgcatcctggtcattttgtgcattttaagcattttgagcattctgttgagggtgattctgaatattttgattttgagcattccactactaattttcatactgagaacatggctcaacctccaccttgtgagaggactcttagggagatggctgcacctgatttcacttatgaaagcttgtgcattcaatatcctgatgagggtgttccaagtgaagatccttataagcatcttaaggagtttcatattgtttgttccaccatgaagccccctgatgtccaagaagatcatatcttttctaaggcttttcctcattctctagagggagtggcaaaagattggtcatactaccttgctcccag

SEQ ID NO: 47585 - DNA, 467 bp, Glycine max
  Peptide Sequence Number=SeqID_139270
atggggacaaatcaaaacggcaaaagattttatcaaatcaaggttaaaagtctagatgtcactagcctcaaggaattgggacgattgatgggacctctccaaaggcaagccttccgcaaagtgtacggggagattctagatttgaccgcagtggaggtatttacggaagctgtcgtatccctcgcccaatactatgaccagccgttgaggtttttcacgtttggggacttccaaatggtaccgactattgaagagtttgaggaaagattaggatgccctcttggggggagaaaatcgtatcttttctccggctttcttccttccttgagcaagattgcagctgtggttggagattcagcaaaagagttggatcgcatgaagcaaactcggaacgacgtagtgggcctgcctcggaaatacttggaaggcaaggcaaaggatatggcaagccaagagaagtggggccc

SEQ ID NO: 47586 - DNA, 297 bp, Glycine max
  Peptide Sequence Number=SeqID_139271
atgccaaacactttggagggccctcagtttcgcccacaaccacaacccttgcattttgcagtgggaagagcccctcctgctatggctgaaaagggaaagttggatcatatagaggaaaggctcaaggacattgaaggagacgaagattgtgcctttgctaacctagaagagttgttcctggtgtcggactttgacaagtacaaggggactacttgctccaagaaccatctaaagatgtattgtcacaagatgggggcatacgcaaaagatgagaaactgctgatacatttttcctaa

SEQ ID NO: 47587 - DNA, 420 bp, Glycine max
  Peptide Sequence Number=SeqID_139272
atggcatcattggtggggtaccacgaatggctgaaagttcatgtacgaggtttagaatggctcgccaagttaaaagtcttcagcaaagagagttttgatcaagcttatcgataccgtcgacctcgagggggggcccggtaccagcttttgttccctttagtgagggttaatttcgagcttggcgtaatcatgctaactcacattaattgcgttgctctcactgcccgctttccattcgggaaacctgtcgtgccacctgcattaatgaatcggccaacgcacaaggagaggcggtttgcgtattgggcgctagcgaacagtatactggcttactatggtggcactgatgagcgtgtcagtgaagtgcttcatgtggcaggagacaataaggctgcaccggtgcgtcagcagaatatgtga

SEQ ID NO: 47588 - DNA, 418 bp, Glycine max
  Peptide Sequence Number=SeqID_139273
atgttgcgacaacccacactagcggacataaggaaaagcgttgcaggaaggaagagtagaggtcaaggctcacgattgggacaagaagtcgaaggaggcccgccctgccacatcagtagaagctttataagcgcaggtctaggacacgaaggccaagtcgttgcgatatgcgaagatgattttccaagtggatccgacgacgagtccctcaaaggtactaatacctgggacctgaccatcgatttcgagcaagaaacgaatcagacggaggatgaagaggacgaggatgtgggacttcccccggagttagagaagatagtcacccatgaggaccaagagatggggcctcaacaagaagagacagaactagtggacttaggaatcgggagtgggaaaaaagaagtaaagataggcacgg

SEQ ID NO: 47589 - DNA, 370 bp, Glycine max
  Peptide Sequence Number=SeqID_139274
atgaatagagaaaaacatgtctcctataatagtcataactcttgcaagagcctagttgaagaacttcatgactattatgaaagaaggcataggtcacatcttagacctcactcccgtaggagagaaaatgaaagaaagcctcgagaggctaacattaacctcccatacttccatgggaaggacaatgtagaggcttacttagattgggaaataagggtagagcaaaaacttaaaagaaagtctactttaaaatcttatagctctcattcttatccaaagaaagaccaaggtctaggcatcttaagggcagtaccttctaagcccaaagaagataaggggaagataatagaaaagcaaccccctaaggcta

SEQ ID NO: 47590 - DNA, 600 bp, Glycine max
  Peptide Sequence Number=SeqID_139275
atggcgaaaccatcaaagaagcgaaagggttctttgagtcggagtcaacgacattccgagactcaggaaacgccgattccttcctctattccctctgcctcattgttttcatccgaagaacagcggagacagtgcacaaatctcttttcttctcattccattattgatccaaaattcattgatatggatttcttttcaaatgagagttttgaatgcattcaggcatttgaaaactccaatcttattcctttcatgtctttaaaattgcctgtttactctgatttagtcaaagccttctattcaaaccttgaaatccaagaaggcactttaatttctgaagtttatgggattaaaatggtcattgaccaatccctattctatgatttaacccaattatccagtgaaggtgtaccatttgaaggtacactaattgatgattggaaatatgaattctctgtgcatgatgctcgtcggttggtttgcaccagccaagcggatatgaccggaaggcttcttgccggttcattggcttttgagagccgcatccttcattatctcattgttcgtatcttgcttccaagatcttcaaaccatgcacag

SEQ ID NO: 47591 - DNA, 414 bp, Glycine max
  Peptide Sequence Number=SeqID_139276
atggggcaaaacacaccaaatgattatgatgatggatggctcaaattctcacaaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggttacgcgcagcgtgaccgctacacttgccagcgctgatgtccggcggtgcttttgccgttacgcaccaccccgtcagtag

SEQ ID NO: 47592 - DNA, 417 bp, Glycine max
  Peptide Sequence Number=SeqID_139277
atggaaaccatatctaagcgatttgagaaacttgatatttgtggtaaagtaactctaaagaataaacttcgagaaatttcataccctgatcaaaactctatgtgtcctcctccagaaaatatcaacactaaagtgaagtgtagtgcatcatcttctgaccaactcattccaagaaggaccataccgatgttggatcaatttcatccgtttatacatgatttcattgacaacattgtggatgtcaaagctgacggtatgggtgaagattcttggtccttggtgcacaaccatttgcttaaagaacttgacaaatggtcagatgactatatcaagctctttggtggcacagacagatttgaggaattaaggatgtccctacttgttgatgggttatccatggtatgttactatggataa

SEQ ID NO: 47593 - DNA, 294 bp, Glycine max
  Peptide Sequence Number=SeqID_139278
atggtgaaagttggaacctcttacgtgccgatcaacgtctcattttcgccaaaagttggcccagggctttcccggtatcaacctgtccctcctgttcagctactgaagtgtgtatccgtcacaattcgcaacaagcataccgccggaagcatcagcgctggaagtgtaaagccggggtgccacgctgagcgtaaccaccacaccttaattgcgttgcgctcaggctgcccgtcccattcgggaaaccattcggctgcgcaactgattaatgaatcggccaacgcgcggggatga

SEQ ID NO: 47594 - DNA, 351 bp, Glycine max
  Peptide Sequence Number=SeqID_139279
atgccattgcttaggcgcttgtttcaagccataaagagattgactatcgcacctgatagacatgggaggtataggtttgggccacaatggaatctcatagatcagtttttagccaccttatcagcttctttccagtggcataactcaaacccttcaggttgtttcatgtatatctcttcatccaattcccaagaatgcagttttcacatccatttggtgaatccatcagaccttgtggatgcagcaagtgctaacaacagtcttccaatgtggatatccagcaatcagaagctattcatacgaaaaaatcagtatatgcaaacctggataactcaatctggttccctttag

SEQ ID NO: 47595 - DNA, 699 bp, Glycine max
  Peptide Sequence Number=SeqID_139280
atggggtggttggagtaccaaggaaatgtttggaagcaaaagcaagagtcttggcaggcagcgattgtcacttttctcgcctttcatgaccgcaaggaaagcccggttgtcgctatcttagccgatctatatgacaccttcgaccgaagatgtgaaaagaacaaggtgagacatgcttgcacgctagaaggccaccgctcatgcacagagaaaaaagaggcaagttgggaccaactcttagcaaggaaagaaggagtgtctgtcaactggttccctcaatggaaagaaggaagaaccgggtttcttatttcgtgcggaggatttccaaatgttcccttgatggggacaaggggttgcattaattacaatcccatcctcgccataagacaactgggctaccctatgagaggggcaccattagaggaagacctcacacctattattgcacgaggtttcaatagcaccaacgcaaaggcacttcagaaggtctgccaggcatgggagatggtgcaaaagaaggacaaggaacttagaggcagtagcaacgggcccatctgcggctaccataggtggttgaaagcctacacgcaaggtctggattggctcccgaatttgagaaccactaaaggggtggaagttgaagctccggaggaggacgaagaggttcaggccctcagggcagaactcgagaacgcctaa

SEQ ID NO: 47596 - DNA, 198 bp, Glycine max
  Peptide Sequence Number=SeqID_139281
atgtggcggaaatcgaaaagagttgtttttgcgcaatccgtgagtttctgtaacttcttcaaaagaagattcctccagaaggttgctgcttttggaggaagcaacctggctcgcctaggcgagctgagcggcaggcatctcccctattttgctataaataggggaggaagtgaagaagaaaagggtttagccccttag

SEQ ID NO: 47597 - DNA, 238 bp, Glycine max
  Peptide Sequence Number=SeqID_139282
aacttggcgttctcatacgcttctaggcggatctcatctaactcactcagttgcaactttctttgcctcatcagcttccatagagaacaaattgcactcatcatttccaatatgcattgtgcaattcccaggaagcatcgacaagaatcaagccaaggattgtgccaaagacaatcaatggggcaaaacatcaccaaattattatgatgaggatggcccaaattctcatcaaaggtaa

SEQ ID NO: 47598 - DNA, 350 bp, Glycine max
  Peptide Sequence Number=SeqID_139283
atggttctatcagctgtccttcctgttcagctactgacggggtggttatccgcgtcaattcgcacacaagcataccgccggacatcagcgggcaagtgtagcggggcgcgtcccttcgccattcaggctgcgcaactgttaatgaaggcaacgcgcggggatcggtgcgggcctttcgctattacgccactggcgctaaagggcggagtgtcaacggcgattactagttgggtaactgtgccaggatacgactcactatcggcgaattgtgagctccacgctcggtcgtgcggcgagcggaaagtggtcttacacggggcggatgatgtcaatctcaccatggaaacccg

SEQ ID NO: 47599 - DNA, 303 bp, Glycine max
  Peptide Sequence Number=SeqID_139284
atgggggttgcttatggaggaagcaacccagctcgcctggaaaatccaagtcgaggtgctttcgtaacacttccgagacgtttccgtgagcaaatccgtgaaggttttccgtcgttcttcactgttcttcgttcgttcttcgttcttcaacgggtgtacccctcgaatctccccaacaattggtatcagagccaggttcaagttggtgatcgtctcagacgagtatgcaagtaccgcaggtggccagaatggctagcgccacagcatgccccgcaggtggagcggggtggtcagaatggctag

SEQ ID NO: 47600 - DNA, 489 bp, Glycine max
  Peptide Sequence Number=SeqID_139285
atgaccggcagactgcttgtcgggtcattgacatttgattgtcgcatcatgcattatatcattgttagaattttgatgcctcgttcttctaatcttgctcaagcctctgaggaggacttgattctgatgtgggctttcttgaccggtcatccaatcgactgggcccatttggttcgttaccgcatgcataaggcattgcggtctgttaaacgctcctttgctattggtgtcggtgcagtaacctcctttggctaccacgagtgtactccctctccttcgcctcaacgagatgattcctcatccctcatgaatgaagttctttcggaattacgaggccttcgcacctatgctggtgaacgctttgattccttggatggtcgcatagatgccattgatgctttctttgaaggaatggatacccgcatcaatcagcttgaagaggatgtgagttatcttcgtcggcgtttcgaccttccaccaccttcctag

SEQ ID NO: 47601 - DNA, 158 bp, Glycine max
  Peptide Sequence Number=SeqID_139286
atggccagttctggaaatggaaccgagcaggaggcggccccactagaagaggaggtccctcaacacccgccgattttcgtgaaaccatgcctccccgagtgccaagtggggatctggctcgtcataacccatccggaagtttattccggcgattcaat

SEQ ID NO: 47602 - DNA, 150 bp, Glycine max
  Peptide Sequence Number=SeqID_139287
atggagaattggcgaacaacgctaggcacgctaggcaatggattcatggggctccgaaaaaagtggagaatggagacttggcgaacaatgctaggcaggaaattcgcggggctccatactcgttggtgcaaggcacatgaacagcgctag

SEQ ID NO: 47603 - DNA, 237 bp, Glycine max
  Peptide Sequence Number=SeqID_139288
tcctctgaagtttggggatgtaaccctctgaaggcgagggtgtgcaaccctctaaaggtggtcatgttggtgcgcatgatccacacttgtctctttgcagcggcacgggtgaaatcttgccccggtatgcatagtagctgcgtgatagcctccctctctagttgtgcttgcacgttgggcgagattaaacctcttaaggctggaatggagccactgaataaggacagagccctctaa

SEQ ID NO: 47604 - DNA, 92 bp, Glycine max
  Peptide Sequence Number=SeqID_139289
taagcactggctcaaggttcatgataagttgggattttggctcaaggcttgtagaacggctggtcatgatatatgtcagggtttggccagcg

SEQ ID NO: 47605 - DNA, 201 bp, Glycine max
  Peptide Sequence Number=SeqID_139290
atggagaatgggcatacagtgcttcgcaataatttcgcgggcctccagtcgaaattgggggacacaagaacagcgctaggcataaattcttggggctccgaaaaaagtggagaatggagaattggcgaacagcgctacgcaataacttcgtggggctccagactcgaaggtggaggacacatgaatagcgctaggcaataa

SEQ ID NO: 47606 - DNA, 447 bp, Glycine max
  Peptide Sequence Number=SeqID_139291
atggcttcttctgcaactctgtatcctctcaacaatagatggcttctggacgatatagattctttgtataccctaagtatcttcatgatcgctcaaccgggtacatccaccgtagataaacagctcgattccacggcatttgatttctctgaccagatgcacaatcaagtgaatcatgatgtcaaagaaagcggggggaaaatacatctccactggcacagtataattgcggcttcattttccacagactcatcaaacttgactggatcaatgactttgctacatatagcatggaagaaaaagacaggcgagttatcgctaaccggatttgttgcaaaggaatctccgtatagcccgactaacattggcatcagagcacgtgacaatcgtgagactttaaccctacaacttaatctccttcaactgcacaaggctcttaatatttga

SEQ ID NO: 47607 - DNA, 375 bp, Glycine max
  Peptide Sequence Number=SeqID_139292
atgggtgatcaagaggagacacaggaacagatgaaagctgacatgtcgactctgaaagaacagatggcttccatgatggaggccatgttaggaatgaggcagctcatggagaaaaacgtggccaccgctgccgcagtcagttcggctgccgaagcagacccaactctcttggctaccgcgcgccatcctccctcaaacacagtaggacggggaaggaacatgctggggcatgatggcaaccctcatctgggatacaaccgagcggcttgcccttatggattgccgcccaactactcaccacccgtcctgcaagacgatgcgggccattttgcttcccccgtccttgaaggggagcctcctcaacaacccgacgag

SEQ ID NO: 47608 - DNA, 306 bp, Glycine max
  Peptide Sequence Number=SeqID_139293
atgacgaaagatgcggataaccataaggtgcgtccgcgtgctactggaccctcgggtcacgatagcagaattgagactttttcgcggtctcggccggaagacgctgacatctctgggaagggtgcagatgactacattggtctctataaccataaggtgtcaccgcatgctaccggacccttgggtcacgatagcgaaattgagactttttcacggtctcggccgaaagacgctgacatctccgggaagggtaccgatgaccacattggtctctgcgtgtcaacgggctcgcttgcctctagctga

SEQ ID NO: 47609 - DNA, 627 bp, Glycine max
  Peptide Sequence Number=SeqID_139294
atgccgccgaaaaacggcaagctcccttcccgcgccagcatctatgccggagcgctcagcgataactacgtgctggcctacagcaactcgctgatggataacttcatcatggacgtgcagggcagcggctatatcgactttggcgacggttcgccgcttaacttcttcagctacgccgggaaaaacggctggccttaccgtagtatcggtaaagtgcttatcgaccgcggcgaagtgaagcgggaagatatgtcgatgcaggcgatccgtgaatggggcgaaaagcatagcgaagcggaagtccgcgagctgctggagcagaacccatctttcgtcttctttaaaccgcagtcctacgcgccggtgaaaggggcgagcgcggtaccattgattggccgcgcgtcggtcgcctctgaccgttcgattattccgccgggaaccaccttgctggccgaggtgcctctgctggataataacggtaagtttaacggtcagtacgagctacgcctgatggtggcgctggatgtcggcggggcgattaaaggccagcacttcgatatctaccagggcatcggcccggatgcgggtcatcgcgccggttggtataaccactatggccgcgtgtgg

SEQ ID NO: 47610 - DNA, 144 bp, Glycine max
  Peptide Sequence Number=SeqID_139295
atgggactaccagcgacaacatatcatcaaaagaggataactttagatgaggcttcactgttatcaagcgagtcggagacccagcatgaccacagatggacctccacttcctatgtctcacatagacccgggtatagggcctaa

SEQ ID NO: 47611 - DNA, 328 bp, Glycine max
  Peptide Sequence Number=SeqID_139296
aggacttcatgtccttgccaacagagggctgcacgccctcaccttcagaggaccacatgtcctcgccttgagagggctacacgccctcaccttgggggggcatgccctcaccttcataggattgcacgtccttgccatcataggactacattccctcgccttcgaaaggcgacacgtcctgaacttcagagggctacacgccctcgcctttagaggactacgcgtcctcactttcagtgggctccatatccacaccttaagagaatttaaggtcctctgcccttatatgcttaaccgagacttgcactcccggttaaggggccagtag

SEQ ID NO: 47612 - DNA, 171 bp, Glycine max
  Peptide Sequence Number=SeqID_139297
atggggggtggggggggggttggttgtttgggaaaactgccaggaaaccacattacaaacgaaacctcaaagagagttgggcttcgtcctcaaaaggaaacaacaccagaaaatctagccttccatggattcaaacagaaaacgcaaatgaaacatgaagcagaaacgtaa

SEQ ID NO: 47613 - DNA, 279 bp, Glycine max
  Peptide Sequence Number=SeqID_139298
atgtcttcctcaaacgtaaatacaactcccgaacttggaatattctttttgactggtttccttcggtttttccgacgttttccacaaataaaagttggtggcgactccgcgcatctttcctcctttggaaagcgcacccgtgagcctcgccctcgctcgcctgcaaaagggcacgttgcgacagttgacgactccactagggagtgtttttcacccacgggtttgagtaagaaaaaggccctatacccaggttcatgggaatttaaggagtggaggtga

SEQ ID NO: 47614 - DNA, 780 bp, Glycine max
  Peptide Sequence Number=SeqID_139299
atgccatatgtggaagccgcggaggagtcattagaaatgaccttccagtcttttgaggtggttagcattgcctctgtagattccttctttgggcaaccttgcctatctgatgcggcaataatgatggcccgagtgatgttggggaatggttacgagcccggaatgggtttaggcaaggacaacggcggcataaccagcctgataagcgctaaaggaaaccgcgggaagtttgggttaggctataaacccacacaagcggacataaagaaaggcattacaggaaggaagagcagaggtcaaggctcgcaattgggacaagaagtcaaaagaggcccgccctgccacatcagtgggagctttataagcgcgggactaggacacgaaggccaagtcgttgcgatatgtgaagatgattcaccatgtgggtcggagttggtacgaccatgccctcctgatctttcttcatctgttcctacgtctctacccattctcatccatttgcatgtttatttctttacgtttaacgccagatccgacgacgagtccctcgaaggtactaatacctgggacccgaccatcgatttcgagcaagaaacgaatcaaacggaggatgaagagaacaaggatgtgggacttcccccggagttggataagatagtcgcccatgaggaccaagagatgtggcctcataaaaaaagagacagaactagtgaacttaggaaccgacagtgggaaaaaggaagtaaagataggcacgagtatgaccacacccattcgtga

SEQ ID NO: 47615 - DNA, 297 bp, Glycine max
  Peptide Sequence Number=SeqID_139300
atgaaatcccagaattttgatagattagcttctcaatctgtccagaatcccaaaaatgtgagtttcattgcattgaggtcgggaaagcagtgtcaaggacctcaaccagcaacatcttcctcatccgcaaatgaacctgcccaacctcactttactccagaaaaagatgatgacacaaatttaaagagtcccttgcagtcaactgatgtagaaattcatttagctaatagaagtgttgcctatcctgttggcttcatagaagatgtcttagttagagttggtgaacttccctgttga

SEQ ID NO: 47616 - DNA, 285 bp, Glycine max
  Peptide Sequence Number=SeqID_139301
atggctaagtttgacccagagatagtcctggagttctatgctaatgcttggctcatagaggagggagtgcgagacatgcgttcatgggtgaggggtcagtggattccctttgacgcagatgccctcagccagttccttggtgacccactagttttggaggaaggccagcagtgtgagtttgaccagaggaggaacagggccgacgggttcgacaaggaggccattacccaactgttatgcataccggggcaagatttcgcccggaccgatgcaaggaggctgtga

SEQ ID NO: 47617 - DNA, 1014 bp, Glycine max
  Peptide Sequence Number=SeqID_139302
atggcctctaggaaatgcaagagtatcggttcaagacccacaactcaatatgatacaaggagatttcactccttagatgcaaggaatcggtacacggacaatgtattggggagaaacatcttgccagagaggaaggtggagctctaccacaccgagtttgatgattttaagattgagttggagagtcgtaatctccataaacgcctcatcaatttggttgatgggagcacaaatttggctttcgtgaaagagttctatgcaaacctatacaactctaatggtccttcaccaaagcaagctaggggtgagactttacccatacactctagatactgcaggctgccttcaaatcctagggagattgagactgccctatgcataccaggccgagggttcatcttgaacgctgaaggccttcttgggaggatcctgaggaaggacttgatgactttagcccagtctaactcttctagacttgggtttcctactctgattaccaccctatgtagagccagaggggttgtctctgatagcctcacttttgagtgcttgaggccggtcattaacttcgcctacatcaggaagaactgttggaatcctgatgatctgaaaatttctatccgagggcctaggagggcgagggtgaggctagctgagcttccttccacatctgcagctcctactctagcttccacttcagcagctccttcagtcccagtggtggcacctccaggatccattcctttcattgagaagtttctagagagagtagcctggcctggggcccaaccttctcttcatagagaagatgaaggtgagacacaggttagacaggaagctgctgctactcctgagaggtcacgagatgtcacatcagatcctcccatgctagtggacccatcaacaccagtcttgactttgaacacttctcctccagctactccagtacttcatctgacagatgaggagggtgatcaaactcaggatactcaggaccagtcacaggaattctaa

SEQ ID NO: 47618 - DNA, 801 bp, Glycine max
  Peptide Sequence Number=SeqID_139303
atgatgtggatgcataggttcgctttcaccttgaatgggagtcaagatcttccaagactgctagccaaagctaaggcgatggcggacatgtactcgtcccctgaggaggcagtaaacaccaaaactaaacacgctttaaggcacccctatcaaacccgttccaaaactagagtcatgggtgacatagaagaggtgcaagaacaaatgaaggccgatacggaggccttgaaggataatgatggaagccatgttaagcataaagagaatgatggaaagcaatgcagccgcagtttccgccgccagcactaccgcttaggcggatcctacccatccctctgccaaaaaccaagcgaaccaacctgccccaaacatggtgggacaaggaggagaggtgttaggcagtacgatggtccacacatggggtataataggaatgcttacccctatggcttaccccctaattatacgccacccaccatgcacatgcctaacgagaacattaatcatgtcgttcccgttacctttgaggggcagcaaccccagcctctaggaggcgcccatgaagaacctcgggagcgtgctcaaggggacttcgacctatatcccactttcaccggggggctgcctccagcagtggaagggagagagaaacttgatctcatcgaagagagattaagggctatcgaagggtttggtgattaccttttagccgacatgacaaaattgtgtttggtacttggtgttgtcatccctccaaagttcaagggacttggaaccgcaagtggcacccccccatggtag

SEQ ID NO: 47619 - DNA, 618 bp, Glycine max
  Peptide Sequence Number=SeqID_139304
atgaagaatgccgccggcaagttcgtgcagccgagcgatgcgtcgttcgccgctgccgccgccagcgccgactgggccaacgccaaggatttctacctggtcatgaccaatgcgccgggcgctgaatcctggccgatcaccgccaccaacttcatcctggtgcagaagacgccgaagaatgctgccaatggcaaggccacccaggagttcttccgctgggtctacaagaacggcgatgcccaggcccgccaactggactacgtgccgctgccggacagcctggtccgccagatcgaaacctactggacccagaacctgaagctctgtagagccgagcccatgctcggttgggtgctggagcgtgcagaccaacggtccgcagctaccgaggacagggagcagtcgagtatggctcgactctacccagcgcccaggccgtcatatcgatgcgcagatccggggtctcagggctcctgccaagggccggccaaccccgtgaaacccttgtcagaacgtgatccaggacacctctgtcatggtcgtaatacggctgtaacaaaaacatcatttcatagccgcatccgccgacgtcgtcggctctaccccgctatggagtga

SEQ ID NO: 47620 - DNA, 126 bp, Glycine max
  Peptide Sequence Number=SeqID_139305
atgaatgactcgggcatacttatgctatgcatggaaaatgtaattatgagattgagatgcccgaagaaacctcatttcctagttagccatgcattagaggaaagcgcaaggatcatgcatgagtaa

SEQ ID NO: 47621 - DNA, 120 bp, Glycine max
  Peptide Sequence Number=SeqID_139306
atgtcgcaggcacaccgccaccaacttggcaggccgatccagctgggccactgggcatggagcgttatctatagcatttggttcgccagcaggaggccaaccactgtgggcagtaattaa

SEQ ID NO: 47622 - DNA, 783 bp, Glycine max
  Peptide Sequence Number=SeqID_139307
atgaggtcctgggtgaggggtcagtggatcctgtttgatgcagatgctatcagccagttcctgggataccctttagtgctggaagagggtcaggagtgcgagtatggccagaggaggaaccggtccaatgggttcgatgaggaggccatcgcccatttgctatgtataccggggcaggattttgcccggactgctgccgggagacgggtgcggatcatgcgcaccaacatgaccaccctgactcagatctggatgactttgctgctcagcaacatccagcccagcgaccataattccgaactccccctgccgaagtgtcagctggtgtatgccatcctgacacggatgagcattcacgtggctcagttaatcgctgatgccatctatctatttgcaggtatggcgcctaccaggcaccctctggacccgaataagtccaacagggccctgggatttctcgccttgatcacaagactctgccagttgttcggagtccccgtcgcacctagcaaggcggccaaccaccgggcacatgtacagacccatgattgtctttaccagttgagcctcagcctgcatagccagagttttacttcttttccgtgccctactccggaccagttcagggcagaggtcgcatggcccgaagattggcctgaggcccgggcaagagaggcaccagcagaggcaccagcagaggctcccgatgaggcagatgaggcccgcgaggacttagagatggccgatttacttgatttcttaggagggagcggagccacatga

SEQ ID NO: 47623 - DNA, 281 bp, Glycine max
  Peptide Sequence Number=SeqID_139308
atgaacgtggggcaaacagcagttatcaaagctggggttgtcgttgcagggccgcgtgggcgccagtactgcgcggtctacccgggagcggatttcccgctggcagatgcgctcggcggtgcgcagggtgatctcatcacactccaggcccagggcactgtcgatgctgcgcttcaggcggctgagcggctgacgccgccggtggcgacggcacggcgattcggcacagaccgggacgtccgtggcccctctgcaatcacccgcaactggcttgcccggcc

SEQ ID NO: 47624 - DNA, 189 bp, Glycine max
  Peptide Sequence Number=SeqID_139309
atgtcggatacaccatgtccaggacatcctgctgaaaatctaggaattgctaaaacccgcattgaagctcaaattttgcatggatccacgatgtcggatacaatgtccaggacagtccatgcccaaaagatccacgatgtcggatacatgacgacatctggtccagcagaagtaatactggacatatga

SEQ ID NO: 47625 - DNA, 436 bp, Glycine max
  Peptide Sequence Number=SeqID_139310
gcatctcactgaaacatgtatgcgagtagggaattctgatatctatggattcctcgagccacagtccattcagagtggacactggcagatggtggtcatcctgcccaaagaacacctagttgtctggttttgttcattgcataacaggtcagacaactaccttaaggggattattaatagtgctatcaagggtcttgatgatgctccacagcctaaatcaaaggcttctgttaggtggattatcatcaagtgtaatagacaaaaaggaagtactgagtgtggctactatgtgatgcactggatgtccaccatcattttaggaacttttagaaataattgggaagcgtattttaacgatcctagaccattggagccagagagattaaaagcattgcgaatccagtgggcacagttttttctccgagttagagattag

SEQ ID NO: 47626 - DNA, 429 bp, Glycine max
  Peptide Sequence Number=SeqID_139311
gcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgcctgcggccctctcttccctgttaatggtatcttctggacaattcgccctatatgagtcgtattcacatattcactggccgtcgctttttttctacaacgcattcactggacaccctggcgttatcagccaacatagtaatcgccgttgcagcacatccccctttgcgccagctggcgtaatagcgaagaggcccgcaccgatccccttgcccattaatgcagttgcgcagcctgaatggcgaatgggaagcggcgctgtagcggcagcattaacggcggtgtga

SEQ ID NO: 47627 - DNA, 764 bp, Glycine max
  Peptide Sequence Number=SeqID_139312
acatcacagcgccggaagtcttgcaggtcattaaacgtccacaaaaccaaagcaagctagaaacagcccacagagcattacaggcagtagggcaggtgatgcgctatgcagtacaaaacggtaaggcagaaagagacgtgacagcagatttacgaggcgctttgcctagccccgaagttaaacacatggcctcatttatcgagccgcaacaagtagcagaactgttacgcgcgatagacggctttcaaggcacgtttaccgttgagtgtgcgttacgccttgcgcctttggtatttacgcgccccagcgagttacgccgtgcaaaatgggcagatattgatttagaggcgggtgtgtgggggtatcgtgtgaccaaaacaaaaatagatcatatcgtaccactatcaaatcaagctgtgcagatacttaaacagctacatcctgtaagcggtcatggggaatttgtatttatgggcggccacgaccctaaaaagccaatgagtgaggccgcaatcaacgccgcattaaaacgtatgggctacgacacgaaaacacagattacagggcatggctttagagcaatggcgcgtacattgttgcatgaacgcctaaacattgaccccgtgatcatcgagcatcaattagcccacaaagtgccggacgctttggggcaggcatataaccgcaccaagtttttagaacagcgcaaagcaatgatgcaggcatgggctgattatctggacgaactcaaggcaggtgcaaag

SEQ ID NO: 47628 - DNA, 255 bp, Glycine max
  Peptide Sequence Number=SeqID_139313
atggctaccattgcgttatcaagtagatatgggagcaagttagcatatgacaccggaatttggggtgaatcctacaggcttttcgctgcaaaattcatttcttggttgacaggctttgtggttgatttagggatggcctttgtggataactgggtggtgggtaaggaggaatgtcagtcacagcatgggtttctccctctttctcaccctcttcatttgccccagttttctcattcgtccaagcaggatgactaa

SEQ ID NO: 47629 - DNA, 303 bp, Glycine max
  Peptide Sequence Number=SeqID_139314
atggctggaaagaaaaaggaacccattaatattttgcagtatgcaaatgacacagtatttgtgggagaggctgcttgggagaatgttgctgttttgaaggctatgctcaggggatttgaattggcctcaggtctgaagattaattatgcaaaaagccagtttgggattataggaggtagagtcaattggcttctgaccagcagcagttatgggctaggatcattaaatctaaatatggtggttgggaagagtttcagtcgggcagagataaaaggggatgctcacactggtggagggacttga

SEQ ID NO: 47630 - DNA, 318 bp, Glycine max
  Peptide Sequence Number=SeqID_139315
atgagaggccctctcaaagagtcgacctcttcctttcttgtaaagtcctttggactacacgtcctcgccttgagaggactacacgacctcaccatcagagggctgcacgccctcacctccagaggactacatgtcctcgccttgagagggctacacgccctcaccttgggtactagttaccctcaccatcagaggactacatgtcctcgccttgagaggactacacgtcctcaccatcagagggctgcacgccctcacctccagaggactacatgttctcgccttgagagggctacacgccctcaccttgggtactag

SEQ ID NO: 47631 - DNA, 715 bp, Glycine max
  Peptide Sequence Number=SeqID_139316
cctcaccgtcagaggactacaggtccttgccttaagagggctacacgctctcgccttcagagggctacatgccctcgccatcagaagactgcacgttctcgccttcgtaaggctacacgccctcaccattaaagggccacacgccctcgccatcgttgggctacatgccctcacctttagaggactacacgtgctcgcattcataaggctaaatgccctcgccttcagaggactacacgtcctccccttcagagaactacgggtcctcaccttcaaaggactacacgtcctcggcttcagaggactacacgtcctcggcttcagagtgctacacgccttcacctttagaggactacacgtcctcgcctttagaggactgcacgtcttcgccttcagatggctgcatgccctcactttcagagggatacacaccctcaccttcagaggactgcacgtcctcatagggctacacgccctcacctttagaggactacacgtcctccccttcaaagggctacatgccctgacctttaaaggactgcaaatcgccgtcttcagagggcgacacgtcctcaacttcaaaggaaggcacgtcctcaccttcagagggctatgcaccttcaccttcagaggactgcaagtcgtcactttcagaggactgcacgtcctcgtcttcagagggctactcgtcctcaccttcaaggggatcctctag

SEQ ID NO: 47632 - DNA, 126 bp, Glycine max
  Peptide Sequence Number=SeqID_139317
atggagataaaagaagctcaagaagtggtacatgaaatgaaaatatgtgaaggaattcttgtgttgaagcaaatgcaattagaaaattcagaattattttggaagttggacttattttgtgactag

SEQ ID NO: 47633 - DNA, 759 bp, Glycine max
  Peptide Sequence Number=SeqID_139318
cttcctgttgggacgcccatggatccattcagtgggagtcgctccctctacactccatcagaaatagaagttcgtagtggaagggcatttggtcatcgtatcgggcgaggaagacatcttggtgagttgcccatcctctatgccatatgtggaggccgcagagaagtcgttagaaaccgctttctagtatttcgaggtggtaagaatttcctccgtggactctttctttgggcaaccttgcctgtcagatacgacagtaatggtggaccgggcaaggacaacggcggcataactagcctgataagcgccaaaggaaatcgtgggaagtttgggttaggctacaaacccacacaggcagatataaggaaaagcatcgcgggaaggaaaagaggaggtcaaggctcgcgattaagacaagaagatgaaggaagcccaccctgccacataagtaggagctttataagcacgggtctaggggacgaaggccaagtcgttgcaatatgcgaagatgatgctccgagtggttcggatttggtacgattatgccctcctgatttccaactaggaaattggcgagtggaggagcgcccaggcatttatgcgacaagcataatatccgaggacgagtcccttgaaggtactaatacctgggacccgcccatcgacttcgagcaagaaacgaatcaaacaaaagatgaagagaacgaggatgtgggactttcctcggagttggaaaggatagtcgcccaggaagactaa

SEQ ID NO: 47634 - DNA, 312 bp, Glycine max
  Peptide Sequence Number=SeqID_139319
atgcccttgtggggtaggattgcatcagtctacaccacagaatttgatgaattcttagatgagctggatagaagacactggagggaggagttgactgactttcaggacggcaacatcgatgttgccattgtaaaagaattctatgcaaacctctatgaccccaaggacaaatcacctaagcaggtgagggtgagaggtcatctgattaagtttgatgaggatactcttaacacatttttgaagatcgttgttgttgtggaagagggggaaacactttgtgcttactctagattcacactccctgaggcttga

SEQ ID NO: 47635 - DNA, 465 bp, Glycine max
  Peptide Sequence Number=SeqID_139320
atggcgctaagtgagccttcgaggatagaaatccctttaaagctgaagttggcgaaaaaagaaggaggttttggaaagcttttagtctcagagagcaattgtgcattacgtgaaagacccaacaggggtcaagcaacgcaacagtcagaggaggaccagcaacagctagctacagatgcaccaccgccgcctctacaggaggtaccatctctggagtccatctccgatcacctgcagagacggctaatcatagaggccaggtgtagcttaacgagaccttctaccggtacaacatgcaccaatagagccaggaccctagtcctttcccttggcctacccccgagcaattcggggccacagtggcctggcctggggattaggttgattttgagaaaaggtcaggacccacaggagcccctggagatgacagagatgctcaggaggatgacgacatggccgacatga

SEQ ID NO: 47636 - DNA, 309 bp, Glycine max
  Peptide Sequence Number=SeqID_139321
atggcttacactcacattccggattcaacaagcgattctcctcaaatttcagccagcccgtatcaattaggccttgcaccttatgcttcagagccctacaatgctcaatggaacgccccggggcttctccgtgacaagcacacgttgcgttcgagtcgtattctcggagaaacggaggttgatgaaccttggctagggttatggctaccattgaattatcaagtagatatgggatcaagtttagcatatgacaacggaatttgggtggtcttcgtcattggaagtgcggtagacagactttgtggttga

SEQ ID NO: 47637 - DNA, 413 bp, Glycine max
  Peptide Sequence Number=SeqID_139322
ttaaaaagctcgtagttggaccttgggttgggtcgatcggtccgcctccggtgtgcaccggtcggctcgtcccttctgccggcgatgcgctcctgtccttaactggccgggtcgtgcctccgcatgggataacaccacaggattctgatcctattgtgttggccttcgggatcggagtaatgattaacagggacagtcgggggcattcgtatttcatagtcagaggtccagacatagtaatgattgacagactgagagctctttctgattctatgggtggtgtgcatggccgtctagttggtggagcgatttgtctggttaattccgttaacgaacgagacctcagcctgctaaatagctatgtggaagtaaccctccacggccagcttcttagagggactatggccgcttag

SEQ ID NO: 47638 - DNA, 657 bp, Glycine max
  Peptide Sequence Number=SeqID_139323
atggggacaaatcaaaacggcaaaaggttttatcaagtcaaggttaaaagtctagacgtcaccagcctcaaggaattgggacgattaatgggacctctccaaaggcaagccttccgcaaagtgtacgggaagattctagatttgaccgcagcggaggtatttatggaagctgtcgtatccctcgcccaatactatgaccagccgttgaggtgcttcacgtttggggacttccaaatggtaccgactattgaagagtttgaggagatattaggatgccctcttgggggaagaaaaccgtatcttttctccgggtttcttccttccttgagtaggattgcagctgtggtcagagattcgtcaaaagagttggaccgcatgaagcaaactcgaaacggcgtagtgggcctaccgtggaaatacttggaaggcaaggcaagggatatgacaagccaagagaagtggggcccgtttacggatatactagctctgttgatctttggggttgtcctctttccgaatgtggacggtttggtggacttggccgcaatcgatgctttccttgcatatcaccatagcaaggagagtccagtggtggctatcttggcggacttatttgatacctttgaccgaaggtgcgagaaaaacagcgcgcggaat

SEQ ID NO: 47639 - DNA, 747 bp, Glycine max
  Peptide Sequence Number=SeqID_139324
atggcagtggaagtggataatcaaggtaacaacattctacactttgctgcgcatcttccagttgaattccaagaattgtccagtttaagagcaagcattcaaatgcaaagagagctccaatggttccagttcgtggattggtatgttcctcgtgaactaagaagaatgagaaacaacatgggcaagagaccaattgatgtattttatgaagaacacaagacgttatccgaagaaattaaagatgcaggcaaaggaatagccgaatctggcatgctcgtggcagcacttgttgctaccgtagcatttgcggctgctctgagtaatgttccaggtgataagaccaatgcttggtttgttgtcttcatattggcaaatgcagtcgcattattcacttcttctgcgtctatactttcattcttgtcaaatttcacttcatcaagattcgcacaaagtgaatttgtgatatcacaacatcccagcttgacttttgggcgtgccttacttttcatctccgtttttgctatggttgtggctttcactgcagcatcctttttgatattagatcacaaatccaagtgggttgcttatttagtagcttcaatgaccgttttcccaatctttgtgtttcttctctttcaaattagctctttggacgaccacttgtggtctagatattatcgttttcccgaacttgactattcaattgccgcagttcaggttcatcagtcgcttggtagatcgatatag

SEQ ID NO: 47640 - DNA, 296 bp, Glycine max
  Peptide Sequence Number=SeqID_139325
ccagtagaccaggagaagtccaaccagggccctggggtctccagctttggttacgggcatctgtcagtcctacagggtgcccgttccccccaacaaggtcacaccatcatgacatagggatcgcacccgcaagacacccagtggacccagagaagtccaacagggtcctggggtttccagctctgattacgagcctctgtcagttttacagagtgcctgtcacccccaacaaggtcattaggccccgcattaactgggctttcatcaagaagtactgtgcccccaggcaggcatag

SEQ ID NO: 47641 - DNA, 978 bp, Glycine max
  Peptide Sequence Number=SeqID_139326
atggcgaatcaagaggagtgggtcccgtttatggatgtattagcattgctaatctttggggttgtcctctttccaaacatggatagtttggtggacctagccgcaattgatgctttccttgcatatcaccatagcaaagagagcccggtgagtagtgcacggatcatttgttgtttacccgctctttgtgtatggttggtttcgcatttattccaacaagacataaggcatccatgtccgctccgaagccatcgctcgtgtgtcgaaaaaagaagagtagattgggaccaacacttggcggggataggaggcagagcagtcaactggtttccacgatggaaagaaggaaaggagggagttctcttctcatgtggggggtacccaaacatcccgttgataggaacgaggggttgcattaacgacaatcctgcacttactataagacagttagggtaccccatgaggggagcaccgacggaagaaagcatgtctcctttccttgtgagagattttggcacgcaaaatttcaatgttatacaaagagtccataaggcgtgggaaagaccgttaaggaaagataaagaacttaggggcattcgtaatggcatcattggtggttattatgaatggctgaaagttcgtacacgaggtttagattggctcgccgagttaaagattatcaacaaagagaacttcgaagctccgaaagaggatgaagaagtccgagctctgaaaactgaactaggaaaagcgagacttgccaaagaaaaattcaagttggccgctacatacgtccggaaagagtgtgccgggttacgagaagaaagtgcagctaccgcaaaagcccttgaaaaagaaaccaagagggctcgcagggaagagcatggtcgcgacaaattccgtggagcattatggggcagcaatagtgagctcaagcttcgaagggaagagagagaccgatcacgagcacataacatg

SEQ ID NO: 47642 - DNA, 354 bp, Glycine max
  Peptide Sequence Number=SeqID_139327
gcagttcttaagatcagcaactcggcggatagagagcttgagcccaatgcaatggacttcttattgatgaatatcgcgacctcttttttgctagagactgggagagatattttcgacattgctaggctagagagaggggaatttctgcgtagatggacttgccaagctagggcttcatatcaactcggtacagtcttcagagatccgccagagttcattacttctttactctttcagatctactcaggaaaggaaggaggacaagcgaagtactctcagaggcctctattgcttatagggactcagttccaggactctttggccgatgaatcgatgtaccgatcttctccttag

SEQ ID NO: 47643 - DNA, 453 bp, Glycine max
  Peptide Sequence Number=SeqID_139328
atgtcctctaattgtgattttccaccatggagatgcagcagaagacaaaggagaagagcccatgggctcgaaatctaccctaaggctcatgagaaccctagggccttcccttggatctctggcccaatctacttggagtcttttatccaatgcccttgcggggtaggattgcatcaggatgcacatgccaaagttgagtatgtgaaaagattgtatgaccaagcgaaggtgcaaattgcaaagaagaatgaaagctatgccaagcaagccaacaagaaaaggaaggaagtggtacttgaacccggtgatgatcctggacatttgagggcaaatgttttccaagaaggagggaatgatgagaatcctgaaaatggccaaatacagactaaaggcccaagtggagaagggcgaaggcccaagtggagaaggacaaagcccccgagtggagaatga

SEQ ID NO: 47644 - DNA, 291 bp, Glycine max
  Peptide Sequence Number=SeqID_139329
gaggagatttatgtagagcaacatgaggggtttcaaatcaaaggagaggagcaagaagtttacaagttgaaaaagatgatgacaaaagtgatgaacaaaaagctcaagagaatcaaagaacatccatctcaagaaaatctagaacaagtcaaagagttcaagaatcaagaagaattcaagactcaagatgaaagcctacaaacaagaatcaagattcaatacttaagagattcaagatctcaagattcaagatcaagattcaagaatgaagaaaagactcaatcaagataa

SEQ ID NO: 47645 - DNA, 213 bp, Glycine max
  Peptide Sequence Number=SeqID_139330
atggtaaaagttatgaaagagaagaggtactctagtcaaataacctatctattagtgcctttgaggaaggagtggtacatagatgctttgcgatgttcaaaagacattatgacttggagagcatcaaagtttacacatatctctccccagaaaagcgggcatgtaacatatggtgacaacaacaaaggtagaatccttggagttggaaaatag

SEQ ID NO: 47646 - DNA, 256 bp, Glycine max
  Peptide Sequence Number=SeqID_139331
tcaaacccaagtagatgtaccctctacttgtaccacaaaggatgtaccctccaatgtgttaagacaaagatctcaggctgttaaacctttgatactttgtgaatggggatacaaaagaattctcaggcgggagaagagaatgaaaaggatgaatagcacaagttttcaaggtttggaaaaccagaaaacttcagaaagcttttggtacaaagaagaaggagaagttcaaagagatttaaggcttgcaaaggattga

SEQ ID NO: 47647 - DNA, 343 bp, Glycine max
  Peptide Sequence Number=SeqID_139332
atggtttataataatggcataaacttgaaaatcctgatgagtcataacaacagcttccagaattgccccatgtatggtgttgcttgtcaatgttatgattcaacaagcgattctcctcaaatttcagccagcccgtatcaattagacttcacactttatgcttcggggtcatacaatgctcaatggaatgccccagggctcctccatgataagcacacgttgcgttcgagtcgtatcctcagaaaaatggaggttgaggaaccttggttggggctttttgctgcaaaattcctttttgttggtgtttttttggtttgtgctaaaggtggtcttcgtcatggaa

SEQ ID NO: 47648 - DNA, 330 bp, Glycine max
  Peptide Sequence Number=SeqID_139333
atggtggtcatcctgcccaaggaacacttagttgtctggttttgttcattgcataacaggccagacaactaccttaaggggattattaatagtgctatcaagggtcttgatgatgctccacagcctaaatcaaaggctcctgctagacaaaaaggaactactaagtgcggctactatgtcatgcactggatgtccaccatcattttaggaacttttagaaataattgggaagcgtattttaatgaccctagaccattggagcctgagagattaaaaccattgcggatccagtgggcacagttttatctccgagttagagatcaggcctag

SEQ ID NO: 47649 - DNA, 429 bp, Glycine max
  Peptide Sequence Number=SeqID_139334
atggtgaaagttggaacctcttacgtgccgatcaacgtctcattttcgccaaaagttggcccagggcttcccggtatcaacaggggacacctcgccctgttttacacttcgtgcgaagctgacccactctccatggctatctggtttctatcagctgtccctcctgttcagctactgaaattggttatcgcgtcaaattcggcacacaagcaccagccggacatcagcgctgcaagtgtaagccggggtccggctgacgcggcgatcggtgccagggcctcttcgctattaatgaatcgccagctggcgaaggggaggcgcagtttgcgtaattgggagaaaaagctccaccgcggtggcggccgctctagaatagtggatcccccggggacaggaatatcgtcccttgtgcttcccgggtggcactga

SEQ ID NO: 47650 - DNA, 348 bp, Glycine max
  Peptide Sequence Number=SeqID_139335
atgaaagataagagggataaggaagaaagactagaaaaacaaaagaataagaaggatagtaaggccttgtcatcaaaggccaaggggaaggaaaaagaggaaaaggattctgccaagaagattgttaagaaggaaaatcattttgcaacaaaaggtgtcgagggaagaagcccaaaatttcaagaacctctagatttgaggtcaaatccttttcaagggggaagggatgatgcaatcctaccccccaagggtattgatagaagactccaagaagattgggtcaaagatgtaggaaaaggccctagggttctcatgagccatagggtagattttgggcctataggctaa

SEQ ID NO: 47651 - DNA, 288 bp, Glycine max
  Peptide Sequence Number=SeqID_139336
atgttcagtctcctggcgctcaatggtctcagtttgcccttggttgacgaaagtggtgcgggtaaccataagggtaaccccgcatgtcacttgacttcacgggtcaggacgacaaaaggtgcagaagacgatgttagtctccgcagcgtcaaccggcaatcgtttgcccctggttgcagaaaggtgcgggtaaccataaaggacgacaaaaggtgtcagcaagacgatgtcagtctcctgtgcgcctcaatggtcttgtttgcccactggttgaccagtatggtgcag

SEQ ID NO: 47652 - DNA, 417 bp, Glycine max
  Peptide Sequence Number=SeqID_139337
atggattcattcggtgggagtcgtcccctcaatgctccaccgaaaactaaaattcggggtggaggggcacttagtcattgtttcgagggaggaagatgttctggtaagctgcctctcttctatgccatatgtggaggccacagaagagtccttggaaatgactttccagtccttcgaggtggttatatatacgtcctcaatgtgaaaaacacgatttttcactctactcttctccaaaacgccacccaaaccctaaaacctcatttttcatcacctaagaccattggtggccgtcgtgagttgccattgcttgccgttgaacccccacaccaagaggaacactttaatcgaagcagaatccttctcaaggattcggtggagaaaattccccaatcctccatttcaaagcttctctga

SEQ ID NO: 47653 - DNA, 1185 bp, Glycine max
  Peptide Sequence Number=SeqID_139338
atggtccatgacatcttggtccatgagcaatacccgttgggaggaaggaagccatatcttttcttggggttctatccctccgtggctagagttgccaaggcaaaggccttggaaaatcaaggtgaatgggcttcttttattgacatcttaacgcttttgatcttcagagttgtcctttttccaaatctggaaggattagtggacctagcagcgattgacgctttcctcgcctttcatcatggcaaggaaagcccggttatcgccattttggccgacatgtatgacacgcttgtgtgtccgctacaaggtcactgctcgtgcgccgagaaaggaaaggcgaattgggaccaactcttggctagcatggagggggcgatttccaatgttcccttgatgggaacaaggggttgtagtaattataatcccgtcctcgccatcggacaacttagctaccccatgagaggagcgccgtcggaggaaagcatcgcgcctttcatcgcacggggtttcagtgaccccaacacaagggtacttcaaggagtttgcaaggcatgggatgcggtgcaaaggaaggacaaagagcttaggggaagtagtaatgggatcatcggcgactatcgtaagtggctgagagtctacacacgaggcttagattggctcccaaagctaagggctacgagagaggaagaggccgaagctccggaagagagtgaagaggtacaagccctaaaggtggagcttgaaagagcctgggcagtcaaagagaagttcaagtcaacggccatcaaagttcgaagagagtacgatgaactaagggacatcaatatgaccaccatcgaagccttggaacgagaaaccaagagggtccgaaaggaagaacacgaccgaaacaagtttcaaggggctttatggggcagcaacagcatgatcttgaaggacgagttaaaggcttgccttaggtcgaaaagaaatttgtcccaacagttaagcgagactgaagggaatatgtgggccatcatcgatgagtataaagagaagctaaacctagcagcgactcatgagcaaagactagaggatgagtacaccaagatatcagtaaaaaggaaagcaagggaaagggccaaagcaatggtggacgtgtactcggcccctgaagaaattcacgggctcctcaactattgctag

SEQ ID NO: 47654 - DNA, 1407 bp, Glycine max
  Peptide Sequence Number=SeqID_139339
atggatacctcagagccctacactacggcaatgaaagacaccatgcataaacctcaagagaacctaggggtagatcagaaattctcacccaataggttccctactacaagccctcttgatgagtcaatctcttgctttctcataagggtggacccttgggtactagtacccatcgccttaagagggctgcacgtcctcgccttaagagggttgcacgtcctcaccttcagaggactacacgtcctcgactttagagggctacacgtcctcgccttaaaagggttggacgttcttgccttaagaaggctgcacgtcctcgccttaagagggctgcacatcctcgccttcagaggactacacgtcctcgactttagagggctacacgtcatcaccttaagagggctgcacgccctcgcctttagaggattgcacgtcctcggcttcagaggactacacgtcctcgcctttagagggctacacgccctcactgtaagcgggctgcatatcctcgcctttagagggttgcatgtcctcaccgtaaaagggctacacacccccgccttcagaggactgcacgtcctcgccttcagaaggcttcacgtgctcgcctttagagggctagtcgcccttgtcgtcctcgacttcatagggctacacatcctcgcctttagagggctacacgtccttgccttaagagggctacacgtcctcgccttcagaggattgtacgtcctcacctttagagggctacacgtcttcgccttcagagaactcaagttcctgggccacccccttgatcttggaggagggccaactatgcgagcacagccagagaaggaggctatcgcccagctactatgcataccaggggtcatctactgtttgcagggatcctgcccccaagacacccagtggacccggagaagtccaatagggctctggggtttccagctctcattacgggactttatcagttctacggagtgcccgtctcccccagcaaggtcatcaggccccctattaacagggccttcatcaagaagtattgtgcccccaggcaggcacagggcgaggcaccacagtagcctgaggacggccagcagcgggcgacagacacaccgccaccaccttcaaagtccacctcagctcatccacaaaggttggagcgttgtctgcgacacatggccgaccagcaagtggccaaccaccggggcaggaggtaacctagaattggctacgaagaagctccccgcgaagcaatccaggaaaccattgaagagggttctagtgtggccccacaagccgacacaggctttgacaaacatcaattccaaagcgtggaacatcagtagcgtttcgaggccatcaagggatggtcattcctcatatagagacaagggcaactga

SEQ ID NO: 47655 - DNA, 126 bp, Glycine max
  Peptide Sequence Number=SeqID_139340
ccttccccttgcatatgcaaagaggctctttccggattcgaacccatgaccaacaagtcaccaaggcacaactttaccgctgcaccagggctcgccctcaccgatactgatcgaaaaaaatgctag

SEQ ID NO: 47656 - DNA, 252 bp, Glycine max
  Peptide Sequence Number=SeqID_139341
atggctccgaggaagcattcctcaaagagatctaggaaggacgccgtggccgaagggactagtgccgctcccgagtttgatagccatcgttttaggagcgctgagcaccagcagcatttcgaagccatcaagggatggtccttccaccgagagagacgcgtccagctcagggacgacgagtacacagattttcagaaggagatagcctcgtcggcgttggatgttgctggtcatgcccatggtcaagtttga

SEQ ID NO: 47657 - DNA, 75 bp, Glycine max
  Peptide Sequence Number=SeqID_139342
atggaggactcccatattccctctcacaaagcagatgggtattgtgatgctgattgggctggaagtgcagattga

SEQ ID NO: 47658 - DNA, 489 bp, Glycine max
  Peptide Sequence Number=SeqID_139343
atgaccatgattacgccaagctcgaaattaaccctcactaaagggaacaaaagctgttgggacgggagtagatgcaacggttgggactggagtctcgggaacagctggagtggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 47659 - DNA, 207 bp, Glycine max
  Peptide Sequence Number=SeqID_139344
atgccttccaagattattttgatgatgccaaagaatcaagagtcatacaagtttcaagaatcaagatcaagattcaagattcaagattcaagaataatcaagatcaagattcaagattcaaataaagaatcaaaactcaagattcaagaatcaagagaagacttaatcaagataagtattaaaagaatttttcaaaacattgaatag

SEQ ID NO: 47660 - DNA, 291 bp, Glycine max
  Peptide Sequence Number=SeqID_139345
atggctccgaaaaagctttccacgaagaggtctaggagagacgccgcggcggaagggtctagtgccacccccgagtttgatagccaccgtttccggagcgccgagcaccagcagtgcttccaggccatcaaaggatggttgttccacagagagaggcgcatccagctcagggaggatgagtatacagattttcaggaggagatagctcgcaggcgttggacgtcgctggtgactcccatggctaagtttgaccctgagaggagggagtgcgagacatgcgttcatgggtga

SEQ ID NO: 47661 - DNA, 447 bp, Glycine max
  Peptide Sequence Number=SeqID_139346
gactcctgccagtcgttcggagtccccgttgcacctaccaaggtgattcggccgcccatcacccgggcttttattgagaagtactgcacccagagacaggctcagggcgcgccaccaccacctcatcaggctggcccagctgggtcgtttgacatggagcagtatttacagcatgtggtttgccaggaggcggccaaccacagggcccatgtgcggaccaatgagaccctttaccagctgagcctcagcatgcagagccaaggcttcgcttctttttcatgccctactccagaccagttcagggcagaggtcgcatggcccggggattggcccgaggcccaggcgggagaggcacccccagaggctcccgacgatggagaggaggcccacgaggacgaggagatggccgatttgcttgacttcttgggagggagtggagctacatga

SEQ ID NO: 47662 - DNA, 312 bp, Glycine max
  misc_feature (230)..(230): n is a, c, g, or t
  Peptide Sequence Number=SeqID_139347
atggcgacgcgggtaatgctcaagcacggttatgagcccggaatgggtttgggcaaggacaaccacggggatgccgatgtggttgacattaggggtaacccgtacaaatatgggttggggtatgaacccgagaaacctggaagaaggaatgcaccatcaagactccgggcagatagggcatggcccggaagaggtggcggaaataggagaggaggctccacaagatccgncaagtttcgtgcgaccgtgccatcccaatttccaagtggggaattggcacatgacgagccagtcggaagtctataccactga

SEQ ID NO: 47663 - DNA, 495 bp, Glycine max
  Peptide Sequence Number=SeqID_139348
atgcttactgcaaaatgtgttgtggacctggggaatgagaacttggagatgagtgtggaggaccagaaagtcattttgaacttgtttgaggcaataaagcatcccaatgataacaagacatgctttaaggtggaggaaattgagcaagaagctgaccttgttgggcggcacctgaagtctatgtttctagaagaagatgaagtcaagccaattttgaatccaacaacaccttccattgtcctcccggggccaaggcgagtcaaggcccgaactactccagacgctccacctgcttcacctccggtaatccctcctccaaccacctcttctatagccggcaagcctttttcctcctcttcccagcaggagcatctagtccagatgatgcaaagcctccatcatggccatcgcctcgtcatccagaacctgcagcagttaacccttcatctttctatggagcctccactgatgacaccagaggcttttctacagtag

SEQ ID NO: 47664 - DNA, 1050 bp, Glycine max
  Peptide Sequence Number=SeqID_139349
atgaaaagagaaaagcatgtctcctatagtagtcataactcttgcaagagcctaagtgaagaacttcgtgactattatgaaggaaggcatatgtcacatcttagacctcactcccataggagagaaaatgaaagaaagcctcaagaggttaacattaaactcccatacttccatgggaaggacaatgaagaggcttacttagattgggaaataagggtggagcaaaaacttaaaagaaagtctactttaaaatcttatggctatcattcttatccaaagaaagaccaaggtctaggcatcttaggggcagcaccttctaagcccaatgatgataaggggaagacaatagaaaagcaaccccctaaggctagtatgcaagaaaagactagctccataaagtgctttaaatgtcttggaagaggacacattacttctcaatgctccaccaagaaaaccatgattatgaggatccaagacatttatagtagccaagatgaggctactgcttcaccttcctctagtgaaagtgaagaagcaaaaggggaagaatctagtgaagaaatctacccccaagaagaaggaaaacctttaatggttaaggaggagtgtaaggaggtaagtgtatcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagcttaaatccttgtgctttgttggtgcccaaaataggtattattaggcaccaaatccctaaaataggtggtatgatgaatgctttgggtggtgcaacactcatttgtaaaatcactcgtgcacccaacatcttcatgatttgtgtactgtcataccctaatttcgtccggggacctttgcttgatgacatgcgacttttgtttggtccttgtgaggtgcttggcacccatcattag

SEQ ID NO: 47665 - DNA, 1116 bp, Glycine max
  Peptide Sequence Number=SeqID_139350
atggcgaataactatattctccagcccgtattacctgctatcgcgacatctctgcagctgcccctgttttataccggcttcattgcagcgagcatgcaaataggttatatgctgggaatactctttcttgttccgctgggagatagcgttaaccgtaaaaaactgatcgtttgtcagtttttcctcctctcgcttgcgctgctcactgcttccctgacccgtcaaccgttgctcctttttagcgcgggaattgtgacgggcgcgatggcgacaagcgcagtgcagctgaatgcgcttggatttcatattacgccaaaaggcgccacggtcggtctgatcacgatgggtatttcggcagggatcctgctggcaaggctagtgggcggcagtctggccgatgcgcttggttggcgagggatgttggccatcttcgccaccgttatggcctccatggcgttgctggccatcagatgtctgcccgatgttaagcccgcaagggatacggggtatctgagcgtcatggtgagattgccgggtttactgcgtaacgtgcggctgattgagtctgctgtaaccggaggcgcatggttttttgtctttagcctgttatgggtgaccatcatgcttcatctgcaaaggccgcctttgcatctgcctgcgggaaccgccggattatttggcctggcgggtatcgtcggtcttgtactggcgaattatgcgggaaaactggctgaccgcttcgggtgtcgcagcgtgatttttagcggaatggtactcgtggtggcgggaataaccgtcctgtttctctttcctgcgtccttaccggggctaacgctgggtattatcttattcgatttagggtgttttgccgcgcaggtggctaaccagacgcgagttctcggactacacccggataaaagaagcagcctctatgcgctttatatgttcttttattatgcaatgggagcagcagggtccgttaccggtccgtgggtgtatgaaagatgggactggcagggcatctgtttagtgagcgtcgtgatggtgattattgcgatgatgaccaccgcaataggtcattttaacgaaaatagcgtcgcccacgtttcgaactga

SEQ ID NO: 47666 - DNA, 309 bp, Glycine max
  Peptide Sequence Number=SeqID_139351
atggtgggttacacaccttcaagctttgcggatttggtctttgctggcgaaatgatcgaagtgggtctaaaaagaggcaaatctgatcatcatgctttgataaatgcaaaaactggggcaaataaagaggccataacccctgctaggtttcctcaacatccatttttccgaggatacgacttgaacgcaacatgtgcatatcatggaggagttctgggacattccattgagcactgtatgaccttgaagcataaggtgcaaggtctaattaatgtgggcttgctgaaatttgaggagaaccgcttgtga

SEQ ID NO: 47667 - DNA, 516 bp, Glycine max
  Peptide Sequence Number=SeqID_139352
atgctttctcataagggtggacccttgggtactagtaccctcaccttcagagggttgcacgccctcaccttcagagggctgcacgccctcgccttagtagggctacacgccctcgcctttagaggacaacacgtcctcgcctccagaggactaccagtcctcgccttcagaggacttcacgtcctcaccttcagagagctgcatgccctcacctttagagggctacacgccctcgcctttgtagggctacacgccctcacctttagaggactacacgtcctcgcctccagaggactacctgtcctcgccattagaggacttcacgtcctcaccttcagagggctacacgccctcgcctttgtagggatacacagtctcaccttcagagggttacacaccctcatcttcagaggactatacgtcctccccttgagaggactacacgtcctcgccttcggagggctacacggcctcgcctttagaggactatacgtccttgccatcagaagactacac

SEQ ID NO: 47668 - DNA, 90 bp, Glycine max
  Peptide Sequence Number=SeqID_139353
atggccacaatgataaaggccatgatgagcgtgaagaggataatggaagccaatgcggttatagttgccgctattagcgttgttgctaag

SEQ ID NO: 47669 - DNA, 756 bp, Glycine max
  Peptide Sequence Number=SeqID_139354
atggctatagaccaaatattcttcataaggatcatccaaatatccatgctgcaaagagaaaaaagactgcaatcaaggaataatgaagctcaaacaatactacattcaaggagattgtttcatcaatggattgttgatgactactgtatgattgagtctcaaaaactaaattatgttaggcaacatcaacaacaacttagagttgacaagtacatgaatttgaatgcctgtaacaatgcccccgaaacacttggcaaccaaaaaggtaagagagttatactacctagttcttttgttggtagtcaaaggtatatggaacaattgtattttgatggcaaggcaatttgtggccatattggatttccaaacctattcttgacattgacatgtaatccaacatggtccgaaatacaaagaaaagttaggaaatccaatctcacacttcatgactgccttgatgttgtctcacagatatttaaaatgaagctaaatcaattgatgaatgatctcaaacgtggacatgtctttggtgccattcttggatttgtttacacaattgagtggcaaaaaagaggattgtctcatgctcatattttaatatttttgcatcttgcaaacaagtatccaaatccagaagacattgataagataatttctgcagagataccaaataagggcacggatccagaattgtatgaaatagtctacaaccatatgattcatggtccatgtggactgccaaatagaagcgcataa

SEQ ID NO: 47670 - DNA, 426 bp, Glycine max
  Peptide Sequence Number=SeqID_139355
atgaattatgcgccctttatcattcaagagcagcaagctgggtggataaacgcgcatagacgaattctacgccctttatcattcaggaatagcaagttggtggtaaacgcgcatagacagattttgcgccgtttgtcattcagatttcgcaagtcgagtgataaacgcgcagagacagattctgcgccctttgtcatttggggacagttctgctggcagggaggttcactggccgaatggtgtttcgctcgaacgaaattagtgtcttatctttacttcccttttatctccaataaaagacaagtaaagaggggcaactgtcaaaccctaatttcgtctggggaccatctgttgttgggatgcgaccctcattttaccactttgaggtatttggcacccatcgttaggcattttgtgaagttctga

SEQ ID NO: 47671 - DNA, 336 bp, Glycine max
  Peptide Sequence Number=SeqID_139356
atggatcatgtggatgacgaggtccatgaacagcctgaagaagcagttgctgatgatgtgccgactgatgccgagggttttccaagcggaccccatgacacatcagtgttgcaagattatgtttatcatgtggcgccgaaagtttggaatagagaggaggcttgcctagcaatagctgaaaggttggaaaggctgctcaacctaagaatagtgattgaaggaacaaaagcatacaccgtcaccaccgaagaatgcctgaggatcgcaagaggtgtcactatgcaaagagatatgtacattcgatcgagacaaaggtggcgtatggaagacgcatga

SEQ ID NO: 47672 - DNA, 726 bp, Glycine max
  Peptide Sequence Number=SeqID_139357
atgaatgtcttgacagcacatgatcaagggtgggaacaggagttaagtccttacaatcaatatgaagaagaaagaactcctaatcttgaaagtgtgtctgaggaattcatggtataccatgctagctcaaaagccaatcaaaattcaaagaaaaatcatgaaattcattttggcaagagctactcaatagaaaactttcaagggggaccagagttacaaccttactatcaaaatgaagcagaaagaggttccaatctagataaattgttgatgcaattcaaggaaacaactaaatcaactcaacgagcactccaaagtgtagaaatccaggttggtgagctggcagaagaagtgactcaatttatgtccagacgagaaaaatactttgaagaggttgaagctcaaaaggaaagccttgtaaaagagcatgagtcaagagaaaaagataaggaacaagcacaacaacaatgggagaagtactcaacagtagaaaaccatcaagaaagtattctccaaatcaataaccatcctcatcaacaaattgacaagaaaagaaggaaaggagagcatgaggaaaccttaagtgccattctttctttaatcattaacacttctcttgaaatgatttggaatgtacttcctgactacatgaagttcatggaatttctagctaaaaagagaaactgcaaggaagatgtgttttatgtgactttcatgccaccttga

SEQ ID NO: 47673 - DNA, 621 bp, Glycine max
  Peptide Sequence Number=SeqID_139358
atggctaagagttcatacacgagggagaacttcgaagctccggaagaggatgaagaagtccaagctctaaaaacagagctaggaaaggcaagactcgccaaagaaaaattcaagttagtcgctacagacatccggaaagagtgtgtcgagttacgagaggaaaatgcggctaccgcaagagccctcgaacgagaaaccaagaggactcgcaaggaagagcatggccgagataaattccaaggagctttgtggggcagcaacaatgagctcaagctccggagagaggaaagagaccagtcacgagtacatggcatggtcttaaaggaggagttagctgcttgctcaagatccaagaggagtttggtccgacacttagaagccacggagcaaagcatgctagctataatagggcagtacaaagaagagttaaaccagtctttgacccatgaacaaaagctagtagaggacttcgcacaagcgtacgccgagaaggaagcaagagggagggtgattgatgcattgcatcaagaagtgaccatgtggatggataggttcgccttgaccttaaatggaagtcaagacctcccgcgactactagccaaagcaaaggccatcgccgaa

SEQ ID NO: 47674 - DNA, 159 bp, Glycine max
  Peptide Sequence Number=SeqID_139359
atgaagaacaagatgcagaattcaaaacgggatgtgtacctaggagccttcctgaatggtgctttgaaaggacttgacgatactccacaacctaaatccaaggctagtgctaggagaattgttgttaaatatttcaataatgctagaccattggaataa

SEQ ID NO: 47675 - DNA, 306 bp, Glycine max
  Peptide Sequence Number=SeqID_139360
atgttgaagaacggtcgagaatcttcgcgtaattactcacggaaacgttacggaaacgctaagtgtctcaccgtgcccttcgcgggcgagcgagggcgaggctcacgggtgcgctttccaaaggaggaaagatgcgcggagtcgccaccaacgtttatttgtggaaaacgtcgggaaaaccaaaggaaaccgttcaaaataaaaattctaagttcgggagttgtatttaagcttgaggaaggtcgacaaaagcagggcttttgctcctacgtaccctcctttggagaggaaatcagacctacgtag

SEQ ID NO: 47676 - DNA, 648 bp, Glycine max
  Peptide Sequence Number=SeqID_139361
atggtagttcgtgccttcgacggcacccgccgagaggttaggggagagatcgacctcccggtacagataggccctcacacctatcagctgtctgttgggacgcccgtggatccattcagtgggagtcgttccctctacgctccaccagaaattgaagttcgtagtggaagggcatttggttatcgtatcgggcgaggaagacatcttggtgagttgcccatcctctatgccatatgtggaggccgcggaggagtcattagaaaccaccttccagtctttcgaggtggtaagcatttcctccgtggattccttctctgggcaaccttgcctgtcagattcggcagtaatgttggggaatggttacgagcccggaatgggtttaggtcggatttggtacgaccatgccctcctgatttccgactaggaaattggcgagtgggtgagcgcccggacatttatgcgacaagcataatatccaacgacgagtccctcgaaggtactaatacctgggacccgcccatcgacttcgagcaagaaacgaatcaaacaaaagatgaagagaacgaggatatgggacttcccccggagttggaaaggatggtcgcccatgaggaccaagaaatagggcctcatcaagaagagacataa

SEQ ID NO: 47677 - DNA, 743 bp, Glycine max
  Peptide Sequence Number=SeqID_139362
atgggttcagtggtggtggttgaaatcacccaacgtgcgacgcgtcgcaccaaagcgatcggcaaagtgaccgagctgctgggtgacgatatgggcaccagccttgcggtcgatatggcggtgcgcacccatgaaatcccgcacacatggccggaagaagttgagaagcagatcgctaagctgaaagaagaagtaccggaagaagcgaagctgggacgtgttgatttacgtaagttgccgctggtcaccattgatggtgaagatgcacgtgactttgatgatgcggttttctgcgagaagaagcgcggcggcggctggcgtttatgggtggccattgctgacgtcagctattacgtacgtccgggcacgccgctggacgatgaagcgcatcagcgcggcacctcggtctatttcccgtcgcaggttatcccgatgctgccggagattctctccaacggcttgtgctcgctgaatccgcaggttgatcgtttgtgcatggtgtgtgagatgaccatctcctccagcggcaaacttaccggtttcaaacactatgaagcggtgatgaattcccatgcgcgactgacctacaacaaagtgtggaacattctgcaaggtgatgccgatctttgtgaacaatacgcggcgcaggttcctcatctgcacgagttgcacaacatgtatcaggtgctggaaaccgcgcgtgagcagcgtggcggcatttcgtttgagaccgatgaacccaa

SEQ ID NO: 47678 - DNA, 258 bp, Glycine max
  Peptide Sequence Number=SeqID_139363
gccaaagaagagaagtttcaagcagctgatgactcgcttagcgaggtagatccgctcagcgagatgaatcctcttagcaaggcatccaactcacttagcagatgggaaaccctagaacttctcgctaagccaatctgtcggcttagcgatccatctgctgagtgcaccactcttgcggctgagcgcgaggaagaatctagaagaaggatgagctggcaaagaactgagcttcaagaggaagccatcctgagagcatga

SEQ ID NO: 47679 - DNA, 210 bp, Glycine max
  Peptide Sequence Number=SeqID_139364
atgacggtgaaaacctctgacacatgcagctcccggagacggtcacagcttgtctgctgcgcaactgttgggaagggcgatcggtgcgggcctcttcgctattacgccagctggcgaaaggggcactctgcctccaaggcgattaagttgggtaacgcccagggttttcccagtcacgacgttgtaaaacgacggcccagtgaattgtaa

SEQ ID NO: 47680 - DNA, 795 bp, Glycine max
  Peptide Sequence Number=SeqID_139365
catgctctcactttcagaggactacacgtcctcaccttcaaaggacagcacgtcctcgccatcagaggactacacgtcctcaccatcagaggactacacgtcctcaccatcagaggactacacgtcctcatcttcagaggactactcgtcctcgcctttagaggactacacgtccttacctttagaggactacacttcctcgccatcagagcgctgcacgccctcacatttagaggactgcacgtcctcaccttcagagggctgctcgccctcaccttcagaggactacacgtcctcgccatcaaagggctgcacgccctcacttttagaggactacacgtcctcgccttcagagggctacatgccctcgccattagacggctgcacgccctcaccttcagaggactacacgtcctcgccatcaaatggctacatgctctcacctttagaggactacacgtcctcacctacagaggactacacgtcctcgccatcagaggactacacgtcctcatcttcagaggactacgcgtcctcgccatcagagggctacacgctctcaccttcagaggactacacgtcctcgccttcagaggactacacgtcctcgcctttataggactgcacatcctcaccttcagaggactaaacatcctcattttcagaggactacacgtcctcatcttcagaggactacatgtcctcacctttagagggctccacgccctcaccttcagaggactaaacgtcctcgccatcagagggctacatactctcacctttagagaactacac

SEQ ID NO: 47681 - DNA, 432 bp, Glycine max
  Peptide Sequence Number=SeqID_139366
atggcgcctcctctcacctattctcctttgtcttccgctgcatctccatggtggaaaatcaccattaaaggacctcatggaagctcaaagatccagcctccatataagccccacaagcaagcttccatcacaatcctaaacgtgtttggcagtagacgaagcaatgatgtaacacgatccatcttttgccccaaattttgcaagatggttacttccatgcttcaacttgactcaatgaaccttttcgtaaaagcacgagcttggttcaaccctataacccagggaatggcaattttgatcgccaatcttcgacaacatttcatagggatgaaagactcaagaatacgcatgctatgcatggaaaataggaaaatgcaaggatcatgcatgaaaacaaaaggtatgcagtttgtagaacaaagagtatgttga

SEQ ID NO: 47682 - DNA, 369 bp, Glycine max
  Peptide Sequence Number=SeqID_139367
atgtatacatacattcacacgccctcgacttcaaaggactacacgtccttgactttagagggcttcacgtcctcaccttcagagggccacacgccgtcaacttcggagggctacacgccctcaccatcagaggactacacttcctcaacttcagagggccacacgtcctcaacttcggagggcaccatgccctcaccttcaaaggaccgcacgttctcgccttcagagggtggcacgccctcgacttcaaaaagcggcatgccctcgacttcagagggctacacgtcctcgacttcagagggctacacgccctcgcctttagagggctacgcgtcctcacttttagtgggctccacatccgcaccttaa

SEQ ID NO: 47683 - DNA, 244 bp, Glycine max
  Peptide Sequence Number=SeqID_139368
gttacaggttgtaccatctgtggtgaggctcatgaaacaggccaatgtattcccattgaagaaaacactcaagaagctcattatatgggaaatcaacagcgacaagggtatactcaaggaggattttcaggcttccaacagggtccttataatcagcaaggacagtggaggaattaatgaagcattgggcttgaatctagaattgggcttggacttgaagagagcagactattttattctataa

SEQ ID NO: 47684 - DNA, 153 bp, Glycine max
  Peptide Sequence Number=SeqID_139369
atgcttaaagaaacaaatcgctggtgctggcagcttggacatacaaacttggaattggaaggaggattggtgccatcccttgaagaatttgagtccagaagcaaggggccaaccaccttaagagctattggactaagaagcactccaaattga

SEQ ID NO: 47685 - DNA, 801 bp, Glycine max
  Peptide Sequence Number=SeqID_139370
atggaactccgcagcgagaacttcgataaagccgttgaggttatggcgaaagcaacgcaagcgccgaagaaatcaacagtcgactacttcgatgagaacctttcgcctcagcaacgagttcacaagagctggaaattgtggagtttctacgttgatttggttgaaagcgtcgcgtcgttggaagagacaaagaaggtttacgagaggattttcgagctacgcatcgccacgccccaaactgtggtcaactatgccaatcttttggaggagcacaagtactttgaggattcattcaaggtttacgagcgaggtttagatctcttcagctacccggttgcattcgagctttggaacctctacttgactaaagctgttgatcggaagattggtattgaaagattacgagacctcttcgaacaggccctggatggatgtcctcccaagtttgccaagccgctctatctaatgtatggcaatcttgaagaggaacgtggattagcccgccacgccatgcgtatctacgagcgtgctactcgtgcggtgtccgacgaggacagattcgagatgtttgagttctacattaccaaatccgcgtcgaactttggattaccttctacaaggccaatctacgaacgtgctattgcggcattgcctgatcaagaagccaaggagatgtgcctcaaatttgcagaaatggaacgacgacttggcgaaatcgaccgagcccgcgcaatctatggccacgctatcgaattcctgcagcccgggggatccactagttctagagcggccgccaccgcg

SEQ ID NO: 47686 - DNA, 726 bp, Glycine max
  Peptide Sequence Number=SeqID_139371
atgttgtccggccctctggctcgctatgaaaaggagcttcgcgcctcgcacgttgccatggcacatgagttgcgctctcccctgacggcagccattgggcgtctgcagggtatgatggacggcgtgtttgacgccaccccggagcagttggggatggtgatgaaacagctccagcacctcaaccggctgaccgatgaattgcaccttctctctttggctgatgcgggaaatcttgtgcttgaagacaggccattccgtctggatgagctgattcaggagcgggcagactggataaccccacaggccgatgcgcataattttacgataacgttgcgtaacccgcgcccatgccccttcagaggcgatgcgttccgtatgggacaggtgtttacgatcctcatggagaattcactccgctacggacgcgagggaggccatctggaggtggtgctgcattatgcccaggggcagtacaccctcgaattcgccgatgacggtccgggtgtatcaaagcactttctaccggacatgtttaagcgatttagccgcgaggaacaatcacgcgcccggcactccggtggcagcggcctcggtttatcaattgcgcaggcgatttgtcaggcgcatgggggaagtattagcgcgtcattaccagaaaccggagggcttctggtgcgcatccagctgccctggcgtgcttgtgacgaggaaaattcccgctcttga

SEQ ID NO: 47687 - DNA, 178 bp, Glycine max
  Peptide Sequence Number=SeqID_139372
atggcctcgaggaaacttgcctcaaagagatctaggaaggataaagtggctgaaggaactagttctgctcccgagtatgacagtcacagctttaggagcgctgtacaccagcagcgctttgaggccatcaagggatggtcatttctctgggagcgacgcgtccagctcaggacgacaa

SEQ ID NO: 47688 - DNA, 489 bp, Glycine max
  Peptide Sequence Number=SeqID_139373
atgagggcttctggtaatcgattaccaagggggtgtaatcgattaccaggcttagaattgaaggcagcaggttgtagaggcctctggaatgggtcactggtaatcgattaccagatcatgatggcggcgcagctaatccatgatcgagtagagatggagtgcctagggggagcttgggagaccctcgaaggcaacacgaggtgccgatttcggggcactattcgatttacggctactttattggtgcatccagatgaaccggcgcgtacgcttcagcgcactgtggagtggatactacccacgcctacaccatatcgtctagtggagtcagtccaagtgatcgaggtgacatcatccgaggaagaccctgaggaggatcccgaggagctaccttctgagcctgctgtggatgatcttgactttctagagggcgatgaggacccacttcctgaggtggattctccccgaggaagtcatgtcggcatctga

SEQ ID NO: 47689 - DNA, 315 bp, Glycine max
  Peptide Sequence Number=SeqID_139374
atgtctttcgaccaagactatcacagtcttcttttcctccaagactatcaagtctgtcggcctacagagacaatcaaggtcatctacctctttttcgaagacttcaatgtctttcgaccaagactatcacagtcttctttgcctccaagcctatcaagcccctggctcacccaggccactagaaagcttagggttgaagtaaccagctcgcctgggcgagcaaggttacttctggaggaagcaaacaactcgtctaggcgagctgagcttgcctgggtgagctggtatgcaacctccacccctcattccctataa

SEQ ID NO: 47690 - DNA, 538 bp, Glycine max
  Peptide Sequence Number=SeqID_139375
atgcagatcgaggcatacatcctctcgccgcgcatcatgagccgtgcggtcgccgtccccggcgccctcgtcgtgatcgcagcagtcgccggtggagcgctcggagggatcctgggcgcgctcgtcgccatcccggtcgcggcgagcatcatcatcatcatccagaaagtgggcccccggctgcactcgcacgtcgaacgcggacacctcgcccatctcctcaccgtcgatctcgaacaccagtggcgtcttcagctccacagagatcgtctcgacggggagatgccgggcggagtcggtgctgaccgcttcgtctgcagcgccgaagagtcgccggatgccgttgtcccagacgaaggaccgcagggtctccagccattgcagcgcgccgtcggcgctgatcatgagcacgtccagcttgccgtcgtccagcacagcgtccggcagcaggcggattccgccctgcaccatcccgcaattgccgatgagcatggtgtgcccgcgcaccgccaccgccttctcaccgtcgatcgccaga

SEQ ID NO: 47691 - DNA, 532 bp, Glycine max
  Peptide Sequence Number=SeqID_139376
atggaatggtgtaatcaaagtacatccattaaatatttgttcaaatacatcaacaaaggttctgatcgtatcacagcttttcttggaaatcaagatgaaattaagcaatatctcgattgcagatatgtatctcccccagaagcatgttggaaaatttttgcattcccaatgcatgtgcgttccccggcagtggagcggctatatttccaccttgaaaatcaacaacatgtttactggacagatgatcaacaaataggtgaagtcctatcaaaaaacacaatcaaagaatccatgttcacagcctggatgcattctaacaaaatatgttcttatggacgggatcttacatatcatcaatatatctcaagatttgtttatgtcgcccgcaaaagatgctggcaaccaagaaaacaagggaatacaataggcagactcatatgggtcccaccttcagctggtgaactgttttaccttagaatgatgctatccactatcaagcttatcgataccgtcgacctcgagggggggcccg

SEQ ID NO: 47692 - DNA, 249 bp, Glycine max
  Peptide Sequence Number=SeqID_139377
atggcacgcagcgtgtttgcttcgtgcccttattttagggacctatatgggagggagctaaaagggtttttagtgataattcccaaggtggtcatatctctcttgatggtctctggaggtatcatccccttcgaagaacatattgtggcagtagggactactagcatgatttgtataactcaaaacatgatgaaggccatgaattgtatagagacaagctcttttgaccaaatagcttaccttgaatga

SEQ ID NO: 47693 - DNA, 345 bp, Glycine max
  Peptide Sequence Number=SeqID_139378
atgatgttgctacttagcaacattctgcccagcgaccgcaatgccaatcaccccctgcaaaagtatcagttggtctgtgtcgtcccgacatggggatcgcacccacaagacacccagtggacccggaaaagtccaacagggccctggggtttccagctctggttacgggcctctatcagtcctatagggtgcccgtacccccccggcaagggatcgcgcctgcagacacccagtggacccgaagaagtccaacagggtctcgagttgtcaagctctaattacgggtcttctatcagttctacgagtacctgtaacctccagcaagggcatcagaccccctactga

SEQ ID NO: 47694 - DNA, 132 bp, Glycine max
  Peptide Sequence Number=SeqID_139379
atgagagaggtactttcaaaaaaaggaggagaagacgaagcccaagatacagaaagaatcgtctcctgcgcaccgattggagacggggcccccgcaaggaaaagtgctgctctcataaccgactgtttttaa

SEQ ID NO: 47695 - DNA, 219 bp, Glycine max
  Peptide Sequence Number=SeqID_139380
atggcgttgatgatggagaagcagctgaggaagaagaagatgcagcagaggatacagaatcagatgatgatgattctgatgccaccccatgaccatcagacctttatttttgctttttactcttactatgaactgctgcctagcagaatattcacttcacagcagcaagagcatggagacagggggagcagaaagctgatgtcacgtgagatgtcttga

SEQ ID NO: 47696 - DNA, 270 bp, Glycine max
  Peptide Sequence Number=SeqID_139381
atgtttgctcctaaggttactattaatcacgggagaggctggcaggtagcgaggcacgtagtgaatgttctaccgaaagcccttcacgcggttgcgatcgaaccacggaaatcggtgccatatgcaaaggggaagttaggcgaggctttgggtggatctggctccacttgtgccgcatgggccgatctttctataacgataccaccaactagcttggatgcctgtcgaagacctcccaagccacgtatcggttattctgactctatgtag

SEQ ID NO: 47697 - DNA, 540 bp, Glycine max
  Peptide Sequence Number=SeqID_139382
ggcgaattggagctccaccgcggtggcggccgctctagaactagtggatcccccgggctgcaggaattcgataatctattcgcgatctagtttaacaatgattgcacgtatcagtaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 47698 - DNA, 1174 bp, Glycine max
  Peptide Sequence Number=SeqID_139383
cgagcacgcggcggtagccgacgtgttctacccgggcctgcccggcacggccggcgccgagatcgcgcggcgccagcaggcggccggcggcggcctggtggcgttcgaactgaagggcgggctggccgccggccggcgcctgctcgacagcctgaggctggcgcgcatcgccgtcagcctgggcgacccggaaaccctgatccagcatccggccaccatgacgcacgccagctacaccgccgaggaccggactggaccgcgcggcgcggtgacggcgagccgcccggctccacaaaggttcgagtgccggcccctcagcgcagcaccgaggtcaggctgtcgaactgctgcgcctccagccgcgcgcgttcctcggtcactggcgcacggccagctggtgcgcgcggaagcggttcaacaggctgtcgcggtcgaacacgatctcgttgtgttccacgcgccaggaacggcggttgtcgtcgagcagattgatcatcttctcgaactcggccagcgtctggcgctccaggtcccagttgcgggccagcattgcgcgttgctgcgggcgcgccttgatcgcgccctcgaccatctggttcttctgctgctcgctcaggtcgagcgaacggatggtggcgggcacgtccaccagcaaccgctgattctgctggctgtatttctgcaccacgcgctgcgattgctccaggatcagtcggctctccaccagccctcgatcgcgcgccagtcggttgggaatgaacaggtcggacagccgcacttcgtccagttcccgcatgtaggcgcggtactgcgccacccgttgtcccagcatgatcttgacgccgcgttcgatctcgccatacacgccgcgcgccttgggtgtggcgtcgatgtccggcacgtcgccgggcggatggtcgggggcgttgatcgccgcgcgcatccactcgccggtgcggcggatctcggccagggcagtggctttttgcgcctcgcgataggccgagaggctggccagcgcggcgaccgccaccgccagcaccacgccgatggcgaatgcggcgcgcatgcggtgcaacggggtgcgaaagcgcttgaacaacgacaacacgccgatcgcgatggcagcgggcagcagcagcaggagcgcgcagcccaacgcgctgccgacgcg

SEQ ID NO: 47699 - DNA, 606 bp, Glycine max
  Peptide Sequence Number=SeqID_139384
atggttggtttcacaccttttcgccaagaggtaaggcatgcttgcctgctagaaggtcaccactcatgcacagagaaaggaggggcaaattgggaccaactcttagcaaacaaagaaggagcgtttgtcaactggttccctcgatggaaggaaggaagagtcggagttcttatttcatgcggaggatttccaaatgttcccttgatggggacgaggggttgcatcagctacaatctcgttcttgctataagacaacttggctaccctatgagaggggcgccactagaggatgagctcgcgcctgtcatttcacgaggcttcaataagaccaacgtggagacacttcagaaggtccgcaaggcatgggaggtgttgcaaaagaaggacaaagaactcaggggcagtaacaatgggtccatcgatggctaccgtaagtggttgaaagcccacgtgcaaggtttggattggctcccgagtctgagaaccgctaagagggaggaagatgaggcactggaggaagacgaagaagtgcaggcccttaggacaaaacgcaagcaagctcaaacggtcaaagaaaggttcaaatcagcaactcttaaaatctga

SEQ ID NO: 47700 - DNA, 462 bp, Glycine max
  Peptide Sequence Number=SeqID_139385
atggggacaaatccaaccgacaagaggttttaccaagtcaaggttaaaggcctagataccaccagcatcaaggagttaggacggttgatggaacctctccaaatgcaagccttccgcaagacttacggaaagatcttagagttgaccatagcagaggatgtcctctcgggagaagaaaaccataccctttcctccgggtgtctcccctctttgagcagaattgcgactgtggtcaaggattccagcaagaggtttggaccgcataaaacagactcaaaacggcatagcgggcctaccacggaagtacttagaagacaaggcgaggggtatggccaatcaaggagattgggtcccgtttatggatgtgttagctttgctaatttttggggtcgtcctctttccaaacgtagatggtttggtggacctagcagcaatcgacgctttccttgcataccaccatag

SEQ ID NO: 47701 - DNA, 174 bp, Glycine max
  Peptide Sequence Number=SeqID_139386
atgggggtgcaaatagagaccaggcccacttgggccctccagaagattcctccagaactgttgcttctggaggaagcaaccctgctcacctgggcgagctgggaatttcgcgaaggtttcgaccgttcttcgacgttcttcattcgttcttcatcgttcttcgatcttcaactg

SEQ ID NO: 47702 - DNA, 450 bp, Glycine max
  Peptide Sequence Number=SeqID_139387
atggcttctaggaaacataaaagtattggttcaagacccatagtgcagtatgagacaaggagattctcttccttagatgcttggacccgatacacagataatgtcttggggagaaacattttaccagagaggaaagtagagatatatcacactgagctagatgagtttaaggctgaattggagagacataatttccataaaggcctcaccaatttagtcgataggagcatagacttggctttggtgaaagagttctgtgcaaatttatacagttctgaggaccgtccaccaaatcagtccagagtcaaagactatagagagatagaggttgccttatgcacacctggtcgagggttcatcttgaactctgagggccatcctgggaagattctcaggaaggatctgactacactagctcagtgtggagtgtcctcttatactccaacttag

SEQ ID NO: 47703 - DNA, 96 bp, Glycine max
  Peptide Sequence Number=SeqID_139388
tttgaaagacacaagaaacaagaacaagaacgtgacaagaacaagaacaagaacaagaacgcaaataacagaacaaggacaaaaacacaaacctag

SEQ ID NO: 47704 - DNA, 240 bp, Glycine max
  Peptide Sequence Number=SeqID_139389
atgtccggaacatccctttcgacatcaggaaaggtagtgaataccagaaaaggtcagatgaaaaacccagtcacagcaaaggagtccaatgccatgggtgtgaaggctatggacacatcaaaggctgaaccatcccaagatgctggacacagaaggaaagcccattctgatgaattgaagtcagagaagactggacaaaagaagaagagaattggcacttggaaactccaagagctttga

SEQ ID NO: 47705 - DNA, 936 bp, Glycine max
  Peptide Sequence Number=SeqID_139390
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattcgggaaatacacgaagagcttaacctcatcgccgacgccggccaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccggtgtcattccgctgttatggccgcgtttgtctcatccacgcctgacactcagttccgg

SEQ ID NO: 47706 - DNA, 129 bp, Glycine max
  Peptide Sequence Number=SeqID_139391
atggcagaaatttatattgacactcgaactcgaaaagatggaagcagtgttaatgaaaaggctgctattgtaattgatgaactaaaaacaagcaaaaggttgaagcagagagttcgcaaaatttactaa

SEQ ID NO: 47707 - DNA, 606 bp, Glycine max
  Peptide Sequence Number=SeqID_139392
atgccttatgtggaggccgcagaggagtcattagaaaccgctttccagtctttcgaggtggtaagcatttcctccgtggattccttctctgggcaagcttgcctgtccgatgcagtagtaatgatggcccgagttatattggggaacggttacgaacccggaatgggtttaggcaaagacaacggcggcataaatagcttgataaatgccaaaggaaatcgtgggaagtatggtttaggctataaacccactcaggcggatatgaagagaagcatcgcgggaaggaaaagcagtggccaaagctcgcagttgagacaaggaagtaaaggaagcccgccctgccacataagtagaagctttataagcgcgggtctgggagacgaaggtcaagtggtcgcgatatacgaagatgatctgggaaattggcgagtggaggaacgccccggcatttacgcaacgagcataatatccgatgacgagtcccctgaaggtactaatacctgggacccgcttatcaacttcgagcaagaacgaatcaaacggaagatgaagggaacgaggatgtgggacttcccccagaaattagaaaaggatggtcgcccgtga

SEQ ID NO: 47708 - DNA, 567 bp, Glycine max
  Peptide Sequence Number=SeqID_139393
atggtgggttacacaccttcaagctttgcggatttagttttcgtcgatgaaaggatcaaagtgggtctaaaaagaggcaaatttgatcgtcctactttgataaatgaaaagcctggggcaaatagagaggatgagaaggaggaaggaactcatgttgtgactgccattcctacatggccaaatttcccaccagctcaacaaagtcattactcagccaaaatctgtccttctcattactcaccacctaatcatccacaaaggtcatccctaaatcagccaaaaagtctgcctgccgcatatgcaatgccaaacaccacccttaacacaaaccaaaacaccaaccagggaaggaattttccagcaaaaaagcctgtagaattcaccccaattccgatgtcatatgctaacttgctcccatatctagtcgataattcaattgtagccataaccccagctaaggttcctcaacctccattttttcgaggatacgactcgaacttaacatgtgcttatcatagaggagtttcgaggcattccattgagcattgtatgacccccgaagcataa

SEQ ID NO: 47709 - DNA, 396 bp, Glycine max
  Peptide Sequence Number=SeqID_139394
atgggtgaagtagaggagatacaagagaagatgaaggccgatatggaggccatggccacaatgatggaggccatgatgagcgtgaagaagataatggaagccaatgcggttgcaattgccgctaccagcgttgttgctaaggtgaacccgacgtccccatccagcctcaagcaaatgaatcatccaacctcaaatatggtaggcaaagatttaggaagtacgggcggcccccatgatgtgcaaattcaaaacgagcacgccctcccgtcatatggcttgcctctcaactatacgccacccaatgtggcgtacactcccaataagaatgtcaataactccactcctataccaattgaaagccagcaaccccaaactgatcatgcacatgtctcttaa

SEQ ID NO: 47710 - DNA, 275 bp, Glycine max
  Peptide Sequence Number=SeqID_139395
ggatcgtgcccacaagacacccagtggacccggagaagtctaataggtccctgaggtttccagctttggttacaggcctctgtcaatcttacagggtgcccgtcaccccagcaaggtcatgccatcgtgacatagggatcgcacccgcaagacccccagtggacccggagaagtccaacagggtcttggggttttcagctctgattacaagcctttgtcagttctacggagtgttcgtcgcccccaacaaggtcatcaagccccctgttaactag

SEQ ID NO: 47711 - DNA, 195 bp, Glycine max
  Peptide Sequence Number=SeqID_139396
atgaaggaaaacaacaaaggagtaagtcatgcggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactctttaagtga

SEQ ID NO: 47712 - DNA, 138 bp, Glycine max
  Peptide Sequence Number=SeqID_139397
atggcccccctctctttacaggatactgggctgccttgcagcgacgttctctgcttgtccagcgccgggaagagacgacgatcagtcagtcatgaccctatcctccatttgcgtccgttcctaagtacctacaagtag

SEQ ID NO: 47713 - DNA, 191 bp, Glycine max
  Peptide Sequence Number=SeqID_139398
ttgaagaccgaagaaaacgaagaactaacgatgaatgtcgaagaacggttgaaaatcttcacggcaggagcttgccacccagctctcccaggcgagctcagctcacccaggcgagctcagctcgcccaggcgagccaggttgcttcctccagaagcaaccgccttctggaggaagaaacgggaaggcccaa

SEQ ID NO: 47714 - DNA, 417 bp, Glycine max
  Peptide Sequence Number=SeqID_139399
atggcggcgggcgcactggcgctctggacattgccggttgagcaatatcccgacatcgccccacccggcgtcacggtgaccgccaattaccccggcgcttcggccaaaacggtagaggacagcgtaactcagattatcgaacagcaaattaaagggatcgatggcctgttgtatttctcatcaaccagcagttcggcgggtcaggctcgcatcagccttagcttcgaacaacaaaccgacccggacattgctcaggttcaagtgcaaaatgcggtcaatcaggcaacgtcgcgattgccgcaagaagtgcagcagcaagggatctcggtgacaaaatcgcagggcgatagcctaatggtagtcgccctgtacgacacgcaaggccgcatggacagcgttgatatcaatgattttctg

SEQ ID NO: 47715 - DNA, 47 bp, Glycine max
  Peptide Sequence Number=SeqID_139400
gaggtttccggactatggaaagctaaatcctctgttggatcttccct

SEQ ID NO: 47716 - DNA, 309 bp, Glycine max
  Peptide Sequence Number=SeqID_139401
atgttggggaagcttgggaggattgatggggacccggtgttgagacaaacgaggatatgggctacgtgggagtacgtgagctcagttggaggtgggctacaggggatggtgggtttatgcgcgcattgtggatgtggaaaaacttgttgtgcaccatcgcccgaccgccacctagtaccacatgtgatggagtggtacctggagatatgtcgcgggggtcaggagaccttggggacgtcaggtggggtgctattgcccaaaaccaagcttgaccaatcccgacccaacccgggcatagtcggtcagtga

SEQ ID NO: 47717 - DNA, 330 bp, Glycine max
  Peptide Sequence Number=SeqID_139402
atgatacgcggagataccttatggttattcacacccttttgtcatccagaggcggcgggcccgatgacaagcagagaccaagtttggtcattctgcacccttgtatcatccagaggcggcgggcccgatgatacgcggaaatacccgagtggttatccgtataaacattcttttgctatctgcccacttgggccctctagaatattcctccagaaggatgttgcttctggaggaagcaacctggctcgcctgggcgagctgagctcgcctgggcgagctgagctcgcctgggcgagctgggcggcaaccacctcccctattttgctataa

SEQ ID NO: 47718 - DNA, 96 bp, Glycine max
  Peptide Sequence Number=SeqID_139403
tatatcaaatctgctcttagacaaggtttgtttttccctgctcagaactctctcaacctcactgccgttgctgatgctgattatgttgatacctga

SEQ ID NO: 47719 - DNA, 369 bp, Glycine max
  Peptide Sequence Number=SeqID_139404
atggatcttagagagcaaaacatgaaagaaggtgttataaccaaacaaggccagttgttgctcaaggcaataccttactcaaattacagcagtgtagcatttgatagagaacttcattgccaacctgttgctagaactgtgaggaatccatcagattgttacttggttgttgagcttgcatctaactccaaattcaagctgtaccaagaatggatgtcgaagaagatcgccaagctccaaggagctgatggtatgaaaggagatcctaacagaggttccttactcacaaggatatatgttgatgacattgtgtttggagggatgtcgaatgagaatgcttcgacattttgtccaacagatgcaatctga

SEQ ID NO: 47720 - DNA, 553 bp, Glycine max
  Peptide Sequence Number=SeqID_139405
atgacacgcagaggccaatgtggtcattcagcacccttttgtcatccggaggcggcgggcccgatgacacgcagagacaaattatggtcattctgcacccttttgtcatccagaggcggcgggcccgatgacacgcagaggccaatgtggtcattctgcacccttttgtcatccagaggcggcaggcccgatgacatgcagaggccaatgtggtcattctgcacccttttgtcatccagaggcggcgggcccgatgacatgcagaggcaaattatggtcattctgcaccctgctcatgctgacgggcggaaatacccgagtggttatgatgaggacatgaccaagagcaagggcaaggatccacttgaaggacttggaggacctatgactagggctagagcaaggaaagccaaggaagctcttcaacaagtgctgtccatactatttgaatacaagcccaagtttcaaggagaaaagtccaagggcccaattggcaacctaggcatcagccttttgggagaccaaatggtggctgacttgttggctgttgggg

SEQ ID NO: 47721 - DNA, 213 bp, Glycine max
  Peptide Sequence Number=SeqID_139406
atggaggttgatgaaccttgcctggggttatggctaccattgaattatcaagctttttcgctgcaaaattcatttctggttgatgttttggtttgggctaaaggtggtgttcgtgttggtggtgtggaatggcagtcacaacatgggtttctccctcatcctcaccctcttcatttgccccagttttctgattcgttcaagcaggatgattaa

SEQ ID NO: 47722 - DNA, 345 bp, Glycine max
  Peptide Sequence Number=SeqID_139407
atggcctcctatggtggtgaattggttccattggatttagaaattgaagcaaccttcagaagaaacaacgcaaagagaaaaagaaagcttttgcacaacagaacagtagcatcaatccttgaagaggctcacttttctgagtcatcatcttctaattcacctacatccagggaatctcaaacaacaaaatttgaagccgaagtcatcgctgaagagcaacctcgacgaatgaccctggaagattactcaagtacatctgtgccacagttctttactagcattgcacggccggaggttcaagcacagaatataacttatccacattcattaattcagttgatttaa

SEQ ID NO: 47723 - DNA, 171 bp, Glycine max
  Peptide Sequence Number=SeqID_139408
atgtcaatgatgggagaactaaagggattacaaacaatgaagacctccagaagaaggatattcatcaaatccaagtactgcggaatgaactccaaaagatgggatggaaagcttgcaaaagatcatcctggctatgacactgttgtacttattggtgatatctcaaaaggg

SEQ ID NO: 47724 - DNA, 639 bp, Glycine max
  Peptide Sequence Number=SeqID_139409
atgccgcccgttttcatttcgtggaagtccccggcagaggaaagggctgtaggccaggccgaatcgggccaccacttgggatgggaatggctcagcccatatgcatcatttgatgaaagcactccagtcgcttcctcgaagtggcttgtcaaccacgctttccctccctcaaaacaatgctcctcaccaaccttaacggccttgggttggggcaagacagcaatgagtagttcggtccaggactccaccccctcgagagcaggatgccggccgagatggagctgggagccaacctatactttcctggggcttgccttgccccaacatctaaatcaaatgcgggcgccgaaaaggaaccagcccagcctcttccagaaagctttgcttggtaggcgctgcctattcacttcactcggacaatgctctaaacacgaaagtgtgacgcccccttctcccatgctgagtcacaggcagcgcctcggaaagcgcggacgagccacatgcagggaaacttgcacgtgtggttctggccggggaccccggtatactgtactaatatgtgtaggtccccgtaattcgagtgagattgtcatggcgcaaaagcagatatggtccggtattcccttgttccctgtattg

SEQ ID NO: 47725 - DNA, 213 bp, Glycine max
  Peptide Sequence Number=SeqID_139410
atgggacaacaaagggttaagaaatatgagaataatgatgacacatccccaatcccctcacacttactttgcactcctgggcaaaacaatccaaagctccaaaaagttcttaagggtacggtgaaatcaggtttttcacttaaggcttgtaatgagcttcaaaacaaagaccaagggaaacataggttctcaaaggggctatcaaaggaatga

SEQ ID NO: 47726 - DNA, 775 bp, Glycine max
  Peptide Sequence Number=SeqID_139411
atgttcatgaaaggtatcgcatccgttctcttgaagcccctcggtgcgcgcctcggcgctctcgccgctggtgccctttccggcgttgcaatctccgatccggttattgcttcccgcgttgaagcgtgggttctcgccggtgtcttgctggctgctgaccttgtcggcagctacctgaggtccaagacacaggagaaaaagtctgctgaaaagcaggctaaccagcaatacgccaatgacatggccgctgctcaacaacagcgcgaatggcagttggaggatcgcgaggaagaacgcgcatacaatcgtgcgcagttggatgaaacccgcgagtacagccgtcaggtgttttcgcatcttgttgaggatgccgaaaaagcagggttcaatcccctcaccgcccttcgggccggtggcggtgcgtcttataacgccgcagcggggcttgcgccgctgtcggctacccccattacgcgtcaagcgcctgtgaaacaggcggtcggcggttcgccgttaggtgatgctgtctccgggatcggtgacttcattgcgaatttcgatccctttgcggatcagaagcgcgaacaggagtaccggctggttgaaagccagattgccgcgctgaatgcgtcggcgctttccggtgctccgcgtggttccgcctcgtttgcgacgggcggttttgaacggcgtgtttccggtcaatccggcgttctttccaagagcgggaagaacgctcccggtgagggcacgatcgttggtggagacgatccaa

SEQ ID NO: 47727 - DNA, 354 bp, Glycine max
  Peptide Sequence Number=SeqID_139412
atgggcccatcggtggctactctaccaccaaggccttggagcaagagacaaaaagggctcgtagggaagagcacggcccggaacaagttccgaggggctctgtggggcagcaacaacgagcttaagctccagagggaggaaagggaccaatcctgggtagacagtttgatcttgaaggataagttgaaggcttgctcgaggtccaagagaaacttgtctcagcggttatgcgagacagagaccaacatgctagccatcatcagcaagtaccaagaagaactaaatctagccacggctcacgagcacaaagtggcggacgagtatgcccaagtgtacgctgaaaaggaggcttga

SEQ ID NO: 47728 - DNA, 210 bp, Glycine max
  Peptide Sequence Number=SeqID_139413
atgacatgcctttccaaagacaacccgataaggagacattcctatgggtgctttgtaggcagtccgatgtgcccagagagcgtcatcaagcctggtactccaatctttcctgcttggctgcacaatcttcacagcaaaacacccaagactgaaacagggactttgtttgtatttagattaatgcaaacccaatttaaaagcaagagataa

SEQ ID NO: 47729 - DNA, 192 bp, Glycine max
  Peptide Sequence Number=SeqID_139414
atgtcattgcctagcgctgttcatgtgtcctccaccttcgagtctggagccccgcgaatgtcattgcctagcgctgttcgccaattctccattctccacttttattcggagccccatgaatgtcattgcctagcgctgttcatgtgtcctccgtcatcaagcgcggagcctctgcaaaaaaagaaggagtag

SEQ ID NO: 47730 - DNA, 228 bp, Glycine max
  Peptide Sequence Number=SeqID_139415
atgtatcaagcttatttttcgaatgatccgtcacagagtgtagcggtcacagctgcgcgtaaccaccacacccgccgcgcttatgcgccgctacagggacgcgtcgtgccattcgctgcattcagagctgcgcaactgttgggaagggcgatcggtgcgggcctttgcgctattacgccagcggcgaaagggcggatgtgtgcaacggcgattatatgttggcactga

SEQ ID NO: 47731 - DNA, 749 bp, Glycine max
  Peptide Sequence Number=SeqID_139416
ggctacatgccctcacctttagaggactacacatccttgccttcagaggactgcacgtcctcaccttgagaggactaaacgtcctcgccttgagaggactacatgtcctcaccatcagagggctgcatgccctcacctccagaggactacacgtcctcgccttgagaggactacatgtcctcaccatcagagggctgcacgccctcacctccagaggactacacgtcctcgccttgagagggctactcgcccttgccttggggctacacgccctcacctttagaggaccacacgtcctcaccttcagagggctacacgccctcgccatcagaggactgcatgtcctcaccttcgtagggctacacgccctcacctttagaggactacacgtcctcgccaacagagggctacacgccttcacctttagaggactacacgtcctcgccaacagagggctgcacgccctcaccttgagaggactacacgccctcacctccagaggactatacatcctcgccttgagagggttgcacgccctcacctttagagggctacgtgtcctcattttcagtgtgctccacatccgcaccttaagagaatttaaggacggcccaactgtgcgagcacacccagagagggaggctatcacacagctactatgcataccggggcaagatttcacccgtgccgctgcaaagagacgagtgcggatcatgcgcaccaacatgaacactcttacacagatatag

SEQ ID NO: 47732 - DNA, 564 bp, Glycine max
  Peptide Sequence Number=SeqID_139417
atgacattcggggctccgaaaaaaacgcgcgagggagaaggcaggtttgcagtattgggcgctcttccgcttcctcgctcactgaactcgctcaagctcggtcgttgggggaggatcagctcactcaacaggctaatacggttatccacagaatcagggccgaaacgcaaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaa

SEQ ID NO: 47733 - DNA, 484 bp, Glycine max
  Peptide Sequence Number=SeqID_139418
aaacgggcttcagtcttttgaggtggttagcgttgcctctgtagattccttctctgggcaaccttacctgtccaatgcggcagtaatgatggcccgagtgatgttggggaatggttacgagcccggaatgggtttaggcaaggacaacggcggcataaccagcttgataagcgctaaaggaaaccgtgggaagtttgggttaggctataaacccacacaagcggacataaagaaaggcactacaggagggaagagcggaggtcaaggctcgcgattgggacaagaagtcaaaggaggcccgccctgccacatcagtaggagctttataagcgcgggtctaggacacgaaggccaagtcgttgcgatatgtgaagatgattcgccaagtgggtcggagttggtacgaccatgccctcctggtttccgactaggaaactggcgagtggaggaacgcccggacatttacgcaactagcataatgtaa

SEQ ID NO: 47734 - DNA, 756 bp, Glycine max
  Peptide Sequence Number=SeqID_139419
atggctcccgaagaactagagcaactaactcaacaaatcagggaccacctaaaggagttgatcacaaaaaaagtgactcgacagcggatgttatccttcaaccagatgcagtctcagtttcaatcacagatgcaatcacagggacttgcactgcctccggagcctgaggttggtccctcagttgctcgtgtcatcacaaaggggagttgtgttgatccctcagcgacagatccaaacacgggtgactcagacaaatgcgggttatacatcgaagaaaatccttcttgcctggtagttgtgtcttctagcaaacctgcagataggccggatcctgagcatgaagatctatctgaaatagcacacggtggtcaatgtctcagcatctctgttatacagttgtggattatgcatttgactgagacaagtatgtgcgcggggaattcctatgtgtatggattccttgagccacagtccattcagagatctgggcaatcacaatttgaatcagaaagttacatgaagagttggatgcaaaattcaaaacgcgatgtctgccttggagcctacctgaatgggccagacaactaccttaaaggaataattaataggtcagtgttgttttccaatacatttgcattagcattactcaacaacatcaatatcttaatgttccttgtattcaacagtgctttgaaaggacttgatgatactccacaacctaaatccaaggttggtgctaggtggattgttgttaag

SEQ ID NO: 47735 - DNA, 207 bp, Glycine max
  Peptide Sequence Number=SeqID_139420
atgtatgatagcacgggattcccttttgaatgcaagtatgtgcataatgtaaatagcttgccaatatgcgaaatggccccgaggaagcttgcctcaaagagatctaggaaggataaagtggctgaaggaaccagttccgctcccgaatatgacagccaccgttttaggagtgctgagcaccagcagcgcttcgaggccatcaagtga

SEQ ID NO: 47736 - DNA, 173 bp, Glycine max
  Peptide Sequence Number=SeqID_139421
atggcatgcaacctttgtttgaccgcttcaaggtacttggcacctgtcgcaacattcccttttgcaggcgagcaaggcgaggctcacgggtgcgctttccaaaggaggaaagatgcgcggagtcgccaccaacgtttatttgtggaaaacgtcgggaaaaccgaaggaaaccg

SEQ ID NO: 47737 - DNA, 288 bp, Glycine max
  Peptide Sequence Number=SeqID_139422
atggcttctataattggagatgctactccaccatctccaaaaactgcaaggctcatggcgaagatgattaaacttggtgatcaaatgagaagcatgagttatgaagatgaagaaaggatggagagaatgataaaggagaatgatgagagtttgggaagaatacacaggagtagtgaagctttaagtatgaggggtatgaagaggatgagggaggaaggaggaactaggtataaggagaaaagaaatcatagaagctatggaggtaggcaaagagaggaagggatttag

SEQ ID NO: 47738 - DNA, 270 bp, Glycine max
  Peptide Sequence Number=SeqID_139423
atgggtgtggtccttccttggataagacctttggagcttgtccataagctccctttcatagtaggagggaatgtgcctcttcctaagggcactcttaagatcattccaatactctactggaggatccccatgaatcctacgttccctaacaagggaagtccaccaatagagggcatacccttgaaagctaagggtagccaatggaacttttctctcatccctaatatgatggcaagcaaagagttgttcaaccttcatttcccaatctaa

SEQ ID NO: 47739 - DNA, 393 bp, Glycine max
  Peptide Sequence Number=SeqID_139424
atgcatttagaagccaatatagatgcaacagacagagaagaaacttcagcttctgcacagtggatccttgatattggtgatgggattgttgggcagcaaaatgatggttatggttcaattgaaattccaaaagatctattaatcacaaaatatgatgacccactatatgcaattgttaattctacatttccaaatttatctcaccatcataacaatcatgaatactttcaatctacagcgatattagcttccacaaatgaaatcgtacaacaagttaatgattatatactatcattgatcccagctgatatcatttctggcaaaaatattggtcaaaatgtttatattccaagaatgtctatgtctccttcacaattccccatggccttttaa

SEQ ID NO: 47740 - DNA, 66 bp, Glycine max
  Peptide Sequence Number=SeqID_139425
atggaagagaaggctacggagatttggatgaagccacttccaaagagggaagataagtcagggtag

SEQ ID NO: 47741 - DNA, 656 bp, Glycine max
  Peptide Sequence Number=SeqID_139426
atggtcatagatcagtcccttttctttgaactcactcaattatccagtgacggtgtaccatttgagggtacacttgatgatgagtggaagttcaatttttgtgtttctgatgcccgccagatggtttgcaccaaccaagtggatatgactggaaggcttcttgctggttcattggcattcgaatgccgcatcatacacttcttgattgtgcgtatcctactccctagatcatccaatcttgcacatgtttttgaggaagatttaatagttatgtgggttttcttaaccggtcgtcaaatcgattgggcccatcttgtgagatatcgcatgcataaggcattgcgatcaaatgctccacttccatatcatcatttgatcaccttgttcttacaacattttaatgtccctcttgactctgaaccttttgttaaagtcaagagatctttctctatcggtgagaatgtggtctcctcttttggataccgcaaagagagagatgtttcttgggtgaagaaagacgcttcagtacaggtcgttgaagaccgttctccatcaccacctccgcacaacattcttgacaggttggatggactccacaccttcgtctgtgaatgctttgactcattggacagtcgtattgatgtcatggatgcatg

SEQ ID NO: 47742 - DNA, 651 bp, Glycine max
  Peptide Sequence Number=SeqID_139427
atgtcgccgccaccatgggaagctctcatcctcgtagccacttaccttgaccccaaaaccctagccatggcctcatgcgtctcaaagtcatggttctcttccatgtcctctgacatcatttggaaacccatattagccacccacttcccctctctctccacccttccctcctccgcccccactgtcgcctaccgccgtctattctcgatgggccacaccgccaccacgcaccgcctccggggaccctcgaagccgagcctctcgctcggtgacctcgtcttcgccgtctccatctgcacgcgcgactctaacattgtctccattgcgagcccttgtgacgcgctgcgcgtggacgcacctggggtgtttcgcttcggcgtgggctgcgacggcgccgttttgagggagggggtggaagaggtgaggatggcgtggaacgtggtgttgagagggtggcgaggggttttcacgatgatggagcgcgtggggaaggagctgccagcgccggggtgttgctccggtgcggtggagagtgcggtggtggcggatttgaaggtgaggatgtgtggaggggaggataagaatgtgaatggggttagggtgaacgaggctaaagtatatctgaaggattttgagttttctaatgcctag

SEQ ID NO: 47743 - DNA, 109 bp, Glycine max
  Peptide Sequence Number=SeqID_139428
atggcgactaagatgaagcgatgtctatttcaagccttaggctcgatggctccgatcatgtctatgcctcacatagagaatggccaaggtgttgccaagacgtttaatg

SEQ ID NO: 47744 - DNA, 304 bp, Glycine max
  Peptide Sequence Number=SeqID_139429
atggaacttcaacgacttaatcaaaatgaagaaactaacaaaaagaaaagaatcatagcacttaaagcctcctcatcaatgcaagaggaaaatgaaaaagaagatgaagaagatgaagaagacttctcactatttgtgaagaaatttcaaaaatttgtcaagaagagaagaattgagaggcgtcaaaacttcaacaatggaaaaagatctcaagaagattctcaaattcttatatgctacaaatgcaatcaacttggtcacatcaaagctaattgtccctcaaatgaggaatggcctgagaaaa

SEQ ID NO: 47745 - DNA, 609 bp, Glycine max
  Peptide Sequence Number=SeqID_139430
atggattggtcacttaggctaactgatgcaatcctacccccaaggacattggataaaagactccaagaagattgggtcagtgatgcaagagaaggccctagggttctcatgagtcttaggcaaaggactccattgatgaagaagatccaaggcgttacaagctccacatggagctacgtcactaactccaacaacacatttttccaagggtgttgcaaaaaggtcaccaaagaggaaaagctctataaaggagaaggcctcaaaaagagcaagatcatttggaagtgcctggaggagaaggatgatgagtacaaatccaaatccttaaccttttttggaaggattatgcactggaacaacatgcattttgtgtttccaagtgttggtacattccaagaagtgaatgatcatgatttgttggtgatctactacctctggaagaagatccctctcagcttgccctatttgatcatcaatcacataatcaaggccatcaagcccatcaagtctacttctggtgtgccttatgggattctgatgaccctgatcttcaagcactatggagtgctcttggaggatgaagccaaggatgaagaagtgttgacctga

SEQ ID NO: 47746 - DNA, 387 bp, Glycine max
  Peptide Sequence Number=SeqID_139431
atggaaactcatcacggaggccagtggaataaagcgtttttgcccctactcttattactctccgtgttctccaccgtcggatcatcatcatcggccatacgtttcagattggcacctctggcacgaggtgccgcggagaggcaggttcccatgcaagcgggtgcacccttcaagattgcgctgttcgccgacctgcactttggggaggacgcgtggacggactggggcccacgacaagacttaaactccatcagggtcatgagtacggtgctccacaatgaaaatccagggggtttgtttttgaagggaactcaccaatggagttggcgagttcaatacgtgacagcacctagtgaacttgttagtggagatggcgagtccatgtga

SEQ ID NO: 47747 - DNA, 1170 bp, Glycine max
  Peptide Sequence Number=SeqID_139432
atggaaggcaagactgaaagtcatatgacatcagcagcagcctttgtggaagggggggttcaagaagcttgtgatgatgcttgcagcatatgccttgaggatttttgcaaaagtgatcctgccactgtcactaattgcaagcatgagttccacctgcagtgcattcttgaatggcacgttttaatattttttcatgtgtcagagaagctcccagtgtcctatgtgttggcaacctatcagcttgagggatgctaccagttgtatgcatttcatcacagtcaagagctgcttgaggcagtagagctggagaggagcttgagagatactccatcaagaaatgctgcgatttttcatcatccaacacttggtgattttgaattgcagcatttacccatgggtgtgaatgaggccgatattgaagagcgaataattcaacatttaactgctgcagccgcaatgaggagatctcatcacctcagccggagggaaggccatcgaactaggccatctgctcatggccgtccacacttcttagtatactcaactcagcctagtgcaccaccatcagctgcaggagggggaagtgaaccagctgcaattcctgtaggaagtccatctaccccacttacatttgatggaaatgagcaatcatcactacagcagatcccccatgttcaaactcagagttcttctttaacttctgcctctactgtctcaacaacaaatcttcaaggagttcactctgatgatagaagttttgcctctcattcttttcctgcaagccaagacagagcacagccatcagaacaatcattctctgattctctgcgctccagatttaatgcagtatccatgagatacaaagattcaatttcgaagggcacaaggggatggaaggagaggctcttctctcccaattcttctatgtcagaacttggttcagaagttaggagagaattgaatgctaaaattgctagcgtgtcccgattgatggagcgccttgaaacaagagaaaataatagtgctgcaggaacttctttatcaaatcatttggtgaaccgttccattgcagagacaagcaaccaaagcaatgtggaagctcgtggagagaactctttgcatggcaataatactccaactactttttctgcaagctcagattcaaaatga

SEQ ID NO: 47748 - DNA, 273 bp, Glycine max
  Peptide Sequence Number=SeqID_139433
atgcctcctcccggtaaagatcccaaggggaagcaaaagcacaaaaaatggagccaccgcaaacaccgaagtggttcaaaggaaccttccgggcaccaggagggttcctcatgggataaaaagctcaagtctcaagatactgagattgccaggcttcggttggccttggctactactgacaaggaaaaggaagaggcgctactgatgaggagagaatttagcagaaggctttttgtaacgacctgcctcgttgctacaacaccactactctaa

SEQ ID NO: 47749 - DNA, 464 bp, Glycine max
  Peptide Sequence Number=SeqID_139434
tcagagggctacacgccctcagctgtagaggactacacgtctttgctatcagaggactgcaagtcctcgcttttagaggactacacgtcctcaccttcagaggaccacacgttctcactctcagaaggctacacgccctcaccttcagaggactacacgtcctcgtcgttagaggactgcatgtcctcgctttcagaggactacacgtcctcaccttcagaggaccgcacatcctcgcctttagagggctacacgccctcaccttaagaggactacacatcctcgcctttagaggactgcaagtcctcgcttttagaggacttcacgttttcacctatagaggaccgcaggtcttcgccttcagagggctatacgccctcaccttcagagggccatacgccctcaccttcaaaggactacatctcctcgccttcagagggctgcacgccatcaccttcagatga

SEQ ID NO: 47750 - DNA, 501 bp, Glycine max
  Peptide Sequence Number=SeqID_139435
atgcaccatttgataacaacgttaaggttgggaccttttgtcaacaacctatgcataaaactagcatctgacctcaacaagctacggaggagaacagctaagtacgtgaagatggaagaactggccgagtcagtcagaacggaagaggagtcgaagccacttgagggagagaaaggaaagagccctcgaccaaccaaggcgagtcataaacaccattgtcgaaggtttcgttgggggagaagccatcgcctctggcgaaaaaggcacatggatatacctgaatctaaaatcctcccacatgatgacccactgttcgattctgctaaggaacagtttgcagtagacatgcccaggatcgatcaaagctttaaagatgcaaagcctattgcccagagaaaaagaaagataggtgaagagagatctcaatcaggcatgctcgaaggatacatacccattcctgaacatcgatcgcctggtcaatggagcagtcggacattgtaa

SEQ ID NO: 47751 - DNA, 663 bp, Glycine max
  Peptide Sequence Number=SeqID_139436
atggaatctgaaaatggagttgctatggaggacgagaaacatgtcattggggaaacaaccaaggagaacataaacaaagaagctgaaaacagttgtaatgctgaaattcagaccaagaatgaggtatctgaaactgatgtaaaagctgaagggcccaaatctgcagcaagtaaaatctcaaaacttgccaagggacatgttggcaaaggtggtgttgcttcaaagaacaacaaatctgccaccaaagacaaacccaatttgaagtccacaacttcatatcaaacacacaggccaaacctttccaagagcttttctttcccagccaaatcagctggtggagagggcgtgaagaaaagcactaatggcactctcgcgaagacagaaactaagcatgctaatggggctaaagctgaggcttctattcgccgttcaagcaggctgacaaactccgaagttaactcaaaggaggcagaaacaaacactggaaattctaatcagaggacttctttgacatccatcactagccttaaaacctctgagcttgataacttctattcattcgtctttggtctccatgttcatgactcctattatgtctaccagtctggaatatttacagtgaatgcggttaccaagagccttacatctgaggaatctttgtaa

SEQ ID NO: 47752 - DNA, 153 bp, Glycine max
  Peptide Sequence Number=SeqID_139437
atgtggaccaccacggaaaattgggggagaagcttgccacccagctcgcccaggcgagcagggttgcttcctccagaagcaacagccttctggaggaatcttctggagggcccaagtgggcctggtttctatttgcacccctatttttactaa

SEQ ID NO: 47753 - DNA, 297 bp, Glycine max
  Peptide Sequence Number=SeqID_139438
atggcgtcatcaagtgcaaagaccatggacagattaaagctcctaaccttccccttttggagatgtttagattctttaaccactctatttcccccaccagggactccgacaagatttatcgcatcccattcgtcaaaagcattgttttctaaagaaaaactcaacatgcagcaggggcaggcatgtattcccttggttaggttccctgaccctaactatgggtttttcaaaggaagtgtaaaaacaccctattacagaacccaacacataagagacactcagaggaactcaaactag

SEQ ID NO: 47754 - DNA, 885 bp, Glycine max
  Peptide Sequence Number=SeqID_139439
atggcggtcttttggagtcttcaacttaatcttcccactagcaaaggcatcgaggagctgcttggaatggggtcacaagccatcaatgaatatgttgagctgaaccggctcactaaacccatgcatatgagtctttcggagcaacccatggaagtggatgagatttccacctttccttcgacggtgttggactttggaaagtacttctttaggaacttctccaccacctcttcccatgtccgcagaactcccgcgatcttcaccgtgttgcaaatctcgacgtatgtgacaagtgttaccctccgtgggcgatcttctgccatgatgcgttcttcaaggttggtatgtggattgatcataggaatgggagatgatgattcaaatgatgaagtgtggtatcttctacaggttgcttcaatctctggattcaaggctcctaacaatgggagtttagcctctcattgccatgagaggctttacactttaggggatgatgtggatggaagaagaagagggatggataatggaagaaaggggagaatggttagagatggaggattttccctatttgagaagctcaggctttggcgggtatggcggtgtgatcacgcgctgagcgcggtagcctctgggtttagcgagtatggcaacgatcatgcacttagcgctggattcacgctaagcgcacctttgggcttcttcataggcctttttcgcattaagcttgagctggccactaagcaaggagacgcgctaggcttgtcttgtgtgctgagcgagctgtctcactcttcaactttttcttcaaggcttcttcttcaagtttttgcatcaattttccttcaaagcacttgtaatcttccttcttttgactcctgctggtaa

SEQ ID NO: 47755 - DNA, 756 bp, Glycine max
  Peptide Sequence Number=SeqID_139440
atggcctcagtcctgtgtgggccatgggtcccaatctccatgcgcgaccgtgagatctgtaacataatcagtgtttgtccagcgtctccagtgctagaggtactctacggcatctgcacaagcagctctgactgggagaaggaagaaggagactggctggtggtaggaggagggactgttggtggcagaacaggtgatggaggggctggtgttcttctagatgtaggccaagttgatcacgaggttcaacaactcaaaggtcagggtgtcaaaagtgaccccttgtgcatcacaaagagccatgatcaatgcgggaaaatcaagttgggaagtgatggactaggcgatctgtgtgaaaggtgggggagcaaggttgaagtagctcaggatgctccatgtctaggccaatgtggtactggagtaagtagggtactcctccccctctggaatgatggcaggggtctccagaaagtcattcaatgtctcaacatcaaattgaatgactttcccttgcactcaatagtgctttggtgcaccgtcatctgggtcataggcattctcataaaagtccctcaccagagcaacgtcgatcctcttctttgggaggcgtataagccatctctaccactgtctcctttggagctccccatagaactcgtcgtacatagtggggtgagctccacattcctctccgaaaggatgttctggaggaggagtcccatgtgggctccccctcctgaggctggctggacatga

SEQ ID NO: 47756 - DNA, 483 bp, Glycine max
  Peptide Sequence Number=SeqID_139441
atggaggaagcattgcaactgtcacgcgcgaaggacataaaagagaggatggcaggcatggagcgcctccaccaacttctagaagtttccagaaaaagcctatcctctttcgaggtcacctcgctcatcaacacatttatagaactcctaaaggataacaacttccgtgtctctcagaccacacttcaggctctctcctctgctgccatccacattagcgaacactacaagctccacatcaacaccttcttctatgtagttttcaaccaccttggcgacaccaagcagcccattcgcgctgcgtgttgcctcttgctcactctcatggagaggttgaagtctaacatgggctttgctgtgaacatccaacttctgtcagggtctcttgcaaatttccatgtttgcactacattgcttaaacctcatgaaagaatcatggcacttgatcttccttatggtggccatctttctcatggatattag

SEQ ID NO: 47757 - DNA, 831 bp, Glycine max
  Peptide Sequence Number=SeqID_139442
atggatagtacgcaagctgaatgtagtcatgttgttactcagatttcttctcaacatgttatttcaatctcagatgctttgcttcagagtaaaatgatgaccctagcagatcttatggaggctactgaggtttgtaatggaattgttcttgcaaaagtaatagctgttgaatcagagaatggatggtcatatcaatcttgcaccaagtcacgcgatgaagaggtactccattccagtggcgctatccaaggctctgcttcagttgatgcatttgaatttgtcgtaggactcatcttcggtgtctttggaagctatttatgcttcttcttgttgttggttttggaacacagtggtgatggtactgaaacgcgtgggtttgtggcgagtgactttggcacacgcggtgccaggtttgccatcattgacaaagatgggagaattcaagctgaggctaagagagagtaccctatctacttggagacattgttttctctgcttcaagatgtcccacttcaccttcacaagcacattgtctccatttctattgatgggacttctgcaactactatcattgttgatagaacttgtaaaaggattttacaagatagtggaactctcaagcgggttgcttggggactggacgtaggcacaagggttgtgaattttgagtatgttgatgaggctaaggctacagcagaggaggcagcacaaaaaagagcaatggagacacttaacagttcaaaaaggacacatttctgggaggagttgttaagagacaagtatcaagagcataaagttgaggagtttaatgccttgggcaagagtaagtga

SEQ ID NO: 47758 - DNA, 258 bp, Glycine max
  Peptide Sequence Number=SeqID_139443
atgggggaaaaaagagggtctgttgtttacgatgaaacccccaaacccgccatcgagtccatgtcggtaatcaaaaagttcaggaagcttttgttgctcttcaatgaggctctcttcttggttgaattcgaactctggaatcacggcaagaaattaagtttcccgaatagggtttcgttggtcacgaggagaaggttcaagaacaatggtgaaggatctcctatatatgcaagaaataggaatggaaaaggacgctaa

SEQ ID NO: 47759 - DNA, 831 bp, Glycine max
  Peptide Sequence Number=SeqID_139444
atgactaagaaattgccctattatcttgaattggttcgagtgttctataacaacttggaaattcatgaaggagtgatattttttgaagtgcacaaaatatcaattgttgttgatcaatccttgttttactccctaaccaaactgagcagtcaaggtgtgacttttgaaggaactttagttgatgattggaaaccaatttattctagtcttgatgcccataaaatggtttgtgttgcaaatgttgatatgtccagtcgcttacttgttggatcctttacctttgaatgtcatatcatgcattacattctgtatcgtgtgttgcttccttgttctactgaccttggtcaagccactgaggaagacttaattttgatgtgggcactacaaactggatgccaaattgactgggcacatcttattcgttactgtatgcacaatgcattacgtgcaaatgcccctctaccatatccccatctggttactctgtttttgaagcactttaaagtccctcttactaatgaaccatctgtcaaggttaactgttcatttgcaatcagagccgttgtagttgctccttttggttataagaaagatcttgatggacaatgggttcgtaaacatgattaccagacaaatgctcccaaggaacgcactccatctccaccacctagggatccctcctctactttactgaatgatgttctcaatgagatttgggatcttcgcgcttttgttggcaaaaggtttgattccatgaattctcgtatcactcgtcttgaggatgacatgggatttacccgccgttgctttgatccgccaaccgatccttag

SEQ ID NO: 47760 - DNA, 238 bp, Glycine max
  Peptide Sequence Number=SeqID_139445
aggaggaagaagttccgaaataagaatattggatttccggaagtacttcttccggaagttgctaagcacatttccggaagaagttgttccggaagacactttcggaactacttcttccggaattggcgctagcaacttccggaagaagttcttccggaagttactaaggcccattccggaagaagtagttccggaagtggaattggccttagcaacttctggaagaagttctttatga

SEQ ID NO: 47761 - DNA, 643 bp, Glycine max
  Peptide Sequence Number=SeqID_139446
gcgcacatgaagggaatcacaggagcaccttacagggcatgttgtgatgctttgaccgtcacagatgtgtcctggtttccgtacactgagcatcggggggttaaggcctttgagctgatttcatcattccatggtcagctgagattgggtcctatggtggtcacagctcgaccggagagggtggtacgacagtttggttacatccagagcatccctccgccgcctgttagtgctcgattgtcacatgatgatatagatgacaagtggatgcattttgcggagcacgtactacctgcagttgagctttgtctagtgcctgggcaggtatctgcagattacatggagtggtttttccgcatatctcacccattcatgataccaaccgaggcaggtgaccagccgagagatgcactagccgcagaccctgaggagtacatacagctgcccagctcccaagttccagtggcatttgacccccctccacatgtggatgattacgacgaatatgaggcgattgcacagaggttggagcgtgtgctcaaccttaggatggtcactgcaggcacagagttatatgagattatgcaggactgtctgacgatcaccagaggaagagtcagtgctgatggaagtgtcagggctt

SEQ ID NO: 47762 - DNA, 318 bp, Glycine max
  Peptide Sequence Number=SeqID_139447
atggttacaattcaggtttcagaggatggagaagggattgttgaggtcgaagaggagcaacacacaatgtcaagtttccctctttgtccacacccaaagcagcatctccaccttcccttgttgattggttacaaatgggtttacaagatcaaggagaatctcgattattctattaaaaaatataagcaaatgtggcgtaatgtcaatggagacattggcagtggtgacaagcggaatggtggcgatagtggtggcggtgaccacaatggtggaatgatggtggtagcgatggtgaaagtggtgataatggtgaaatga

SEQ ID NO: 47763 - DNA, 537 bp, Glycine max
  Peptide Sequence Number=SeqID_139448
atgtatgtccaccttctctcaagcaacgatcctcaagagacgtccttaatttctttcagtgctgaatcagaaggagaaggggagcttgatgataagaaagctgactatgatgttgaggttaaaggggttgaaatatatcctgatcccatcgcacgaggccagcctgctacattcagcattgctgcaactacaggtaaagcgttatctggagggaagctagcgattgatgtgtcatatttcggatggcacatacatagtgagacccatgacctttgtggagaaactacttgccctgtttcagttggtgattttgtgattgctcattcccaagttttaccaggattcactctacctcacacagctctgttttctccgaatgtcatgagcatgtctgcttacatgtcatctttcccttggagaggtttaaaggtttcatactctttgaagatgaagatgttcgatggaaacaagcatgagttaactaacattacatttggttttgatattgggtttggttcttctgtggctgatagctaa

SEQ ID NO: 47764 - DNA, 222 bp, Glycine max
  Peptide Sequence Number=SeqID_139449
atgggagagcactcgggccttgtccgtgcagctggagtcggtgtcacggttagacaatactttggattggctttagcaagttcccacacgtctatgtcgatcaaccccgaagagttggagcatttgacacaaaaaatcagggaccagctggagcagtcgaccattgaaaaagtgactcgacaactaatgttgtccttcagccagatgcattttgagatgtag

SEQ ID NO: 47765 - DNA, 648 bp, Glycine max
  Peptide Sequence Number=SeqID_139450
atgagcaacaagcgtaaccttcaagttacgttctcaaagcgtcgcaccggaattttcaagaaggctagtgagcttaccaccctttgtggcatgaatcttgctgtaattatgtcctcacctggtaatcgggttttctccttcggcagccctagtgtggattctgttattcaacactacaccgcacagggcccacctcccctcctcaacctagagctgaatgaggcctccatagacgagcatgagctccatgtgcaccttaacaacttgtccgaccaaattgctgcagagaagaagcacaaaaaggatctaaatcgtatgttgaatgctgcggaggaacacgtttggtttgtcatgccaatcaaaagcatgaatgatgcccaactagagacgtataagaaaatgttggaggagctaaagacgtatgctaatgaaaaacgtgagaagctcctccagcgccttcccaacacctctatgggagtagccacactgacccatgactttagcaagatccatggcacaaaaggtggtaaactcacttgctttcttgaaatccctcatgtaacactttcagaacgtcacctgaagaggaaaggctgggttcaatttagaggaatactcacgtttggcaaacaaaacgcgccattatga

SEQ ID NO: 47766 - DNA, 153 bp, Glycine max
  Peptide Sequence Number=SeqID_139451
atgttcttctttaagaatcctgagggtatgtggatcccatgtggaccaaagcaacagggtgcaatacaaacctcaatgcaagagcttgctgcaaaaggacttgcttttaaggttgttatatctctaattgaaactggggaatgcttaccataa

SEQ ID NO: 47767 - DNA, 1572 bp, Glycine max
  Peptide Sequence Number=SeqID_139452
atggttagaacacgaggtctgcgtcgtgtggtaggcacaggtagaggcagagaccttagtcaggatgtggctgaggatgttcctcgccgtcgtaggcccactgcctcagcacgtaggcaacgggttacccagagagtcgaggatgttcctcagttggctgaggatgtgcctcatgcgcctgatggtagcccagagaggacaggagccgccgatggtgctgagtctgatcgagtggctagtgatggaacaactgctgatgatgaggggttccccagtgggccacgcgatccatctgatttgataggatttgctgatcatgtggcacacaacatatggagtggacaggagcgacccgatctcaagtttgtctcccatggtaggaaagtagataaatttgggagaccggctgctgagatcgaaggtatgattgcgaccaccggattggatccattgatcaggtgttctatgattactggcgcgctgcattcattcgagccgctggctacatctgacgcagtggccctgttgatggaactacttgaggtcaccccagacgaggctccagctgagacacgtcaggcaggtgggcctcatgttcagttgtcctggctttgggacatgtaccagactcgggtgtacctacttcatttggttggttgcactcttttcgctaacaagagtgcaacccatgtccatgttgtgcacctacaggcattcagagacctggcacaggcagggacattctattggggagcggccgctttggtccacttgtacgatcagcttaacgagacgtcgcgggcccttacacggcagatggctggttacatttcactacttcagtgctggatttacgagcactttccatcagtccacaggtctgttgttgacgatggttatgctgaggctagcccacgtgcctgtaggtggcttacatgtaaggcccatatgaccgggattaagggagccccttatagaacacgtattgatgccctgacagtcactgatgtctgttggatgtcgtatgctgagcattggggagttcggggctatgacttgatctcctcgtacatggggcaagtcagatggggtccgatcatcgtctaccttcgaccagagagggtggttcggcagatggggtacattctgaccgttcctccaccatcggttcgtgattcgttgacatgtactgatatagatgaccggtgggtacaattttcagatcatgtagcgcctacaggggagctctgtgtagttcctgggcaggtggccccagactacatggagtggttttttcagatttcgcacccctttgtgacgtcgacggaggacactgttgagctgagacctacgcctccccctcccactcatgatgatgacttcgtggagccacctatcgccgaggttccagtcgcgtcagatccccctacgcattctgtgcgcgtcatcaacctcaggatggtgactgcagggactgacttatatgatatcatggatctttgcctgaggatagctagagatgacgacccagatgacagtcttaggtcgcgacagagagcccgcatagattag

SEQ ID NO: 47768 - DNA, 375 bp, Glycine max
  Peptide Sequence Number=SeqID_139453
atggccaaacttggtgcacaaccatatgcatcccttggttctgaccttctctacggtcgttgcccttccttcgacaaatcctcttgcaatggtgttgataacacatctaggttggttgagggattttgcttccctttctctagaccggctttggctcctatgtctttcagttttgggagcacggtctcggtccctacccttgttagggtcttgcctataagtattattaggctaataggattgaagtttatgaataaaatccttcaggtgtctgagtttgatgaggtcttcaatcttgtttttcaaaacactacattcctcaatggagtgtcctcggttgcaatgatatcgtcaacgcttggagaaatcggctag

SEQ ID NO: 47769 - DNA, 142 bp, Glycine max
  Peptide Sequence Number=SeqID_139454
tggcgtctcctctctctcttcctttctccattccgctgccattcatcttccaagaagcaaagggaatccattgatgaagaagatcctaggcctacaagctccaatggagcttgcatcaggaaggagagagagtttaaactag

SEQ ID NO: 47770 - DNA, 348 bp, Glycine max
  Peptide Sequence Number=SeqID_139455
atggggtcctacggtggtcacagtttgaccggagagggtgctatgccagtgtgggtacatttagaggatccctccgccgcctgtatctgcggattacatggagtggtttttcagatatctcacccattcatgatacctacccaggcaggtgaccagcccagacatgcacctggcccagaccatgaggactacatgcagccggacatcccacaggttccagtggcatttgacccccctcgacatgcagtggatgattacgaaggctatgagacgattgcagaaaggttggagcgtgtgctcaaccttaggatggtcactacagggacagagttacatgatatcatgtaa

SEQ ID NO: 47771 - DNA, 828 bp, Glycine max
  Peptide Sequence Number=SeqID_139456
atggcgatgcaaaccgtttatctgaaagaacatgaaggacttgtccacagttctgttgggcagttgtcatctgtaacttcagctccctggtggagtgccttaggatctcaaccagtttacggggagtattgtggtcaaatgaagtccttttcattggagatttccaactatgtggaccaatttggtgctggtaagcaagcggcacgaggagttgagcaattgttggataaaggacatacaactcagtttaccatctttccaggaccaacttacgtaaatgctaagcagtaccatggaattatcagacgtaggcaatcacgtgcaaaagccgtacttgagaacaaaatgataaaacgtcgcaagccttatatgcatgaatcacgccatctacatgcgacgcggcgaccaagaggatgcggtggtcgcttcttgaacacaaaaagctctactgatggaaatggtaaaaatgaaagtgaagtgattaaaaccagcggccgacaattccagtccagtgcctctcagagttctgaagtcctgcagtctgaggttggaatgttaaattcatcaaagcagacaaatcgaagcagtccaaacatctctggttcagaggtgactagcatgtattcaagggaaggttttgatggcttttctgtcaatcctcttggatcttccgtccactctctagcagacatgataggtagtgagcatggtatcattaggcccactaaatgggttgcagcagtaccaggtgaagaagttctttttccgtttcctgtgttcattgtgacgaattttgttttggaggcgtgcctctacatctggttttag

SEQ ID NO: 47772 - DNA, 918 bp, Glycine max
  Peptide Sequence Number=SeqID_139457
atgaacgacttgttctccggctccttctcccgcaccaatgaccaagtctcgccggaccaccaccatgtgatcgagatggcggccaccgcatcgccaacggccgagggaagcgtgaatctcgaaaagttctttcaagaagttgagcaggtaaaagaggagctgaaggagctagagcgtctccatgaaaatctgcgtgggtcccacgagaaaagcaagatccttcacagcgccaaagctgtgaaggaacttcgcttacgcatggacagtgacgtgacacttgctctaaagaatgcaaagctcgttaaggttcggcttgaggcactggaccggtccaaccagaccagtcaaagcttgcctggttcgggacctggttcgtcctcagaccggaccagaacgtccgttgtgagcggactgaggaagaagctgaaggactcgatggacagcttcaacagcctcagacaaaagatatcgtcagagtatagggaaaccgtgcagcgtagatattatactgtcaccggagagaaccctgatgacaaaaccattgatctccttatttctacgggtgagagtgaaacattcttgcagaaggcgatccagcagcaaggtagagccagtgtgatggacacgatccaagagattcaagagaggcacgacacagtcaaggaaatagagagaaacctaaacgagctccaccaagtgttcttggacatggccgtgctggtgcagtcccagggcgaacaactggacgacatcgagagccacgtggcgcgcgccaattcgtacgtgcggggtggggtccagcagttgcacgtggcaaggaagcaccagaagaacacccgaaagtggacatgcatagccatcatactgctcattattatcatcttgattatagtcctccctatagttctaagaaattga

SEQ ID NO: 47773 - DNA, 2748 bp, Glycine max
  Peptide Sequence Number=SeqID_139458
atgacttgtgtggaaattggggatggtgatggcaggctaaaaatgtatgtaaaagtggcctggctgggatttgacactaggatcaggcagttcacaaaaggacttagtgtcactagctcttggtgctgtacttggtctggccaattttttggctaccctaaggtgcatattgtacttgtgctactgattaaaatgtccacagacattgagagaagggtaggaaatcttttgaatagctcacagtcaactggggcaacactgtctagtcttccttctatatcagctgaccttggacaaaaacaatctgcagcccctataaaatatgtttcttcacgacagactgattcttctaaggagaaacttagtgttgcactcaaggaaaggcaagaacttgtacaggcaagtgatagtttgaaggaaatgaaatcatttagggagaagcttcctgcatttaaaatgaagtctgagtttctgaaagctgttcaagaaaatcaggtattagtagtttcaggagagacaggttgtggtaaaacaacacagttgccacaattccttctggaagaagaaatatcttgtttgcgcggagctgattgcaacataatttgtactcagcctcgtcgagtatctgcaatttctgttgcagctcgaatatctgctgaaagaggtgagagtcttggggaagcagttggataccaaatccgtcttgaatcaaaacgttctgcagaaacacgccttcttttctgcaccactggtgtattacttcggcagttggggggagaaaaagggggggtcaggggaggttgcatgtctcatacttgtagtaaatataaaaccatttatgaaccttcttctaatagcgtacaagacccagacttgactggtgttagtcatttgctggtggatgaaattcatgaaagaggcatgaatgaagactttttaattataattttacgtgaccttcttcctaggcgtccagatttgcgtctcattctgatgagtgccaccattaatgctgatatgttctctaaatactttgcaaatgccccaacaatgcacataccgggatttacttaccctgtggcagagcacttcctggaagatgtgttggagaaaactcgatacagcatcaagtcagattttgacaattttgaggggaattcaaggaggagaaggaaacaacaggattcaaagaaggatcctttgactgaaatgtttgaggcatatactaattacaaaaattacagcttgggtgttagaaaatctctagaagcttggtcaggttcgcagattgatttgggtttggtagaggcaacaattgagtatatatgtcgcaatgaagctggtggagcaattcttgtatttctcactggctgggatgaaatttctaaactgcttgacaaacttaaaggaaataacttagttggagaccctagcaaaaaaatcgtgctagcaacaaatattgctgagagtagcatcaccatagatgacgttgtgtatgtcatagactggggaaaagcaaaggagaccagctatgatgctctaaataagcttgcttgcttgttgccatcatggatttcaaaggcttcagctcatcagagacgtggtcgtgctggtcgagtgcaacctggagtttgctataggttgtatccaaaactgatccatgatgcaatgcctcaatatcagttagctgaaatccttcgaacacctttgcaagagttgtgccttcatattaaaagtttgcagcttgggactgtaggatcatttttagaaaaggcacttcagccaccagatcctttagctgttaagaatgctattgaacttctcaaaacaattggggcgttagatgaacaggaagagctcactccacttggtcagcatctttgtaacatacctttggacccaaatatagggaagatgcttctcatgggctctatctttcagtgcttaaatcctgccttaactattgctgcctctcttgcttaccgcaacccatttgtcttacccataaacagaaaagaggaagccgatgcagcaaaacaattttttgctggtgattcttgcagtgatcacatagcccttctcaaagcttttgaaggatggaaggaggcaaagcgaagtgggaacgaaaagcagttttgttgggataatttcctttcccctgcaaccttgcggttgattgacaatatgagaatgcagtttctcaatttattatctgacattggatttgttgacaagtccaggggtgctaatgtttacaaccagtatagtcatgatttggagatggtttgtgcaattctttgtgctgggctctaccctaatgttgttcagtgcaaaagaagaggaaaacggacagcattctacactaaagaagtagggaaggttgacatccatcctgcttctgttaatgctgggatctatctcttccctcttccctacatggtgtatagtgaaaaggtgaaaactaccagcatctatattaaagactctacgaacatttcagattatgccctacttctatttggtggtaatcttgtccctagcaaaagtggtgagggcattgacatgcttggaggttaccttcatttctctgcttcgaaaagtgtcatcgagttaataaggaaactacgtggggagcttgacaagcttctgaacagaaaaattgaagaaccaggatttgacgtttctgctgaaggaaagggagtggttgctgctgctgttgaattgctgcacagtcaagtcatgagataa

SEQ ID NO: 47774 - DNA, 6834 bp, Glycine max
  Peptide Sequence Number=SeqID_139459
atgggtcgacccgagccatgcgtcctcttcgcccaaaacttcgttcacccgcatctcgacgagtacgtcgacgaggttatgttttcggagcccattgttatcaccgcgtgtgagtttctggaacagagtgcgtcatcagttgctcaagcagtgacacttgttggaataagtgctaaattaattgctgctgaccttttcagggcaacttcacctccatcatttgcgatagaggtgtttgttcactgtgagggagagacgaggtttagaagactttgtcagccctttctctattcacactcttcgtcaaatgtactagaagtagaggctgttgttactagtcatctagttgtaaggggcagctatcgcagtctaagtttggttatatatggcaacacagctgaggatctgggtcagtttaacattgatattgatgacaatgcgttgactgatcttgttgattctactgaggggaagcttgaagacctgccaccagcattacgctctactagttttacaattgatgattcacgttcatatctgaatgtgttgtctattccagttcctgcaacagatatttctgttgaagtcaatctttttctagggttgatgttaaaatttttggagttttcagatcttggggatgctggacataaaattgtaaatactgtagtgtctgcaatctcttcttacatttccagtgacatatgtgaatcaatcggtgggagatatcagatgcggaagagatctgagaatttggaagagttgcacattgttgttgatgaggcaagaaaagagcttcttgaggtttataaggttcttcataaaaaatttaggagtgaatcttctgagtgttcatcagatgcctattatcttgaaatggatgctgaaatgttggattccaaaactttggtggatatgtttaaccagtactttcattttcaaaggaactcttcctgtataggagatcactgcctttctcagagtgagcatgccctattaggattgagcatggcttatttgctttgttctggtagaaagagtggctttcaatttgttagtagtgggggaatggagcagcttgcattgtttttttccaaggatgggcaaaattctactactattatgctattgcttcttggtgttgtagagcgggctactaggtattcagttggatgtgaagcctttttaggttggtggccccgggaagatgacagtatcccctctagtatcagtgaaggttatagtcatttgttgaagttgatattatcaaaacctcgtcacgatgttgcttctcttgcgacctatttgcttcatcgcttacgattttatgaaattgcttcaagatatgagtctgcagttctttctgtgctgggaaacatcagtactgttggcagggttacagatgttacattgaatatgctcagctcttctgaaattctgctcagaaagctcctgaaattgataaattcacgtggtccaattgaagatccttctcctatagcttgtgcaagcagatcactgattactggtcaaacagatggattgttgtcatataaaacaacttccagcttgattagctcttcaagttgttgcttttcagattgtgatattgattcccatttattgggacttttgaaggagaggggttttctttcattatcaactgcattgttgtcatcatctaaactgcgcatggagagtggccatgcaatggaaatcttcatggatgtcacgtcatccattgaggccgtgattctatcatttcttttttgtcgttcaggcttgatattcctattgcaggatcccgaactttctagtacattaatccatgctcttaggagtggtcaccgaggcaacaaggaagattgtattcctcttcgatatgcctccattttgatttcaaagggtttcttttgtagtccactggagataggaatgataattgagatgcatttaaaaatggttaatgccattgatagtttgctttcatcgaatccgcaatcggaagagttcttatgggttgtctgggaactctctacgctctcacgtttaagttctgatttaaacctgctgatgatttgtagatctgattgtgggcgccaagcattattggccttaggaaattttcctgaggctgtttccatcttaattgaagcactaagttccttcaaggaatctgaatctgttgggaaaaacagcggtagtcaatggtctaaattgcttgttttaactctactgcattcaggatcttcagcggtaaatcttacaatatttcactcagctgctgagatcattgaagccattgttacagattccacagcatcatctttgggttcatggattggacatgctttggaacttcatagggctttgcatttctcctctccagggtccaacagaaaagatgctccctcacggttgttggaatggatagatgctggcgtagtataccacaaacaagggggtattggtctcctgcgttatgctgctgtattggcttctggaggagatgcccagttaactactgtcctagtttcagatctgactgatgttgaaaatgttgttggagaatcttccagtggctctgatattaatgttatggagaatctgggaaagtttatatctgaaaagtcttttgacggtgtcactcttcgtgattcttctctggcacagttgactactgcattaaggattttgtcttttatttccgagaacccaactgttgctgcaactctctatgatgaaggtgctgtaatagttatttatgccattttagtcaactgcagattcatgcttgagaggtcctcaaacaattatgattaccttgtagatgagggtacagaatgcaatgctacttctgatttactactggaacgtaatcgtgagctgaacattgttgatcttttggttccttctctggtgctattgattacactacttcagaaattacaggaagcaaaggagcaacaccgaaatacaaagttaatgaatgctcttttacgattacacagcgaaataagccccaagctagctgcatgtgcagatgacttatcatctccatatcctgattatgctattggttatggagctgtctgtcatcttgttgcatcagcacttgctttctggccagtacatggttggagtccaggtctttttcacacccttctcgccagcgttcagagtacttcattgttgactctaggtccaaaagaaacatgcagtttgctctatcttttgattgatttatttcctgaagaagatatatggctttggactagtggaatgcccttgttgactgcacggagaatgttggctgttggaaacattttagggcctcaaaaggagaggcatgtcaactggtatttggaatctggacaccaagagaagctggttggccagctggcaccacatcttgacaaaattgctgagattatactacattatgcagtttctgcattagtggtcattcaagatctgctgcgtgtttttgtaattcgaattgcttgccaaaatgctaagtatgcatccatgcttataaaaccagcattgtcctcagttattcatcatgtttcagaatcatcatgtccatcagatacagatgcatacaaggttttgaggcttcttgattttcttgtcagcctgttggagcatccacttggaaagggcctattgttgagggagggcactcttcagattctgacaaaagtactggatagatgttttgttattgttgatgttgatggaaagcagattcatgatagaagttctgcaaaatgcagctttaatttttttagttggtgtctcccaatattcaactttatgatgctgctttttcgttctgaaatttctcgacattacccccgaagagatgactttaaaaattttgaaaaattgagtgatgaagattgtgccctgattttacgatatcttttgaagagttgtcaggtcctgcctgttggaaaagagttactggcttgtcttacagctttcaaagaattagcttcttgtggtgaaggtcaaatggcatttggagctactcattttggtatccactctcatgctctcgaacttgagcctcggaaagatgataggaatgtaaattataatgtctctagtgtagcagaatggatcaaatgcccccctttacttagctgttggatgaagttgtttagatcgattgatacaaaggagggtttgtcagcttatgcaattgaggctgcctatgcattatctgtgggttccctacaattttgcatggatggagacagtagttacgagtttgtatctaattttgaattttttaatattgagtatttatatcatatagcaggaaaatttacagtttctttcttggttagtttgaattccgacagagttgttgcattgaagtacctctttgggatttccaatgatatgacaagatcagatggctttcctgaggaaaatataaattacatactagaatttagtgctctgttaagttctaaagcttctatggatgattgtttggttaactctcagtcacaaatcccattatatcaggtttctgagtcagttaaatcattgtcattagtattgcaaaggcctgttgattccatgaagttagaagatgttgttttacatcaaaatgaagttctagttttttcaaagacacatcagttgcttgaaaacagtgttgagaagattgatgatcatcttaatgttggtggacttggcgacaaatttctttgggaatgtccagaaacattaccagatagattaacacagacaactcttgctgccaagaggaagcttccatcaatggatggtcctgtaaggcgagctagaggagaaagttttcaggctgatatgtcttctcaaaatgctttttcacggggtgtagcacagtctgctgtttcttctggtcctacacgtagggatgccttccggcaacgcaagccaaatacaagcagaccaccatctatgcatgtagatgattatgttgcaagagagaaaaatgttgaaggggttactaatgtaatatcagtgccacgagcaggatctactggtgggagacctccatccattcatgtagatgaatttatggcaagacagagggagcggcacaacccttcagcaacagtagtgggagaggctgttggacacccaaaagatgcttctcctgtaaaacccacagatacggagaagttaaacaaatctaagcaattgaaaacagatctttatgatgatcttcaaggaattgatatagtttttgacggagaggagtctgaccctgatgacaagttgccattccctcagctggatgatgacttacaacagcctgccccagttattattgagcaaagttctcctcactcgattgttgaagaaacagaaagtgatgtcgttgatagtagtcaattttctcaaatgggtactccattaggatctaacatcgatgaaaatggccaaactgaattttcttcaaagatgtctggttcacgtcctgatatgtcattaactcgggaatcaagtgtttcttcagacaggaagtatgttgagcaggctgatgacacgaaaaatgttcaagctaggccctctggcagatatgattctgtatcatcaaatacttcgtttccaatgtctctttacaataatccatccacatctatgcaatcaccagctgattcaaggatggtttcccaaaattacttgttaaagaatagtcctcaacatgctggtattgcttctggttctcaaggattgtatgaccaaaggtttttgaccaaccaacctcctttaccacccatgccacctccacctacagtctcgcctgtaatatcgcatgctacagattcagttcctggtcattcatctccatttgttaattctctagcaggcacacagcgtcctgtggcattccaagttcggtcagactattcatctccattcatcaatggttcaactgctgcatcttctgttcctgtgccagattcaaaatactccaggacttctgtgtcttcccctggtggacctagtagagttgctcctccccttcctcctacaccacctccttttgcatctaatcagtataatttaccatctgttaaaacttctgcctcccaaccttctatgtataatcagacaagtattggggccactgaactttcccaggcctccatttcatcttcaggagccagattgtcatcttacccaaatcccccaatgatgtctgcgggttttagtaggtcagcttccatgccattgactatgttcggtaactccccaaatcagcaacagactgagaaccagccaagcatcttacaaagtatctctgttcctccagcttcctttcagtcaatgcatccagttactcagttgcagcccctccagccaccccagcttccacgcccaccacaacctcctcagctccttaggccgcctgtccacgctttacagcagttggagcaagggatggctgtgcaaagcaatgttcaagtgcatcatcaattacagatgctgcaacagcctcaggttccttcaatgcagacgtattaccaaacccagcagcaacagttttcacatgagcagcagcaagttgaatatactcaacagccagggaattctctatcacagcagcaacaagatgcagcaatgtcgttacatgagtatttcaagtctccagaggcaattcagtctttattgagtgatcgggacaaactttgccaacttttggagcagcatccgaaattaatgcagatgcttcagatgtttggtaggttaagggttgggaatggtaaactgcggaactggaaaaattgggccaactgtagccgcatgatgatgaccaagtag

SEQ ID NO: 47775 - DNA, 246 bp, Glycine max
  Peptide Sequence Number=SeqID_139460
atggtgattttccaccatggagttgcagcggaagataaaggagaagaggtgagaggagcttggagaggatgcttcaatggaggaaaagaaagagagaggggggagcaaaaaattgaagaaggaaaagggggagagaagttgaactttgagttgtgtctcacaagactctcattcatcaaagttacaacaagtgttacacatacttctatttatagcctaggtagcttccttgagaaacttccttga

SEQ ID NO: 47776 - DNA, 348 bp, Glycine max
  Peptide Sequence Number=SeqID_139461
atgtcaaggctatgcctgaaaggatactcaaggagaaaccaaagtgaaggtgaactagatggtgaagtgcaagttgatgttggggtacaagggggagtggaacttaaccaaaatccccaaagtgaagtggaagtagaggaatgtggaatcaacaaggttgaggatggagtggatagtcaagtgaaatttgaggctaagtcccatgatgaagatgaatttgttgttgaagaagaagtttctagtgaggaaacatcagtggttgttgatagggtaaaatatccaacactcaatgtgcttggtgatcatgatgttgaggttaaatttgagttgcagtacagttcaataaag

SEQ ID NO: 47777 - DNA, 540 bp, Glycine max
  Peptide Sequence Number=SeqID_139462
atggcaattctttggtgcaataaaagtttccagagccaaggtggattgaaaaagaaaaacacttctctcggtcccattacgagggacaaggaaagcaagcagaagggtaacaccattggcattgatggtgaaatggataaggcaaggaaaagagtagaacaaacagaacaacagaataaagttgactttcaggagcatgatggtagacaagaggtctcgtataccaaggaggtcatgtttacaaaagggaagagagagaaagagaagcaaaatttgattgttactagcttaatgggatttactaggatgttcccggttaaagaggaactgagatttagcactgagtatccatgcatcaaccaagtcaaatataagaatcaagaattactgcactgcgtgccagatagttatgagaatggcagccacttgaagcatcatcgtaaagaaattcatgaggtggctgttataaatggagcagtagttgataggggaagttcgttggtgaacattagttttgggtgggacagaccaggcccttga

SEQ ID NO: 47778 - DNA, 387 bp, Glycine max
  Peptide Sequence Number=SeqID_139463
atggatgaaagggactttgctgatcatgtgatgcaagtgcacgaagctctcaaatcagaaagggagaaatgggaaaaagctatacaagctgagcttattgcaacacaagttaaggaagccattgctcatgtcactgaagaaccttcaaatgaagccacatatgtgcaaaaggatgttcttgatgttgtagttgtgttttctagcagctctagcaatccaaaggatgttgctttcattagttatgctgcccccaatgctctatcaaaagacagattccaagccattgtgactcaggctatgacaaagcaaagggaagaaacacaagaactggtgaatcaagcaatcatgaagcagagagaagaaatgcaaaaggaggttagagcataa

SEQ ID NO: 47779 - DNA, 1377 bp, Glycine max
  Peptide Sequence Number=SeqID_139464
gatccccgacggagccacgatggaaatgggtatggccagcagcgagaaataaggaaaataaattggagggatgcatctgatgttcactcattctatttcacaagatttcctgaagatatgaatgaaactaatttgtggtacgagtttaaaaaatggggggatgttcgagaggtattcatcgcaagaaaccgtaataagaggggcaagagatacggatttgtaagattcaagggggtgaaggatgttacttggttggagagaaagctggataacctggtagtagggggattaaagatgcatgtcaatgtatcaaagcatggaagagagaggacatcacatggaaaagctagtagaggacgacgacaggaaaagggacatggagcagccaactggaacaccaagcaaaggatggaaaaaacttcatataagttgttagaagacacgaacagtaaaggtacccttgcagatacgatggggaaacaactccaacagatgaaagagacaaccttgtatgtgaaggtcctgatgacggatagcaagaacttgacacgaggaagaaatctcagaaacccgagtccaactggatttgtatcttattcgtcagtgcagttgaacatacctatgaaagaaaaaacatggctaaataatacatgggtgggaagattgaagaaccttgcgttgtttgatagaatggaagatgatctcatgtggaatgggggcgacgacatcacgccaaagtatattagagatgacatggtattgttaataggcctcacagagaccaaagctgcacaaatggtgaaggaagcaaatgagcaaggctcatccttattctactcgttggaaaagtcgactcctcagctgagaactggatatcgtctagtggatgacgagatggacgaactctataggctggatagggggcggatactagatagatgcaaatgttggggaagaatatccatagggtcatcagaggaaataagctccgacgatagtgaaagtgaaatagggacgcaaatgatgaacggagatgtaatgtcagaaatagaaccatcggaagaggactttctaccgagtgcagagggcgacgagcaggcacatgagtgggtcatatccgacacttgtagtggtcaaagagaagttgaccgaagcaaccataggcctgataaaagtgaaaaaatacaggcacaagggaaaaaagcaactgggccatgggcacactgttgggctcttaaaaacacaaacaacaatgcccacaatgaagttaacagtgtaattaagaaccatgataacctctcaccagcaatgagaggtagtgggttgaaagaagtggcagagtggaaagaactggacaaagagcagcctccaacatag

SEQ ID NO: 47780 - DNA, 821 bp, Glycine max
  Peptide Sequence Number=SeqID_139465
atgcgggcgcacgggagatctccgcggaatcgacgcccgccgcacccgtcggcgtggcctggacaccgacctcatcgagaggcggcagaccggccgccgctcgctgctcctcgggagaggcgagttcgccgtactggggccgttgatcggtcatcccgccatgctaaccgcacgggcggggcgccggcttccgagccgctgcacccgacagccctgaaaacgatggcggccccggagaagtggggacttctcggggccgcggacatggagcactggggacgctcctcgtccagatgtgatcgccagcgctggggacgcttcgagcgatcagtagcgttcatccgcgcaccagaggctctatttcagatagtgaactccgcgtcggaggcgccgccgccgagactgtccgccccgagctgtagggagagccgtcgagcggcacgctgcagtgtcgagacgagcttgcgatccaccacggcccggtccgtcggcagcgagatcgcgagagaagccgtgacccctggcgcgaccaccgggctccagctggctgagcagcgtcgcacggtcgctgctcgtgcgcggcgtgagctcttccagccgatgccgcgacaggtagtccaggcggccctcgtcggggagatccgcgaggatctgctttcccagtgccgtcgcgtgcgcgctggactgcagtcctacccacagctcgatccgaggattgtggaccgcgtcgacgatgtcgaccatgtggatctcaccgtcgccgccccgggagagctacgcggtggcccccacatcctccgtcacctggcgcaacgccgccc

SEQ ID NO: 47781 - DNA, 417 bp, Glycine max
  Peptide Sequence Number=SeqID_139466
atgacgttgctacttagcaacattctgcccagcgactgcagtgccgatctccccctgcggaagggtagcgcccacaagacacccagtggactcgaaggagcccaacagggccctggggtttccagctctgattacgggcctctatcagacctacagggacacccagtggacccaaagaagtccaatagggtcctggggtttccagctctgattacgggcctctgtcatttctacggagtgcctgtcaccctgggcaaggtcatcaggttccctactaatcgagctttcatcaagaagtattgcgccccaggcaggcgcaaggcaaaacaccacaacagcctggggatcgccagcaacaggcaacaaatgcaccgtcgccacctccagagcccctcagctcatccacaaaaaggttag

SEQ ID NO: 47782 - DNA, 363 bp, Glycine max
  Peptide Sequence Number=SeqID_139467
atgaccggccctctcgatgagtcgatctcttgctttctcataaaggtgggcccttgggtactagtacctaacacctttagaggactgtatgtcctcgccatcagaggactgcacatcctcgcctgtagagggctgcacgccctcgcctttagagggctacgcgtcctcattttcagggccagtagtttccttctatcagttcctgggtcaccccctgatattggagggcgaccaactgtgcgagcacatccagagagggaggctatcaccggggcaagatttcacccgtgccgctgcaaaaagacgagtgcggaccatgcgcaccaacatgaccacccttacatggatgacgttgctatttag

SEQ ID NO: 47783 - DNA, 432 bp, Glycine max
  Peptide Sequence Number=SeqID_139468
atgtcagttctagaattgtacatagaaaaggatgtgactagtggttcaatgtttcattctgcaaattcgcttacatcatgtggaaattatttatctaatgatgagacacaaccgccaacaaatatgagcaatttacatgttgacgaagatgatgatgatgattatcttgtgtctaactcatacgttgaagagtctttagacgaagatgacagtgttgacggtatatctgatacagatgatgaagtcaccgacatgattcaaccagtaagaattgtcacccagcagaaggtgtacaaggaattcaaaatccattttggaatgatgttttgcattataataatatcaactggagtcatccggatgatgaggacatttgtggtttggagatgccatcgagttttaatgttggccaagaattatatgttggcataa

SEQ ID NO: 47784 - DNA, 231 bp, Glycine max
  Peptide Sequence Number=SeqID_139469
ttgaaaccacttcagtttcaggccaaaagaagagaaggtcaagcagctggtgtctcgctaagcgaggcatatgtgcttagcgagtgtcatccactaagcaaggcactcagctcacttagcgtgatgagaaaccctagaagaggatcagccagagatgtgctcgcccaccagcctccaagagagtctaggctaaatctcttgttggggagttctgctgaacctttgatgtaa

SEQ ID NO: 47785 - DNA, 532 bp, Glycine max
  Peptide Sequence Number=SeqID_139470
cctaagtggaagaacttcggtgactattacgaaggaaggcataggtcacatcttagacctcactcccataggagagaaaaggaaagaaagcctcaagaggctaacattaaactctcatacttccatgggaaggacaatgtagaggctaacttagattgggaaataagggtagagcaacaacttaaaaagaagtctacttcaaaatcttatggctctcactcttatccaaagaaagaccaaggtcaaggcatcttaggggtgacaccttctaaacccaaagatgataaggggaagacaatagaaaagcaagcccctaaggctaacatttatagtagccaagatgaggctactacttcaccttcctctagtgaaagtgaaaaagcaaaaggggaagaatctagtgaagaaatctacccccaagaagaaggacaaccattagtggttaaagagaagtgtaaggaggcacttgctagcattgccacacctcttgggcttgagtttattcctcaagtaaagaagttgttggatgagg

SEQ ID NO: 47786 - DNA, 240 bp, Glycine max
  Peptide Sequence Number=SeqID_139471
atggctagtacaaacctgaatagcatgccctgtatgccttacaactaccatttgaaacttcccttgcatttgaccaattgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 47787 - DNA, 621 bp, Glycine max
  Peptide Sequence Number=SeqID_139472
atgtcgcgggggtcaggagaccttggggacgccaggtggggtgctattgcccaaaaccaagcttggccaatcccgacccaacccaggcatagtcagtcagtgagaacctgtgacgtacctaagcaggcgagctccaggcagtcgaccaataaaagaacaaaagtccacgaagcaaagaggcttgtgtggcggctagccagctatctattttgtgttatatatgaaaaatcccctctggttccaatgtacaaaggctgtggtaattcgtttttgggcatcggtaatcgattacttactttgatcgcgatggcagcacagttgatccatgatcgcgttgtgatggagtgcctaaagggtgtatgggagaccctcgaaggcaatgagaggtgccgattccgtggcacaattcgactcactgctacttcgctagtacatccggagcaacccgtacgcacacttcagcagcctgtggagtggatactacctacacctactccatatcgattagttgagccagttcaagtgatagaggtgtcatcctctgaagaggatcttgaagaggacccagaggagttacctcctgaacctgctgtggatgcccctgaacttcccagaggatga

SEQ ID NO: 47788 - DNA, 375 bp, Glycine max
  Peptide Sequence Number=SeqID_139473
atggatatgaacttggggttcctcatctcagccttgattactgctttatgcaaggcccgaggagtcacctctgattctatgacctttgaatccctgagcctagccattaatttggcttatattaaacagaattgttggaacctggatgaccctttggtcacttttcagggaacctgcaaatctagggccagaagatctgaggcaccatctacttcaactccccctacctcagctccttctacatcagctccttctacctatcctctccctccaccaccaacagctccgattcttccaggtccctccgctcagagctcagaggtttccttgtctatgctgcagagcctgcatcagggcaagctcctaatcatgtag

SEQ ID NO: 47789 - DNA, 599 bp, Glycine max
  Peptide Sequence Number=SeqID_139474
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcattctcgatctcacttatgcctttaagtttatatgtttctgctgcaaagaatcgaaaacccttgtgcgcggctgtggaagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 47790 - DNA, 147 bp, Glycine max
  Peptide Sequence Number=SeqID_139475
atgaatgacaatcaattcgtggggctccggataagattcgttggtggtggatgcacaaacagcgctagattctttggcggaggatgcacgaacaacgctaggcaatcaattcgtggggctccggacttgatggtggaggatgcatga

SEQ ID NO: 47791 - DNA, 339 bp, Glycine max
  Peptide Sequence Number=SeqID_139476
atggtccttccaccgagagagacgcgtccagctcagggacgactagtacacagatttccaggaggagatagctcgtcggcgttggacgtcgctggtcactcccattgccaagttttacccggatatagttctagagttttatgccaatgcttggcccacggaggagggcgtgtgggacctgcggtcatgggtaagggcaacatcctgcccaacgatcataattccgacctccctctgccgaagtgtcagctggtgtatgccatcctgacactggagtcccgcatggatgaggagatgacagatttactcgatttcttgggaagcagcggagcctcgtga

SEQ ID NO: 47792 - DNA, 247 bp, Glycine max
  Peptide Sequence Number=SeqID_139477
atggcattcttagaagagacaagcagtcagacagttgtgaactcaacattaggttttatttttccaaatggatccattgttcacaacgacagtggtatttcctttcaagcttccagtccatttccgattcgagtacctaatgggtgtgatcttgaaacgttaaaaaccagaatacacaataccataaagctaaccgacaaccaatttttggatgaaatttactaccggcagcctttcacatatgcag

SEQ ID NO: 47793 - DNA, 204 bp, Glycine max
  Peptide Sequence Number=SeqID_139478
atggctatggcatcgaagatttggcacttcaacacacatgccttgaagttgttacatgagaagaacatgatgagagatcttccaagcataaaggagaacaatgaagaagtatgggtcaaggcaatggaagaagagatacagatgatcgagaaaaacaacacatgggagttagtaaatcgtccctatggaaaagatatcattggg

SEQ ID NO: 47794 - DNA, 411 bp, Glycine max
  Peptide Sequence Number=SeqID_139479
atggatgtttatgcaggcacactgtctatggaatttggtgacataactgttcattttaatattctggatgctatgaaatacccatctgaagatctttctgtatttcgtgctgaaataattgaccatgttgttgatgaatacatgactgatctttattctaatctgcatgcctctcactcttcatgcattgagtctgaaattgtacttgatcatatgtctgaatttgatgctgagagtgaatctgagagtgatattgattgcattgaatcagatcgggctgcacaatgcacaaggcaagataaaatgtcaaatgaagaattgaagttgcaggatccacgatgtcggatacaatgtccaggacatcctgcccgaaaatactggagttgctgcacaatgcacaaggcaagataa

SEQ ID NO: 47795 - DNA, 393 bp, Glycine max
  Peptide Sequence Number=SeqID_139480
catatacggtacctctctcaattttcttctaggatcatattagaccctaagtacctagacgtagagttctttaatgatgaaacatttgattgctatcaagtgtttcaaaattctggccttgttgatttcatgtcattaaaactgccacattatcctgaacttgtaaaggtcttctactgcaatttgaaaattcaggatggcattatttcctctgaggtgcatgatattcctatgatcattgatcaatcattattcttttctttaacacatttacctagtcaaggtgcaccgttagagggcaccattgttgatgaatggaaatttgattattctagtcatgatgctcgccgaatggtctgcaatgaccaggctgaaatgcccggtagattgctg

SEQ ID NO: 47796 - DNA, 1131 bp, Glycine max
  Peptide Sequence Number=SeqID_139481
atggtatttgctgaaagtgatcccgtggagaatttggcagaacagagaggattaactatccctagtgggcaacttgttaatgatgaattgaagacccttcaaaccaattcttttaatcctaagtctgaagaactcaaatcaaaagatataaagaagctcccgagcgtcgaatttttgaagaagaaacatgacggagttaaggacttctctcaagaagctaacctgaaaataccaacctggataggaagaataatacgaaaccggaaaggaaagccgtcccagaaaccaaagcaccctcccccaccgccagactaccgtgtacaactaaagtccgatcccccagcgccaaacgcaccaccgaagcaaatcaatattaagggcctgtccgtcgtcaaagattacttatctgactacggctacattgaatcctctgggccatttaccgattctttcgaccaggaaataatatcagccattaagacctaccagaatttttccaatcttcaagttaccggcggcctgaacaaacagcttattcagcaaatgttgtccatacgatgcggtgtccccgacgttaacttcgactacaacttcaccgacgacaacatttcctatcccaaagccggacaccgctggttcccaaacagaaacctcacatacggttttcttcccgaaaaccaaatcccagacaacatgactaaggtgttcagagattcctttgcgaggtgggcccaagcctcggggactttgagtctcagggagacaacctacgacaacgccgacatccaggtagggttctacaacttcactaactcgaggattgaagtgtatggtggcagcactatatttttgcaaccggattctagtaagaaaggggtggtacttctggacggtaacatgggctggttacttccaagtgaaaacgccacactgtctaaagatgatggagttttggacttggagactgtggcgatgcaccagatagggcatctacttggacttgatcactctcacaaagaggactctgttatgtatccttacatattgtcatcacagtcagagcaacgaaaggtgcagctttccaattctgacaaggccaacattcaccttcagtttgctaagcatgattag

SEQ ID NO: 47797 - DNA, 551 bp, Glycine max
  Peptide Sequence Number=SeqID_139482
ggcttcggtattccattgcgagcattgcgatagattacgggactcaatcagacatccgagtaaaagagcttcaacattcaatttcgagcttttcgatatatgacgggactcaatcagacatccgagtaaaaagttattgtcgtttgaatttgctcagagcttccgtaatccatttcgagcgtctcgatatattacgggactcaatcagacatccgagtaaaaatttattgtcgtttgaatttgctcagagcttcaacattcaatttccagcgttccgatatattacgggactcaatcggacatccgaagcttcggtattccatttcgagcatctcgatatattacaggactcaatcagacatccgagtaaaaagttattgtcgtttgaatttgctcagagcttctacattaatttcgagcttttcgatatattacgggactcaatcggacatccgagtaaaaggttattgtcgtttgaatttgctcagagcttcggtttaccatttcgagcgtctcgatatattacgggactcaatcagacatccgagtaa

SEQ ID NO: 47798 - DNA, 297 bp, Glycine max
  Peptide Sequence Number=SeqID_139483
atggggagcacacaaaatggtggtattacagctactaaaatccagaatttaatgaaggatctgaatgctttggaggctagagtaaatggttcaaacatatctcaagctgaaatggagcttaaaaaatctttgcaggaacagctgtggacagcagctataacttatgaatccatgatgaggcaaaaatctagagtgaagtggataagagaaggggatacaaattcagcttattttcacagattgattaatcatagaaggaggctaaggagggctgaatggtctgatgagaaaagctaa

SEQ ID NO: 47799 - DNA, 618 bp, Glycine max
  Peptide Sequence Number=SeqID_139484
atggggaccttcatacagtcagcctgggaatggaatcttttgtggagaaggcccctatttgacaacgaggtagcatcggctgttgggtttttagaagacatatctcacatcacattacagcaacacgaagcagatagttggacatggaaacatgagtccaatggttattattcttctaggagtgcctacagactgctacaagggatttcagatgtggcaggcatggatgatatattcaaggacttatggaagctgaagataccgactaaagccacgatctttgcgtggagcaaaatacagcatctgtggtgggaatcccaatcatggatagggacttcgggggcataccctataaatcctaggcaccattttttgcagcacaacattgggatgaaaggtgggaagatatacaagaggtggaagtgctggtgggttgctctaaattggtccatctggcagcagaggaataaggttatttttatgaacgccccattcaatggtagtaagctgttggaagatgcactatttgtggcatggacatggttcagagcaatggaggaaaactttacaatacatttcaacttttggtcaagcaatcttccagctggttttcagtaa

SEQ ID NO: 47800 - DNA, 222 bp, Glycine max
  Peptide Sequence Number=SeqID_139485
atggtgctggtagtgactattgcagccgcattgacctctattatcccctttatgctcatcattgttaccatttgctctttcaaggcctctgtgtcggccttcatctgctcttgtacctcctctatttcacccattactctagctctagcacgggtttggacatggggttgtgatgcaagctccattggagcttgtaggcctaggatcttcttcatcaattga

SEQ ID NO: 47801 - DNA, 294 bp, Glycine max
  Peptide Sequence Number=SeqID_139486
atgggggtgcaaatagcaactaggcccacttgggccttccagaaaattcctccagaaggcggttgcttctggaggaagcaacctagctcgcctgggcgagctggggggagaagtgaagaggaaaattgttcagcccgcctggtaattcgagaatcacttgaaattggtgaaaaaaattggttccgtgaagaaaatcccagccgaggcgcttccgtaacgtttccgtgggaattttcgcgaagattttcaatcgttctttccgttcttcgttcgttcttcggtcttcaaccgtaa

SEQ ID NO: 47802 - DNA, 1104 bp, Glycine max
  Peptide Sequence Number=SeqID_139487
atgccgacattacctccttttatttcacccatttccccgacgaagctaatgaagagttgctatggaggcacttcaaaaactggggtgacgtacgtgaagtatacatcgctaaaaggctcaacaaggatggcaggagatacgggttcatgcggttcaagggagtctcggatgcaaaaggattggagggggggggggtgccaaggagacaaaagggcagacgaggcacaaacaccaactattctgatcaacccagatgaaggtggggaatattggtgtaacgaaacctgggtgggcatgctaaagaaggtgatggaggtggaaaccttagaggatcgtatcacttgggagttaggatataacgtccgcactaagttcctcggagacgacatggttcttctccctgggatgtccgatgacaaagctcaactcctcattcaatcagagacggaaagcgatgattctctcttttactcactggagaagtggacgccgaaatgtagacccaataacagggttgtttggctccagctgtggggatttctgatacaggtgtgggaaatgaaaaatatcaggagggctgtagctgctattggggatgtcatcgagtcagacgatgacacagaggaccgccgacgattggaccgggctcgagtattggtgcggacaccgcttccgccgttgataaggtcggaggtcatcatccgtgtgggggagcttgagtatcgggtatggattgtggaagagacagggttcgaaggtgggtcgaaccggaaaggaagctcgccgtccgatgggtggtcggagatgataacatcggacgacgaaggggaggttggtgatgttcttgacgacactaataccaatttctccttctcgccggagctgcccaaccagaaattgtctccgtctcgtacccaacgggcagaaggagggaccgatgtgcgctgttgtgatcttagacccctgggtaatatccaggcagacgttacacccaaagaaaagtcaaaaggcactgtagaaggtatgctgggctctagctttggtaagctcaacctaggggacagcttcgcaggaacagaagaggaagctgctaacaccaaagag

SEQ ID NO: 47803 - DNA, 378 bp, Glycine max
  Peptide Sequence Number=SeqID_139488
atgccgatctccccctgcggaagtatcagttggtctgtgccgtcccgacatagggatcgcatccacatgacacccagtggacccgaaaaagtccaacagggccctggggtttccagctctggttatgggcctctatcagtcctacatggtgcccgtaatctgatgtcatctattgtttgtagggatcgcgcccgcaggacacccggtggacccaaagaagtccaacagggtcctggggtttccagctctgattacgggcctctgttagttctacggagtgcccgtcgccccaacaaggtcattaggccctgcattaaccgggctttcatcaagaagtactacgcccccagacgggcgcagggcgagacaccacagtag

SEQ ID NO: 47804 - DNA, 303 bp, Glycine max
  Peptide Sequence Number=SeqID_139489
atgttgtggaagcttgggaggattgacggggacccggtgttgagagaaacgaggatatgggctacgtgggagtacgtgagctcagttggaggtgggcaacagggatggtgggtttatgcgcgcattgtgatgtggaaacttgttgtgcaccatcgcccgacggcacctagtacacatgtgatggagtggtacctggagatatgtcgcgggggtcaggagaccttggggacgtcaggtggggtgctattgcccaaaaccaagcttgaccaatcccgacccaacccgggcatagtcggtcagtga

SEQ ID NO: 47805 - DNA, 292 bp, Glycine max
  Peptide Sequence Number=SeqID_139490
atggagactttgcaagtctcacaagttccagaactacgtaggtctgaattcctcattggaggatacgtaggagcaagagcctcgcttttgtcgaccataccgccttttgttgccatgactcaagagctggtagcccgaggagacaccttacggttatccgcacctcgtcattcagtgaccccaagtgtgattgacgagcagagaccaatatggtcatctgcgcccttgccggaaatgtcatcattccccgatggacacttgtcaatgtctcacatgttccagaactacgtag

SEQ ID NO: 47806 - DNA, 168 bp, Glycine max
  Peptide Sequence Number=SeqID_139491
atgaaaattctaagttcgagagttgtatttacgcttgaggaaggtattagcacctcttacgtcgataaaagcggggcttttgctcctacgtaccctcctttggagaggaaatcagacctacgtagttctttcttatgcgtgaatcaagtgattctttttactcgaaag

SEQ ID NO: 47807 - DNA, 630 bp, Glycine max
  Peptide Sequence Number=SeqID_139492
atggctagaaccaaacgatatggccagatgacatcaaaggtggcaaaagaaatttcggatagaattgactcgttagaagagcagatgacacagggtagttttgttccccatggtcgggatgacatcttgaatacggccattggcaaaccggaacatccaggtcgagttcgtgcagcgggatcaggtatgacccttactcaattttatggtagggcaacacgtacgtcgagtagttcctcagcaacactaatgcagcaacagtgggttgacattattggaaacataaaggaacaagtaaggaatgaatatgaagaacaacacaagaggagtctggaggaatttaagaaggagttgtccagtcagatcttcattcagttgagtcagatgggatcacaatactctccccttattgaggtggatttacaggcattggctgcacgtcttagcactaaaggaagtaatgtagaaactgttgatgttgacccatcaggcgacaaaaatgtgagcttaaaacccactatggggttatacgtgcaacgacaacatactacagtgttggtggccttggggaaaatatgtgaggggggatctgccattcacaatgtcacttatgctgatgatgttgtaagg

SEQ ID NO: 47808 - DNA, 459 bp, Glycine max
  Peptide Sequence Number=SeqID_139493
atggtttctccacctgcctcgcctcctcctccttctcctcctcctccgcctcctccttcccacacatcgcctttgtcgtctgccatgaagcggacacgcaaagcctcacgtctacgatcgttgtctactagaccacctggtgctaagagaccagtggtccacgttgatcctgctaccgacaaggtcgacggttcccataggaagaaattaagaacatatttggggaatgtgacgcgtgataaggtggacgtcacctacaagaactggaaggaggtccctacttctcaaaatgacttgatttgggaggatattcaggtggaatttgaaatcttagaggcttctgatagtaggacgaaaaagaagttacttcagactgtcggtgagagatggaggcagtttaaatcagacctcatgaagaaatgggcccttacagccgatcaggacggtgtggacgacaat

SEQ ID NO: 47809 - DNA, 186 bp, Glycine max
  Peptide Sequence Number=SeqID_139494
atgaagaacggtgaagaacaacgtagtacgatgaagaatttccacagaatcgcttacggaagcgttacggaaccgaaatgcatagccaagggtcttgaacattttgaaacagctcccccctcccctatttatagacaaaaaagggaggtgcttgccgcccagagacttaatgaagaagatttctaa

SEQ ID NO: 47810 - DNA, 201 bp, Glycine max
  Peptide Sequence Number=SeqID_139495
atgaaccctaagagaataaaggtcattcctgagtggcccactccaccaagtgtcgagggaaggaacccagagtatcaagaacctcgggatttgaggtcaaatcctttccaaggtggaggcaatgatgcaatcataccctgtgggcattggatagagaagactccatgtagattaggccagagatccaaggtaaggccctag

SEQ ID NO: 47811 - DNA, 663 bp, Glycine max
  Peptide Sequence Number=SeqID_139496
atgcaagagaagactagctccataaagtgctttaaatgtcttggaagaggacacattacttctcaatgccccaccacaaaaagcatgattatgaggggccaagacatttatagtagccaagataaggctactacttcaccttcctctagtgaaagtgaaaaagcaaaaggggaagaatctagtgaagaaatctacccccaagaagaaagacaaccattagtggttaaagagaagtgtaaggaggtaagtgtctcctccaagaggttagctaagaaggaaactcattttacaataaagacaaacattaaagaaactttccctcttagacaacctccacattttctcttttgtaaaaagacacttgcgagcattgccacacttcttgggcttcagtttattcctcaatcccaaaataggcaccaagtccctaaaataggtggtatgatgaatgttttgagtggtgcaaccctcttttgtaaaatcactcgtgcacctaacatcttcatggtgtgtgtacatagggacccattaggactaggatcttcttcatcaatggattcctttgcttcttggaagatgaatggcagcggaatggagaaggaagagagagaggagacgccacttcaaggagaagatgagtctagaagaagctcaccaccatag

SEQ ID NO: 47812 - DNA, 120 bp, Glycine max
  Peptide Sequence Number=SeqID_139497
atgcaagaaatggctccgaaaaagctttccacgaagagatctaggagggacgccaaaggtgaagggaccagtgccgctcccgagtttgatagccaccatttcaagagcgccgagcattag

SEQ ID NO: 47813 - DNA, 320 bp, Glycine max
  Peptide Sequence Number=SeqID_139498
tcattcggggttcccgtcacccctagtaaggtgatccgatcctcgatcactcaggccttcatcgagaagtattgcatgcctaggcaggcgcagggtgatgcacctcaggccgcagacgcaccgccaccacctcatcaggccgatcccgctggatcacttggcatggagcgttatctaaagcacttggtcgcatggcccggagattggtccgaggcccaggtaggggaggagctcgcgggatcccccggtgccgcagaggaggcctgtatggatgaagaaatgatggacttgcttggtttcttgggaggaagcggagccac

SEQ ID NO: 47814 - DNA, 117 bp, Glycine max
  Peptide Sequence Number=SeqID_139499
atggctactccaatgagtactgcttgctacttggataaagatgaaactggtcagtcaatagacattaagaaataccgagatttcaagcaaatcccaaagaatcacatcttagtgtag

SEQ ID NO: 47815 - DNA, 623 bp, Glycine max
  Peptide Sequence Number=SeqID_139500
atgggcacgatgatccagggctatcgtctgagtgaagacgatttccgcggtgaacgcttcgctgactggccttgcgatctgaaaggtaacaacgacctgctggtgctcagcaagccgtccgtcattaaggatatccacaatgcctacttcgaggcaggggcggatatcgttgaaaccaacacctttaactcgacaaccatcgccatggcggattaccagatggaatccctgtcggcggagatcaactttgaggcggctaaactggctcgtgcctgcgcagacgaatggacggcccgcacgccggacaaaccgcgctacgttgccggggtgctaggcccgacgaaccgcaccgcgtcgatttcaccggacgtcaacgacccggcgtttcgtaatatcaccttcgatcagctggtggcggcctaccgtgaatcgaccaaagcgctggtggaaggcggttccgacctgatcctgattgaaacggttttcgacaccctcaacgccaaagccgcgatttacgcggtgaaagaggagttcgaggcactgggcgttgacctgccgatcatgatttccggcaccattaccgacgcctccggccgtaccctgtccggccagaccaccgaagc

SEQ ID NO: 47816 - DNA, 984 bp, Glycine max
  Peptide Sequence Number=SeqID_139501
atggacgatgcggttcagatgctggtggacttgttgatggtgtctccagagtctgctagggctgagacagtccagtgtcgcggatcgtacgtacgcctgcaatgggtatgtgatatatatcagcaccgatgccaggcaggtcattggacagctgcggctcgtccatatcttcttcacctactgggttgcactctgtttgctaacaagagtgcaaccaatgtccatgttgtctacttggaggcccttcgtgacctcagtatgacagagaggtacgcttggggagtggctgctttggttcatatgtacgaccagctgaacgatgcatctatgagccacagtcgacagcttggcggttacatcacattgctgcagatttacgagcactttccctcggttgcggagtccaccgctgatcaggactacgacgaggcttctccgcgtgcgtgcaggtggattgcgacgaagaagaccgtgaaaagcattcgcacgccgttgtatagggagcgcctggaccgactccggattccggatgtctgttggatcccttatggggagcatcgggaggtccgggacttccacgtcagatcatgctattccggtctcttgcgctgggggcctgttgctgtgtattaccgaccggagagggtcgtgcagcagtttggttacacgcaaaccattcctgctcctcctgtcgattcatgggtctcgtatgatgatatacacgacaggtggatgcactacgaggatcatattgtacctgcaggtgaggtgtgcgtcgtgccaggggcgtgttccaatgactacatcgactggttcttccgcatctctcatcctttcatgacaccaggccacgcagtagatcatctgcctcatggtcatgccccgcagccccgagtcgtccctcaggccccgcagacagatatccttcgcgtgccggagccaggagcatcgtcgacatctacggaggagcccagacatgcagtg

SEQ ID NO: 47817 - DNA, 124 bp, Glycine max
  Peptide Sequence Number=SeqID_139502
atgggttctccacctgcctcccctcctcctcctcctgctctttcggacgcatcggcttcgccgtctgccgtgaagcggacacgcaaagcctcacgtctacgatcattgtctactagaccaccgg

SEQ ID NO: 47818 - DNA, 189 bp, Glycine max
  Peptide Sequence Number=SeqID_139503
gggcaggatcatcttgagctaccttctggggtggggacaaaacatgaacagcagaaaccaatcaaggtaagacaacgacgcggtcaagattggccatacctggttgtttattacttgcaagtacttaggaacggatgcaactggggatggggtcacgaccgactgatcgtcgccccttctatacgctaa

SEQ ID NO: 47819 - DNA, 129 bp, Glycine max
  Peptide Sequence Number=SeqID_139504
atgggtgaagcagaggagttgccgctactagcgactgtcgctaaggtgaacccgatgctcccatctggcctcaagcaaatgaatcatccaacctcaaatatggtaggcaaaaatttaggaagtacgtga

SEQ ID NO: 47820 - DNA, 324 bp, Glycine max
  Peptide Sequence Number=SeqID_139505
gctcatgaatcaagtcattgcattcccattgaagagcatactcgggaagttcattacatgggaaatcaacagagacaaggatacaaccaaggaggattttcggagttccagcaaggtccctataatcagcaagggcaatggagatcacaccctggcaatcaattcaataaggaccagggtggaccttccaataggtcacatcaacaagggccaaatatttttcaaaggaccaccaaactggaagagacactagctcagtttatgcaggtgaccatgtccaaccataagagtactgagtcagccctgaaaaaccttgagatctag

SEQ ID NO: 47821 - DNA, 291 bp, Glycine max
  Peptide Sequence Number=SeqID_139506
atgtatgacattgcgaccataatgccgatctccccctgcggaagggtcacgcccacaagacacccagtggacccagagaattccaacagggccctggggtttccagctctggttatgggcctctatcagtcctacagggtgcccgtaccccccggcaagggatcgcgcccgcaggacacccagtggacccaaagaaatcaacagggtcctggggtttccagctctgattatgggcctctgtcgattctacggggtgcctgtcgcccccagcaatgtcatcaggccccctaa

SEQ ID NO: 47822 - DNA, 231 bp, Glycine max
  Peptide Sequence Number=SeqID_139507
atgggtgccaagtacctcgaagcggtcaagcaaaggttgcatgccatcaaacaatggttcccggacgaaattagggaaatcaattcgtggggctccagactcgatggtggaggatgcatgaatggcaatcaattcatggggctccgaacaagatttgatggtggaggatgcacgaacagcgctaggcaatcaattcgtgaggctccggactcgatggtggaggacgcatga

SEQ ID NO: 47823 - DNA, 520 bp, Glycine max
  Peptide Sequence Number=SeqID_139508
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaacccccccgttcagcccgaccgctgcgccttatccggtaactatcgtcttgagttccaacccg

SEQ ID NO: 47824 - DNA, 357 bp, Glycine max
  Peptide Sequence Number=SeqID_139509
atggaagggttagtggacctagcagcgattgacgctttcctcgcctttcatcatggcaaggaaagcccggtcgtcgccattttggccatgtatgacacgttcgaccggggatgtgaaaagagcagcgcaagaattgtttgttgtgcactggctctctatgtgtggatgtccaaatgttcccttgatggaataaggggttgtattaattataatctcgtcctcgccataagacagcttggctaccccatgagaggagtgccatcagacgaaagcatcacgcctttcatcgcacggggtttcagtgaccacaatgcgagggtactccaaggagttcgcaaggcatgggatgcagcgtga

SEQ ID NO: 47825 - DNA, 210 bp, Glycine max
  Peptide Sequence Number=SeqID_139510
atggaggattgccttgagggtccgcacttaggcaatcatgaaacacagctccaaactcgaaagtggaggacacatgaaggaaagcgtaatacatggggctccgaaaaagggggagaatggaggattgccttgagggtccgcactcaggcaatcatgaaacaaagctccaaactcgaaagtggaggacacatgaacagtgttaggcaataa

SEQ ID NO: 47826 - DNA, 234 bp, Glycine max
  misc_feature (3)..(3): n is a, c, g, or t
  Peptide Sequence Number=SeqID_139511
gcnactctagaggatccccttccgcggctttctgctacaggcgtttttgctgtgggcgcccaaaagccgttttgcctgcatgttgctcacatcgctgctgttcgccgcgttacacacgcagtacgtgcactgggaggccagcgttgcgctgacgctgttctcgctgctgctgtgctatgcgcgtctgcgcagcaacagtctggcgctgccgatttttctgcataccctgaataa

SEQ ID NO: 47827 - DNA, 849 bp, Glycine max
  Peptide Sequence Number=SeqID_139512
atgctggtggacattccggcggcgcagcagagtagaatctttggcatcattcaatcctcagtgtgggtcggggaacagtggcgcggccagacacagcgcgccaccgggggcagaacgtcaggagatggcggaatctttttgcttgtcggcttcgaagtgtgccttgaactgttcgtagatggagatcatattggaagcatcgccgtgcagcgggctcagtttaccggcgcgtaccagttcgatgaccagttgcagggcggcctgttttgggctgctggccggatgggcaatttcatgagacatcagatatcactccttattgttgtcagtgccgcacagtttagcccagattgtgctgctaatgggcgcggcgctggaacacacagccacgcattccgtaccacgggaatggtgcagaaggagtcggttatgttgattggttttgtcttgttagtgagcgcctgcggccacgatgcctgtgatgccctgccggtgtcggagcggatttaccccacgaaagtggcctgcgaagagatggccgatcgcatccataaagtccggccgaacgtggtgctgctttgtggggaagtgcacccggcttcggcggctggctgccgttttactattcgcccacctttgaatttgttgcgggcgatccgcgcaaagcctaccgcattgcgcgcagcagcgtgcgcaatctgcgccagcatgagcatgacggcgaatatgcctgaggcgtcagaactgccatggcagccacgaggccgtcagcaggtagtgcaccagttccagcaccagaataatcatcaccagcaccccgagcttgtggcggcatacccaatcctttag

SEQ ID NO: 47828 - DNA, 2053 bp, Glycine max
  Peptide Sequence Number=SeqID_139513
ggctattccacttgcgttgcctggctgccggatgcgtatcaccggctgggctggtcggcgcaggccggcggctcgctgctgggcgtgatgattctgagccaggttgccggcgcgctgctgatgccgctgctggcgcgcggtgccgatcgccgtccgcaactgattgtcagtctgctgtgtcagctggccgggatgagcgggtttctttttgcgccgctgctggcgccgtggctgtgggccgccatcgccggcttcggtctcggtgccgcgttcccgctggcgatggtgctggcgctcgatcatctgccgcagccgcaggcaggcgcgcggctggtggccttcatgcagggcgcaggattcatcatcgccggctgcatgccgtttattgccggtcagttgcaggtgctcacccacagttttgccagcgtatggctgatgcagggcgtcgtgacgctggggctgatcggactcaatctgcgttttcatccgcgcagctatgcgcgcgcctttggtgcggcagcgcgctgattggtcctaccaataaagcccgtcagctgcaatgtggtcctaccaattgtggtgcggaaccgggcaacaatctgcggcgcacgcctgcttttgccgatgcgccgcatccctctggtgacctctggagaaacggcatgcaggtgtggcaacaaaactacgatccgctcaacaatttgtggctatccagcctggtggcggtgatcccgattgtttttttcttcttcgcgctgattaagctcaagctgaagggctatcaggccggtacgatcaccgtggtgctggcgctgctggtggcgctgctgctgtacggcatgccggtgccccaggcgctggcgtcggtggcgtatggttttttatacggcctgtggccgattgcatggatcatcgtggcggcggtgtttgtctacaagatctcggtgaaaaccggccagttcgatatcattcgcgcctcgattctctccatcacgccagaccagcgtttgcagatgctgatcgtcggcttctcgtttggcgcgtttttagagggcgcggcaggctttggggcaccggtggcgatcactgcagcgctgctggtcgggctgggctttaatccgctctatgccgccggcctgtgcctgatcgtcaatacggcgccggtggcgttcggcgcgatggggattccgatcatcgtcgccggtcaggtcaccgggctggacagcttccagattggccagatggcgggacgccagctgccgtttctcaccctcatcgtgctgttctggatcatggcgatcatggatggctggcgcggcatcaaagagacctggccggcggtgatggtggccggcggctcgtttgccatcgcccagtacctcagctctaacttccttggcccggagctgccggacatcatttcgtcgctggcttcgctgatctgcctgacgctgtttctgcgccgctggcagccggtgcgcatcttccgctttaaagagcccgcgccggaggctgcgccctcagggacgcaacgctacacgctggcgcagattgtgcgtgcctggatgccgttcctgttccttaccgcgaccgttacgctgtggagtattccgccgtttaaagcgctgttcgccaaaggcggcgcgctgtatgactgggtgtttagcgtgccggtgccgctgctgcacgagctggtggcacgcatgccgccggtagtgagcgcagcaacgccgtatgcagcgctgttcaaatttgacgtggtctccgccaccggcactgcgattctgctggcggcggtgatttcggtgattttcctgcgtatgaagccggcggcggcgctgcgcacctttggcgaaaccctgaaggagctggcgctgccgatctattccatcggcatggtgctggcctttgcgttcatctcaaactactccgggctgtcggccacgctggccctggcgctggcgcacaccggccaggccttcaccttcttctcgccgttcctcggctggctgggcgtctttctgaccggctccgatacctcttccaacgcgct

SEQ ID NO: 47829 - DNA, 357 bp, Glycine max
  Peptide Sequence Number=SeqID_139514
atgggatatctgcattatcccgtcgcacaaaccgtagcggcgcgattcatcgcgcatttcatttcccgcaccgtggcggaatgcgcaataaattatgccctctgcaaaaaacacgcagagaccctggataatcggggtaagcgcttagcgcttcttctccagcacgcgataaatcacgctggaaagctcgttgatttcaaacttagcgacgtaaccgtcagcgcccactttgcgcacgtgatcttcgttggcgctgccggacagcgaagagtgaatcaccaccggaatctgccgcagcgcgtcgtcgcgcttgatgttgcgcgtcagggtaaagccgtccatctccggcatttcgag

SEQ ID NO: 47830 - DNA, 420 bp, Glycine max
  Peptide Sequence Number=SeqID_139515
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccatgctgacgggctgaaatacccgagtggttatcggtataaccattcttttgctatctctaagacagaacgcttgatagcatgcagagactga

SEQ ID NO: 47831 - DNA, 621 bp, Glycine max
  Peptide Sequence Number=SeqID_139516
atggcgaatctagatgagtgggtcccattcatggatgtattagcattattaatctttggggttgtcctctttccaaacgtggatggtttggtggacctagctgcaattgatgctttccttgcatatcatcatagcaaagaaagcccagtggtagctgtcttgacagacttatttgacacatttgaccgaaggtgcgaaaaacgtagtgcacggatcatctgttgtttacccgctctttgtgtatggttggtttcacatttattccaacaagacgtaaggcatccatgtccactccgaagccatcgctcgtgtgtcgagaaaagaagagtagattgggaccaacacttggctggggtaggaggcagaatagtcaattggtttccacgatggaaagaaggaaatgagggtgttctcttctcatgtgggggctacccaaacatcctgttgataggaacgaggggttgcattaattacaatccctcacttgctataagacagttagggtaccccatgaggggagcaacgacggaagaaagcctgtctcctttccttgtgagagatttggcgtgcaagatatcaaggttatacaaagagtccataaggcgtgggagagcccgttaa

SEQ ID NO: 47832 - DNA, 258 bp, Glycine max
  Peptide Sequence Number=SeqID_139517
atgtccaatgatgtgcaacctaacggggatgacccattcgtaggatggcaatctgttaactcgagctttttcaaagattggcaaagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 47833 - DNA, 87 bp, Glycine max
  Peptide Sequence Number=SeqID_139518
atggggggagttgcttgtgcacgacagggtaacctcaacacttactatctagttttcctaaatgacaacatagagtacgagaagtga

SEQ ID NO: 47834 - DNA, 252 bp, Glycine max
  Peptide Sequence Number=SeqID_139519
atggcagaaccatcgaaaaagagaaagggatcatcctccaccgccactgctgctgcccatcaccgccacggaccatccgaagcacccacaacacctatccatccttctttttcatctccaagatcatccactctgttttcttccgatgatcagcgtctacggtacctttctcaattttcttctaggatcattttagaccctaagtacctagacgtagatttctttaatgatgagacgtttgattgctatcaa

SEQ ID NO: 47835 - DNA, 222 bp, Glycine max
  Peptide Sequence Number=SeqID_139520
atgactgagtggattgtcatcatcaaaaagggggagattgtggaagcaatgtcttccaaggttattttgatgatgccaaagaatcaagagttaagcaatgtttcaagcaaagattcaagaatcaaacttcaagtttcaagattcaagaatcaagattcaagtatcaagatcaagactcaagactcaagattcaagaatcaagagaagactcaatcaagataa

SEQ ID NO: 47836 - DNA, 348 bp, Glycine max
  Peptide Sequence Number=SeqID_139521
gctgcagacgcaccgccactacctcatcaggttgatccagctgggtcattcggcatggagcggtatttacagcacttggtttgccagcaggcggccaaccacaggggacaggtgcagacccatgagtgtctcaaccagctcagcctcagtctgcagagccaaggtttcgctccttttgcctgccctactccagatcagttcagggctgaggttgcatggcccggagattggcctgaggcccaggcaggggaggcgcccgcagaggctcccggcgacgtggaggaggctcgcatggatgagaagatgacagatttactcggtttcttgggagggagtggagccacatga

SEQ ID NO: 47837 - DNA, 207 bp, Glycine max
  Peptide Sequence Number=SeqID_139522
atggagctcggccttaaatgtgacacgttgaaaggcagcttgttcagtggccctattgtgtccccacccttcgacagggatctcctcctcagtgaaggtgaggtagttattagtcgtgatattgctgacgatgccctcaaagccttccacaaagatatcttggccacgtgggcctcattcaaaactttaaccagcaatgcccggtga

SEQ ID NO: 47838 - DNA, 246 bp, Glycine max
  Peptide Sequence Number=SeqID_139523
atgaggggcaccgtgcatgagcctcaagtgaacataggggccgatcaaaaatttcctacatctaatatccagtcgtgtggatttgggatgaccgaccctctcgatgagtcgatctcttgctttctcataagggtgaaccctttgggtactagttaccctcaccatcagagggctacacgccctccccatcagaggactacacgtcctcgccttgagagggctacacgccctcaccttgggtactag

SEQ ID NO: 47839 - DNA, 222 bp, Glycine max
  Peptide Sequence Number=SeqID_139524
atggggatgtcttctccacctctaatcactcacaaactcatctcaagctctcaggacaacttcctcttcaagctccattctctgcaggtctttgcacagcaaaatctctcaaactctctggattcagacccttctctctctagaatctctcacatgcagaagctcctcgagaaaatggccaaaatccctggaacttggacctgtctctctagaaatctctaa

SEQ ID NO: 47840 - DNA, 556 bp, Glycine max
  Peptide Sequence Number=SeqID_139525
atgaccggccctctcaatgagtcaatctcttgctttctcaaaagggtggacccttgggtactagtaccctcaccttccgaggactacatgtcctcaccttcagagggctgcacgccctcgccttcacaggactacacatccttgccttcagaggactgcacgtcctcaccttcagagggctacatgcacgccctcaaaggactacgcgtcctcacctttagagggctacatgccctcgccttcaaagggctactcgccctcatcctcagaggactacgcgtcctcaccttcagagggctacatgccctcgccttcagagggctactcgccctcatcctcagaggactacgcgtcctcaccttcagagggctacatgccctcgccttcagagggctacatgccctcaccttcagaggactacacgtcctcacctttagaggactacacgtcctctccattagaggactacacgttctcgccttcagagggatacacgttctcacctttagagggttgcacgtcctcgccttcagaaggctggacgccctctccttta

SEQ ID NO: 47841 - DNA, 770 bp, Glycine max
  Peptide Sequence Number=SeqID_139526
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagttaacctcttacacccactgccttcatggcaaaacataacaaaagcaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 47842 - DNA, 612 bp, Glycine max
  Peptide Sequence Number=SeqID_139527
atggataatgaaaagggcgtgcaggaacagatgaaggccgatctatcggccttaaaagatcaaatggcttccatctcggatgtcatgttaaaactccagaaaaccatagaggataaagccacgacaaccgcctccagtacagttagggaagcggagccggtgctgcagcccgccttgaatccgagcctagacagaaacacggccgtgttcggtcgaatgtatagtccgcaagcttatccttatggcttgcctctggatttcactccccgtgccaccccggaagatctaagccaagcccctacttttgaggggcaactcccgccttatgacaactatcccggacaagacgatggggaaggagatacccatcttggccccctgctccacctcaaagatccgtccccccatgaactacccccaccgaacatagtccgccatatcccggcctcacccatactcgtaaaagaatctgttcccttcgcggaagataagggaaagattgaggcgcttgaagaaaggttaagagcagtcgagggccttgggcaattacccattctcggatttaacggatttatgtctcgtgcccaatatcttcattcctcccaagtttaa

SEQ ID NO: 47843 - DNA, 336 bp, Glycine max
  Peptide Sequence Number=SeqID_139528
agatctttgtctatcggtgctggtgtggtttcctccattggataccgcaaagagagggatggttcctgggtgaagaaagacgctcagccacaggcagcagatgatcgctctccttctcctcctcctcagagggatgactcttcatcctttatgcaaaacgttctagacaagttggatggtctcctcacctttgtcggtgagcgttttgactccttggacagccgcattgatgtcattgatgcacggtttgcaggaatggatacacgcatcactcagcttgaggaggatatgagtttcatttgccagtgcttcgaccttccaccaccgtcttcatag

SEQ ID NO: 47844 - DNA, 261 bp, Glycine max
  Peptide Sequence Number=SeqID_139529
atgtttttcaagagatttactctctgctccattagagcttgtaagcctaggatcttcttcatcaatggattcctttgcttcttggaagatgaatggcagcggaatggagaaagggaaagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 47845 - DNA, 213 bp, Glycine max
  Peptide Sequence Number=SeqID_139530
atgaaattcgtagtagaggacatttggtatcgtatagggcgaggaagacatcttggtgagttgcccgtcctctatgctatatgtggaagccgcagaggagtcattagaaacagtcttctagaatgcttacaagcccggaatgggtttaggaagaacaacggcggagaattccagctgaaaggtcttccagaggaaaccagggagttgggttag

SEQ ID NO: 47846 - DNA, 558 bp, Glycine max
  Peptide Sequence Number=SeqID_139531
atgtgcaacatccgtacgccgggcgcctggagcgcgaaagaagcctcaccgtttacgccgttcgattgttcgcagatcatctggaacgacgcgcctcccctgccgctgccggagtccgatatcgtcggtaaagccacggcgctggtccaggcggtacagcgccagttgcatcctgacccggacgacgattcacacgttagcccggcattacgttcggcaattcaaaaatcaggaatggtactgctggatgacttcggcgatatcgtgctgaaaaccaacgatctctgctcggcgaaagatgactgcgtgcgtctgaagaacgcgctggtcaaccttggcaatacccgcaactgggaagcgctaaccaaacgcgccaccgccggtaagctcgatggggtaaacgtgttgctgcggccggtgagcgccgaatcgctggagaatctggtgaccacctcaaccgcgccgtttgtgatgcgtgaaacctcccgcgcggcgcaggcgttaaatagcccggcccctggcggattcctgatcgccagcgatgaaggcagcgaactg

SEQ ID NO: 47847 - DNA, 210 bp, Glycine max
  Peptide Sequence Number=SeqID_139532
atgtgggtgcaaatagctaccaggcccacttgggccgtccaaaagattcctccagaaggcggttgcttttggaggaagctacctagctcgcctgggcgagctggaaaatccaagccgaggcacttccgtaacgtttccgtgggtgatttcgcgaagattttcaaccgttctttgacgttcttcgttcgttcttcggtcttcaactggtaa

SEQ ID NO: 47848 - DNA, 408 bp, Glycine max
  Peptide Sequence Number=SeqID_139533
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctcggatcccgattggaccaatgcgattcgtcgggaaacctgtcgtgccagctgcattaatgaatcggccaacgcgcggggagaggcggtttgcgtattgggcgctcttccgcttcctcgctcactga

SEQ ID NO: 47849 - DNA, 261 bp, Glycine max
  Peptide Sequence Number=SeqID_139534
atgggtgaagtagacgaggtgcaagagcggataaaggatgacatggaggccatgaaagagcaaatggccacaatgatagaggtcatgatgagcatgaagaagataatggaggtcaatgcggctgtagttgccactactagcgccattgctaaagtgaacctgactccctcatctagcctcaaccaaataaataatctcatctcgggtatggtaggcaaagaattgggaagtatgggcgggccccattttgtgcaagtttag

SEQ ID NO: 47850 - DNA, 387 bp, Glycine max
  Peptide Sequence Number=SeqID_139535
atggcagcacagttgatccatgatcgcgttgtgatggaatgcctaagggtgtttgggagaccctcgaaggcaatgagagtacatccggagcaacctgcacacacacttcagcagcctgtggagtggatactacctacacctactccatatcgactagttgagccggttcaagtgatagaggtgtcatcctctgaagaggatcttgaagaggacccagaggagttacctcctgtacctgctatggacgcccctgacttaccagaggatgatgaggacccactccctgatgttgattctccagaggatattatattagcatctgaggcagactctacagaggagagtggccctggagggacaacgaatagtgacgactcttcatcatag

SEQ ID NO: 47851 - DNA, 213 bp, Glycine max
  Peptide Sequence Number=SeqID_139536
atggctgatgaacatcaacatagggttacccttgaggattattctagtagttcagtgccgcaattctttacaagagaagccaagaagtggctccattcatttaaaggtaacaatttgaagacgtgggaggaagttgttgagaaatttctgaagaaatacttccctgagtcaaagactgcagaagggaaagttgttatttcatcatttcactag

SEQ ID NO: 47852 - DNA, 435 bp, Glycine max
  Peptide Sequence Number=SeqID_139537
atgcagaatccgaaaaatgtgagtgccatcaccttgaggtctggcaaccaaattcaagtgcctccaccagtagcagcacctgcacctgaacctgtcaagcttcattctacaccagaaaaagaggatgagatagttgcacaaaagagaaagcttcctaacaaaaattttcatgcaggtggaccttcttctagtaattctaacttacagcagcctcctatccctcttccattcccacctagagcaattccaaacaaaaaaatggaagaagcggaaaaggatatcttggagaccttcaggaaggttgatgtaagctccattggagcttgtaggcctaggatcttcttcatcaatggattcctttacttcttggaagatgaatggcagcggaatggagaaggaagagagagaggagacgccacttcaaggagaagatga

SEQ ID NO: 47853 - DNA, 651 bp, Glycine max
  Peptide Sequence Number=SeqID_139538
atgacatctgagtcggcacaggaaatcgcagataaaattgactccttagaagaacaggttacgcagggctcatttgtaccccatggtcggcaagacatactgaacactgccattgggcgacctaaccatgggggtcgcgttcgtgtagcaggctcaggtgtcactattactcagtactacggaagggcattaaggacatgcagcaactcatccacatccatcactcaacaacaattagatgaagttattgcaaggcttagggaaggcatgagtggtcaaattagggaagaattgaggagtcagattaaggaagaattgaggactcagctagaagaggaaaataaaaggagcttggaaagaatgactatggcattgaaagaggctattaaaatagagttgtcacataaaggatccctagagtcactaataattcagccggaactacaacaattaggcgcgcgtgtcagcactaagggaagtaatgctcaaagcaatgcccagccttcacgggaatatgatggtgatgtgataccaaagatgggactgtatgtgcaacgtaaggatggtacactagggttggtggccatggggagaataatggatagggattcagtgatacgcactgtggcttatgcagatgatgttgtaagg

SEQ ID NO: 47854 - DNA, 217 bp, Glycine max
  Peptide Sequence Number=SeqID_139539
atgacggtgaaaacctctgacacatgcagctcccggagacggtcacagcttgtctgtaagcggatgccgggagcagacaagcccgtcagggcgcgtcagcgggtgttggcggagtgcaccatatgcggtgtgaataccgcacagatgcgtaaggagaaaataccgcatcaggcgccattcaccattcaggctgcgcaactgttgggaagggcgatcg

SEQ ID NO: 47855 - DNA, 291 bp, Glycine max
  Peptide Sequence Number=SeqID_139540
atgcggcaatttggatacagccagaccatttctactctgcctgtcgattcatgggtgtcgtatgatgatatacacgagaggtggatacactactcggatcatatggttccagcagatgaggtgtgcgttgtgtcagtcatccctcaagccccacagacagatatccctcacgtgccggagccaggagcaccgtcgacatctgcgaggcccgctgtggaggagcctagacatgcagtggttggagcgccatctgagcctaggggtggtcacgccagactcatcgacacatga

SEQ ID NO: 47856 - DNA, 400 bp, Glycine max
  misc_feature (92)..(92): n is a, c, g, or t
  Peptide Sequence Number=SeqID_139541
cgccacgcttcccgaagggagaaaggcggacaggtatccggtaagcggcagggtcggaacaggagagcgcacgagggagcttccaggggganacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccagtctttctttgaagaatggtag

SEQ ID NO: 47857 - DNA, 261 bp, Glycine max
  Peptide Sequence Number=SeqID_139542
atgggtaaggctgttaagactgaattaatgaggtttagcctcgcatttgctaataatgggctgccacacagacctatttttagagctgacccctacaggaattccaaggtaagagaatggaatatccatttaactacaattgagagaagatgctgcctccctacaccagtcctcggatttgcccatacacccaaattttctcttattgtagtttatcttaagaccagagaccaattcaaagcttttcaggatacactttag

SEQ ID NO: 47858 - DNA, 527 bp, Glycine max
  Peptide Sequence Number=SeqID_139543
gagggacgccgcgcctgaagggaccaatgccacccctgactatgatagccaccacttcaggagcgccgagcaccaggacgatgagtacaccgattttcaggaagagatagctcgccgacaatggacgtcgctggtcactcccacggctcagtttgacccagatatagtcctggagttttattcttatgcttggcccacagaggagggagtacggaaggccagaagtgtgactttagtcagaggaggaacagggccgatgcggttcgacgaagaggccgttgcccagctattatgcataccgggtcaggatttcgctcggaccgctgcagggaggcgggtgcggatcatgcgcaccagcatgaccacattgaccctgatgaggatgacattgctgctcagcaatgtcttgcctagtgatcataactctgaccttcctttgccgaagtgtcagctggtgtatgccatcctgacacggatgagcgtctatgtggctcagttgattgctgacaccatctatttatttgcag

SEQ ID NO: 47859 - DNA, 342 bp, Glycine max
  Peptide Sequence Number=SeqID_139544
atggttaggaccagaggattaggtcgtgccttaggtcaggttactggcaaaggtgtgggcagaggagatcatgatgattctgatgatgctccgcagcgtcggcggcctactgcatcagcacggaggcagcgagtcgctgtgactgcggatcacgtcgatgagccagtcatcccttcgccagatgttcaggatgacccgatggaggcaccagttgctgtagaggacattcctgcggacacaggcgcagaggctgctgaggacgcgcatgagggatttccgggtggtccgagcgacccatccgtgttgaccttgtatgcggatcacgttgcttgcagcgtatga

SEQ ID NO: 47860 - DNA, 270 bp, Glycine max
  Peptide Sequence Number=SeqID_139545
atgtatgcacaaaacaaaagtcaatcaaaacgaaacaaacgtggggtggtcgacaaaagcagggcttttgctcctacgtatcctcaatttgtgatgaggaactcaacctacgtagttcttgataattgtgagactaaaaatagtctcggtgttttctttaccaaaatgcgatcatgctttagtaaagagacaaaacttccaactgatcagagcaacatatgctttttggatgaaaaacaatgtgtctatcggggaaggagagtatgctga

SEQ ID NO: 47861 - DNA, 192 bp, Glycine max
  Peptide Sequence Number=SeqID_139546
atgaccctcaggcgtaaggtgcaaggtctaattgatgcgggctggctgaaatttgaggagaatcgcgtgattttcaagtgcaagccattggtcagtttgctcaagcgacctgctcctgagtttggacttccaagaccgttcaatcagagattactcgtcttgcacgttggtggggttgccgtaaaacaatga

SEQ ID NO: 47862 - DNA, 576 bp, Glycine max
  Peptide Sequence Number=SeqID_139547
atgttatccttcaaccagatgcagtcccagtttcaatcacagatgcaatcacagggactcacactgccttttgagcctgaggttggtccttcagctgctcgtgtcagtacaaaggagagttgtgttggtccctcaaggaatgatccagacacgggtaactcagacaaatgtgggttgtacgtcgaagaaaatcctccccacctggttaccctaggaagactttatgaggggtccacaatcgttaacaacatatctttgctccatgatcaagtcaaggttggtgttgaggaggttagagatgcagatgctcccattcctgtacccactgaagagggagttgtgggaccagcaaaaccttcagataggccagatcatgatgtcaatgatcccctatatctgatgactttgaccatcccacagctttttctgaagccgttgcaggttatgtgggatgatatcgtgtttggggtgtttaatgacaacttccccttgtacataaagtatgaagatttatctgaaatagcacacggtggtcaatgtctcaggatctctattatacagttgtggattctataa

SEQ ID NO: 47863 - DNA, 205 bp, Glycine max
  Peptide Sequence Number=SeqID_139548
tgctggaagaggtcttgatgatgctccacaacctaaatcaaaggctcctgctaggtggattgtcgtcaagatgcccaccatcattttaggaacttttaggaataattgggaagcgtattttaacgatcctagaccattggagccagagagattaaaggcattgtggatccagtgggcacaattttatctccgagttagagattag

SEQ ID NO: 47864 - DNA, 521 bp, Glycine max
  Peptide Sequence Number=SeqID_139549
aggactacacgtcctcgcttttagaggactacacatcctcgccaacagagggctgcacgccctcaccttcagaggactacatgtcctcgccttgagagtgctacacgccctcaccttgggtactagttaccctaccgaccgcttgagaggactacacgtcctcaccatcagagggctgcatgccctcacctccagaggactacataaaggactacacgtcctcaccatcagagggctgcacgccctcacctccagaggactacatgtcttcgccttgagagggctacacgccctcaccttgggtactagttaccctcaccgtcagaggactacacgtcctcgccttgagaggactacacgtcctcaccatcagagggctgcacgcccttacctcctagaggactacatgactacacgtcctcaccatcagagggctgcacgcccttaccttaccagaggactacatgtcctcgccttgagagggctacacgccctcaccttgggtactagttaccctcacc

SEQ ID NO: 47865 - DNA, 279 bp, Glycine max
  Peptide Sequence Number=SeqID_139550
atggcttctatggacacctctgctatggtcaattctaagatctttccatgcaatctaggaatgcgggggtccggggaatttgtccccttcttagatacgacgtctaggggtagcaaaatgccccaacgcacgtttttaagaaggcgacacggaccctccgttggtttgtttacagtagggatcaagaagaacccgtatgcaatgcctatgcaaaagacacaatgcgggaatgtgcacagtatgacaatatttaccgaacataagcaaaagggtatatga

SEQ ID NO: 47866 - DNA, 689 bp, Glycine max
  Peptide Sequence Number=SeqID_139551
atgatcggccctctcgatgagtcgatctcttactttctcataagggtggacccttgggtactagtacctatcgccttaagagggttgcatgccctcaccttcagagggctgcacgtcctcgccttcagagggctacacgcccttgccttcagaggactacacgtcctcaccttcagagggctgcgcgccctcgccttcagagggctacacgccctcgccttcagagggcacacaccctcaccttcaaaggactacacatccttaccatcagaggactacacatcctcgccttcagaggactacacgtcctcgccttcaaaggactacatatcctcaccttcagaggactacacgtccttgcttttagagggctacacgccctcgccttcagaggactacacgtcctcaccctcagaggactacatgtcctcgccttcagagggctgcacgccctcgccttcagaggactacacgtccttaccttcagaggactacatgtccttgccttcagagggctacacgacctcacctttagaggactacacgtcctcgccttcagagggctacacgccctcgccattagagcactacatgtcctcgcctttagaggactacacgtcctcgccttcagaggactacccgtcctcaccttcagagggctacacgccctccccttcaaaggactacat

SEQ ID NO: 47867 - DNA, 228 bp, Glycine max
  Peptide Sequence Number=SeqID_139552
atgggagtagaaaatgggattatcatcatcaaaaagggggagattatggaagcaatgctttccaagattattttgatgatgccaaagactcaagtcaagaatcaagagtcaagcaagtttcaagaatcaaagagttgttcaatcaaagcaagtttcaagaatcaaagagtcgttcaatcaagattcaagattaaagtgaagattcaagagaagactcaattaagataa

SEQ ID NO: 47868 - DNA, 204 bp, Glycine max
  Peptide Sequence Number=SeqID_139553
atgtgggtgcgagccattggtctgtttgctcaagcgacctatgctcctgagtttggacttccaagaccgttcaatcagagattactcgtcttgcacgttgttgggggcaccgtaaaacaacgagtaaaggacaacccttcccttgtgttcaagaatcccctacaacaagagacccacggtctcttaatcccttttcagaaataa

SEQ ID NO: 47869 - DNA, 387 bp, Glycine max
  misc_feature (347)..(347): n is a, c, g, or t
  Peptide Sequence Number=SeqID_139554
atggcaagagctggtgacaatggtggtgtatatcatcaattggacgaatctcagcgcttatttttggacgcgtggactacacaaatgcaacgtttgttgaaccgtaacaaagaagagccctacagacgaatagccaaatcttcctcgtttactcttaaacctctatcccctagaaaagtgtgtgatgaccaaatcagaatgagagaaaagagagaacaagagaaagaaaatagtgaggcaccacaaaggaatatgaaaaagaagagtgatacacccgaggaaaagagtgatacacaagagagagagagtgataattctaatcagaatttaaagatgtctttcccaanggagattcctcaatggactgccacacttcaagaagcatag

SEQ ID NO: 47870 - DNA, 151 bp, Glycine max
  Peptide Sequence Number=SeqID_139555
atgaaaattctaagttcaggagttgtatttacgcttgaggaagtcgacaaaagcggggcttttgctcctacgtaccctccatcaaagaggaaatcagacctacgtagttctttcttatgcgtgaatgaagtgattcttttttacttgaaag

SEQ ID NO: 47871 - DNA, 599 bp, Glycine max
  Peptide Sequence Number=SeqID_139556
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagaccttggacaccatgaagttggcgattatgatggagacaaccatggggtcgtcttggctagtgaggttgatacccttgaagtttctatcagtgaaagtgataggagggagacttcagggcaatggtgtatcgacatagttgatatctatgccctgaatggcatggaggtggcactttcaggactagttagactattctctgtaagagaatctgcctataatggtgttgatcacccctcttatttgttgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 47872 - DNA, 252 bp, Glycine max
  Peptide Sequence Number=SeqID_139557
atgtataattatgtactagggacctccagtaaaatttcggagtcgatccaacggttaaattgcagatcgcgatggcagctgtcgcaacgtgcccttcgcgggcgagcgagggcgaggctcacgggtgcgctttccaaaggaggaaagatgcgcggagtcgccaccaacgtttatttgtggaaaacgtcgggaaaaccgaaggaaactggtcaaaatgaaaattctaagttcgggagttgtatttacgcttga

SEQ ID NO: 47873 - DNA, 333 bp, Glycine max
  Peptide Sequence Number=SeqID_139558
atgatcttaaaagaagagttagctgcttgcgcaaggtccaagaggagtttggatcaacacttggaagccacggagcaaagcatgctagctatcatagggcagtacaaggaagagttgaaccagtctgtgacccatgaacaaaagctagtggaggattttgcacaagtgtacgccgaaaaagaagtttgccttgaccttgaatggaagtcaagacctcccgcgtctattagcctaagcaaaagccatggccgaagtgtgtacgggccccgaggagattcatgggctaatcaattactgtcagcacatgatagatttgatggcccatataattag

SEQ ID NO: 47874 - DNA, 84 bp, Glycine max
  Peptide Sequence Number=SeqID_139559
atggactccattgatgaagaagatccaaggccttcaagctcccatggagctacatcatgtggttctatcatttttcaatcataa

SEQ ID NO: 47875 - DNA, 672 bp, Glycine max
  Peptide Sequence Number=SeqID_139560
atggagagaagtatgatagatgctgccagtggtggagcccttggagacatgactcctgctgaagccagaaatttaattaagaagatggcttccaactcccagcagtttacggccagaaatgatgccatagtcattagaggagtgcatgaggtagctacaaacccatctgcatcatctgaaactaagaagcttgaaggcaaactggatgcattggttaacctggtaacccaactggccttgaatcagaaatctgtacctgtcgcaagggtttgtggtttgtgctcctctgctgaccaccatacagacctttgcccttccatgcaacaacctggagcaattgagcagcctgaagcttatgctgcaaatatttacaatagacctcctcaacctcagcagcaaaatcaaccacagcagaacaattatgacctctccagcaacagatataaccctggatggaggaatcaccctaacctcagatggtccagccctcagcaacaacaacagcagcctgctccttccttccaaaatgctgctggcccaagcagaccatacattcctccaccaatccaacaacagcaacaaccccagaaacagccaacagttgaggcccctccacaaccttccctcgaagaacttgtgaggaaaatgactatgcagaacatgcagttttag

SEQ ID NO: 47876 - DNA, 411 bp, Glycine max
  Peptide Sequence Number=SeqID_139561
atggtatattctgttgggagggttgaaagaaggcactacgaggataccatggctgaacagagagcttatgcttactggaaaggtaatccagctgttgctgaaaccagacaagacctcattaaatgcaatgtttctgaaaatcaagattggaatgctcgtttatttgcccaggattggtttcgagaatcacaagaggggttcaacaaatcagacttgccaagtcaatgcacttatagatataaggtgtacattgaaggttctgcttggtcagtcagtcaaaaatacattctgtcatgtgactctaccactctacttgtaaaacctaaatactatgattttttcacaagaggactgattccagtgcaccactattggcccataaaggacgatgacaagtgcagatccatttag

SEQ ID NO: 47877 - DNA, 542 bp, Glycine max
  Peptide Sequence Number=SeqID_139562
ccagaggaaaagaaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggggtgaaatgccactcgaacccagagctagctggttctccccgaaatgcgttgaggcgcagcagttgactagacatctaggggtaaagcactgtttcggtgcgggccgcgagagcgcttcatcgtcgagaggaaacagcccggatcaccagctaaggcccctaaatgaccgctcagtgataaaggag

SEQ ID NO: 47878 - DNA, 429 bp, Glycine max
  Peptide Sequence Number=SeqID_139563
atgaaggcaaccattaggtccttccaagagtggactcgagaagtcattagagaccagcattcttccttttcagccagccccatcaattccgcactctttacgatcttagggcaagtagccccttgggtataccaccaactgcttgcccttcagtggcatatccgagccaaggctcgaagtcggctagattgtgatggggaatttcatgtatctcccccacggttaagagacatgtgcatatcagttgggttggtgggaaactctcaagggtattggaatggcagtcacagcacgggtttctccttcatcctcaccctcttcatttgccccagttttctcattcgtctaagcatgatgactaaatttgccttttttcagacccacaccgatcctttcactggcaaagaccaaatccgcaaagctttaaag

SEQ ID NO: 47879 - DNA, 582 bp, Glycine max
  Peptide Sequence Number=SeqID_139564
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccccttcaaaaatatatgttgctctaatcgagacaagcgagtccgatagcacgcagagagaaattatggtcatccgtcgcccctttgccatccaaagacaagcgagtccattggcacgcagagacaaattatggttatctgctcctttttggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 47880 - DNA, 156 bp, Glycine max
  Peptide Sequence Number=SeqID_139565
atggcagaagagcatgaccaaaggattacccttgaggattactcaagattacctaatgaagatccctatgcacacttggcaatgttcattgaaatatgtaacactattaagatcaccggtgtaccagatgaagctattaggatggggatcctctag

SEQ ID NO: 47881 - DNA, 452 bp, Glycine max
  Peptide Sequence Number=SeqID_139566
gcaatccatctgacttacaaccctttgatcctgagatagataggacatttcatagattagttaggcatcattttataccttttgatcattctgagcattccataactggtgaatctgtacattctgttattggtgattttgaacatcctgatcttgagcattataattttgagcattctgattctgagcattctgattttgcacattctgagaacatgacacaacctccacctcgtgagaggactctaagggaaatggctgcacctgatttcacctatgaaagcttgtgcatccaataccctgatgtggatgtcccatatgttcttaaaactgaactgattcatttgcttccaaagtttcatggccttgcaggcttttcctcattcattagagggagtggcaaaggactggctgtattaccttgctccaaggtccatcacgagctgggatga

SEQ ID NO: 47882 - DNA, 465 bp, Glycine max
  Peptide Sequence Number=SeqID_139567
atgtaccctctcttgttctcagtcacaacaacccaagtagatgtatcctctacttgtaccacaaaggatgtaccctccaatgtgttaagacaaagttctcaggcagttagtccttccttcttttggaaaagggagaagagagacacaaaaagaattcaggcggttagtccttggcgaattctttttggcaaagggagaaagagagacacaaaagaattcaggcagttagtccttcgttcttttggaaaagggagaagagagacacaaaaagaattcagacaattagtccttggcgaattctttttcgcaaagggagaagagaatgaaaagataaatagcacacttttgttttcaatgtttagaaaaccagaaaactttagaaagcttttggcaaaggaagaagaagaagaagatgttcaaagagattcaaagattgtaaaggattgtaataattgttatgaatga

SEQ ID NO: 47883 - DNA, 333 bp, Glycine max
  Peptide Sequence Number=SeqID_139568
atgacgctgcaggttaagccagaattcaatcgaggtggcgaaaacccgtgccagccggtaggccatctcagtgctgagtttacggttgttattcaccagcgcgctgacggtgttgcgatgcacattcagcatctccgccagatcattcactttgaggttgagcggttcgagaaattcatactgcaggacgtcccccacgctggtgctctctttggtacgggtagcgggccagaagggatcgttagcgctattttttgtagcggtgcggatccagatacagatcccaggcttcgccttttgcccactggaaaattagccgatactgcgcgttaa

SEQ ID NO: 47884 - DNA, 332 bp, Glycine max
  Peptide Sequence Number=SeqID_139569
acgaatgggctccattcattgatgtcctgacactcttgatcttcggagtgctcctctttccaaacgtggatgggttggtggacctgacagcaattgacgcttttctcgcctttcacgaccgtaaggaaatcccgctcatcgctatcttagccgatctgtatgacacattcgaccgaagatgtgagaagaacagtgcaaggattgtttgttgtacactgaccctctacgaggcaaactgggaccgactcttagcaagcaaagaaggagcgtccgtcaattggttccctcgatggaaggaaggaagaaccgacattctcgtctcatgtggatga

SEQ ID NO: 47885 - DNA, 332 bp, Glycine max
  Peptide Sequence Number=SeqID_139570
atgaattcattgcctagcgctgttcatgtgtcctccaccttcgagtctggagtcccgcgaattgattgccttgcgcttttcgccaattctccattctccacttttattcggagccccatgaatttattgcctagcgctgttcattctggagccccgcgaattgattgcctagcgctattcgccaattctccattctccacttttattcgcagccccatgaattcattgcctagcgcttttcatgtgtcctccaccaatgagtctggagccgcgcgaattgattgtctgacgctattcgccaattctccattctccactttttgcggagcccc

SEQ ID NO: 47886 - DNA, 421 bp, Glycine max
  Peptide Sequence Number=SeqID_139571
aggcaccaacaccttcttcttctacacttcctccctcttcctccacagagatcccagtgattcctccatcaccttcacagattccacttccagctccagtctctgcagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 47887 - DNA, 382 bp, Glycine max
  Peptide Sequence Number=SeqID_139572
atgactagaggcaatccatctgacttacaaccctttgatcctaagatagataggacatttcatagattagttaggcatcattttataccttttgatcatcctgagcattccattactggtgaatctgtgcattctgttattggtgattttgaacatcctgattttgagcattacaattttgagcattctgattctaagcattctgattttgaacattctgagaacatggcacaacctccaccccgtgagaggactctaagggaaatggctgcacctgatttcacctacgaaagcttgtgcatccaataccctgatgaggatgttccatatgttcttaaaactggactgattcatttgcttctaaagtttcatggccttgcag

SEQ ID NO: 47888 - DNA, 216 bp, Glycine max
  Peptide Sequence Number=SeqID_139573
atgaagcatagctccaaactctttgggtcgaggatgcaagatcgaaaacgcaattcatggggctccgaaaaaaaggcgaggatggaggattgcactagagggtccttactagtcaatgatgaagcatggctccaaactctttggatggaggatgcaagatcgaaaaagcaattcatggggctccgaaaaaaaggcgaggatggaggcttgcactag

SEQ ID NO: 47889 - DNA, 222 bp, Glycine max
  Peptide Sequence Number=SeqID_139574
ttaggcatagtgtgcagcttggtcattctgtgcattttgagcatcctgatcatattgagcattttgttgctggtgattctgaatattctgattttgagcattcgaatactaattttcatactgagaacatggctcaacctccacctcgtgagaggaatcttagggagatggttgcacctgatttcacttatgaaagcttgtgcattcaatatcccgatgaag

SEQ ID NO: 47890 - DNA, 144 bp, Glycine max
  Peptide Sequence Number=SeqID_139575
gagcagaattgtcttaagcagtggtcaattgctgggatgggtctgaagggacggacgcaagtagaggctaggatcacgatcgatagatcgtcatctcatgcccagcactggacaagcgggaagcgcagctgggggacaacctag

SEQ ID NO: 47891 - DNA, 480 bp, Glycine max
  Peptide Sequence Number=SeqID_139576
atgacagatcttgtgagggcggaagatgacgtaaatctccacgtgccaacgggcttgtcggccgcgattgacgaaggcgcagaagacgacgttagtctctgcgtgttatcaggcttttcgtcttacagacagcaaaaagtttatacggataaccactcgggtatttccgccgtcagcgtgactcaaaaacagcaaaaagtttatacggataaccactcgggtattttcgcccgtcagcgtgactcaaaagtcagtatgacagatcttatgagcgcggaagataacatacttgtgagcgcggaagatgacggaaatctccgcgtgccaacgggcttgtcgatcgcgattgacgaagggtcgcagaagacgacgttagtctcggcgtgctatcaggcttttcgtcttacagacaacaaaaagtttatacggataaccactcgggtatttccggccgtcagcgtgactcaaaagtcagtatga

SEQ ID NO: 47892 - DNA, 234 bp, Glycine max
  Peptide Sequence Number=SeqID_139577
atggacatcaacaactctctgctatctcatgatgttggtttgttggatgagcatgttgaaaagaagggtacatcctttgtggtacaagtagagggtacatctacttgggttgttgtaactgagaacaagagagggtacatctcttgtggatcagttcaagtagagggtacatccacttggttgttcaaagagaacaagggagggtacatcccttgtggatctttgcttgtaaag

SEQ ID NO: 47893 - DNA, 230 bp, Glycine max
  Peptide Sequence Number=SeqID_139578
ttgagcctgttcaattgatagaggtgtcatcatctgaagaggatcttgaagaggacccaaaggagctacctcctgaacttgctatggatgcccctgacttaccagaggatgatgaggacccgctttctgatgttgattctccagaggatattatgtcagcgtctgaggcagactctacagaggagagtggccctgaagggacagcgaatagtgatgactcttcatcatag

SEQ ID NO: 47894 - DNA, 265 bp, Glycine max
  Peptide Sequence Number=SeqID_139579
atacaggaattttgagcggttgcatcggcatcttaaagatattcccaattacacattgcatttgcctcctaaaaggatattttcctcaagcacagatgatgcctttgtacatcaacgttgcattcaacttgataaatatctccaggatctcctgtcaatagctaacgtagccgaacaacatgaagtatgggatttcttcagtgtttcctcaaaggctatagctattctatgtatggtggcccctcctgttaatcttctgagttaa

SEQ ID NO: 47895 - DNA, 474 bp, Glycine max
  Peptide Sequence Number=SeqID_139580
caaggaaagtccagtggtagctatcttggcgggatttgttcgatacctttgaccggaggtgtgagaaaaacagtgcacgggattgtctgttgtttaccccgctctctgtgtgtggttgatttcacacctattccgacaagacacgagacaccccacgatcaattggtttcctcgttggaaggaagggcaaggaaggagttcttttctcgtgtggggactattcttaatgttccactgatagggactaggggttgtattaattataatcccgcactcgccataagacaactaggatatcccatgaggggagcgccaaccgaagaaagtcttttgcctttccttgtgagagatctaggcgcgcaaggtctcaaggttatacaaagaatcccacaaggcgtggaggagtccgtgaggaaagacaaggagctagaggcatccgaaacggcgtcatcggaggttatcatggatggctaa

SEQ ID NO: 47896 - DNA, 336 bp, Glycine max
  Peptide Sequence Number=SeqID_139581
atggaaatagttgatgtttcaccaatcaaggttgacatagtggaacagattcgaacaactggactcttcaaacacgtcacaaggtggttggattctaaaagttcatgttgtaatactttagcaaaccttggtgacaaagatatgttaccagcacttgctgccaccaaagcatctgaagttgtagccttagggaagctgaaaactcttactgagagtaccattagagaaagagctttaacagcacaacatagttccatgatcactatctcaaaatttgagtatgagtatctaacaaatcatgcagcctcagtagaagaaattgctgataaaaagtag

SEQ ID NO: 47897 - DNA, 273 bp, Glycine max
  Peptide Sequence Number=SeqID_139582
atggcacaacctccaccctgtgagaggactctaagggaaatggctgcacctgatttcatctacgaaagcttgtgcatccaataccctgatgaggatgtcccatatgttcttaaaactggactgatccatttgcttccaaagtttcatggccttgcaggactctgcaacatggagagaagtatgatagatgctgccagtggtggagcccttggagacatgacccctactgaagccaaaaatttaattgagaagatggcttccaactcccagtaa

SEQ ID NO: 47898 - DNA, 150 bp, Glycine max
  Peptide Sequence Number=SeqID_139583
atggattatgaaaatgaacaagaatgtggtgtgaatgaaccgtatgttgattgttcggatgcttttaatacttctcaggcttcgtgggaaaccagtgcatggaggggaaggttggatggtgaagttgatctgtgggattcacaatcatga

SEQ ID NO: 47899 - DNA, 99 bp, Glycine max
  Peptide Sequence Number=SeqID_139584
atgtccaaccttggctccaaagaggactccttcccaagtagaaaatacaccattggggcacatgtggctgcaacgtggaaaccaacatatcgacaatga

SEQ ID NO: 47900 - DNA, 434 bp, Glycine max
  Peptide Sequence Number=SeqID_139585
ggcgcaaaatatgtatctgcgcgtttacccactcagcttgctcaaaagaaagtttatacggataaccactcgggtatctccgcctgtcagcgtgattcatacgtcagtatgacagatcttgtgagcgtggaagatgacaatgtttatacggataaccactcgggtatttccgcccgtcagcgtgactcaaatgtcaatatgacagatcttgtgagcgtggaagatgaccaaaagaatgtttatacggataaccactcgggtatttccgcccgtcagcgtgactcaaatgtgaatatgacagatcttgtgagcgcggaagatgacggtgcagaagacgatgttagtctctgcatgctatcaggctttctgtcttacagataccaaaagaatgttttgaaagtgcggacaaccacttgggtatctccgcatgtcac

SEQ ID NO: 47901 - DNA, 1221 bp, Glycine max
  Peptide Sequence Number=SeqID_139586
atggcaagccaagagaagtggggcccgtttgcggatattttagctttgctgatttttggggttgtcctctttccgaacattgacggtttggtagacttagccgccattgatgctttcctcgcatatcaccatagcaaggaaagtccagtggtggctatcttggcagatttgtttgacaactttgaccggaggtgtgagaaaaacagtgcatggattgtctgttgtttacccgctctctgtgtgtggttgatttcacacctattccaacaagacacgagacacccgtgtccgcttcaaagctattgctcatgctccgaaaaaggaagagtcgattgggaccaacatttggctgggatagggggcagcgcgatcaattggtttcctcgttggaaggaaggcaaggaaggagttcttttctcgtgtggggactaccctaatgttccactgatagggactaggggttgtattaattataaccccgcactcgccataagacaactagggtatcccatgaggggaacgccaactgaagaaagtctctcgcctttccttgtgagggatctaggcgcgcaaggtctcaaggttatacaaagaatccacaaggcgtggaggagtccgttgaggaaagacaaggagcttagaggcatccgaaatggcgtcatcggaggttatcatggatggctaagaattcatatgcgagggttagattggctctccaaattgaaagttatcgatgaggagaacttcgaagctccggaggaagatgaagaagtccgagctctaaaattagagctagggaaggcgagactcgccaaggagaagttcaaatcagctgctacacacatccggaaagaatgtaccgagttacaagaggaaaacgcggtcactgtaagagcccttgaacaagaaaccaaaagggcccgcaaggaggaatatggccgagagaaattccgaggagcattgtggggtagcaacaatgagctcaagctccgaagaaaggagagagatcggtcacgggtgcatggcatgatcttaaaagaagagttaattgtttgcgcgaggtccaaaagaagtttggctcaacacttggaagccacggagcaaagcatgctagctatcatagggcaatacaaggaagagttgaaccagtctgtcgcccatgaacaaaagctagtggaggattttgcacaagtgtatgccgaaaaggaagcaagggggagg

SEQ ID NO: 47902 - DNA, 251 bp, Glycine max
  Peptide Sequence Number=SeqID_139587
gaaaagccaagaggtggctccattcatttaagggtaacagtctcaagacctgggaagaagttgttgagaaatttctaaagaaatacttccccgagtcaaagacagtggaagggaaagctacaatttcatcatttcatcagttccctgatgaatccttaattgaagcattggagaggtttagaggttgtaccatatgtggtggtactcatgaatccggcctttgcattccttttgaagatcaaatgcaatag

SEQ ID NO: 47903 - DNA, 330 bp, Glycine max
  Peptide Sequence Number=SeqID_139588
atggttacttcaatacttcaacttgactcggtgaaccgtttcgtaaaagcacgagcttggttcaaccccgtaacccagggaatggcaattttgatcgccaatacttcatcaacatttcatagggatgaaagacttgggaatacgcatgctatgcatggaaaatgggaaaacgcaaggtgccccatgtgtgctgttaagaagacgatatggatcttccgacttcccacgacaaaagatgagacccacatacaacgcatgtgtgacggcatgatgcagatgcgcgaaagcgcaacaggggaacttacacagcatggcaatatcctcaaataa

SEQ ID NO: 47904 - DNA, 648 bp, Glycine max
  Peptide Sequence Number=SeqID_139589
atgggtgaccaagaggagacacaggaacagatgaaagccggcatgtcggctttgaaagaacaaatggcttctatgatggaggccatgctagggatgaggcaactcatggaaaagaacgcggccaccgctgccgctgtcagttcggctaccgaagcagatccgactctcctagccaccgcgcaccatcctcccccaaatacgctaggacgaggaaggaacacactggggcacaacaacaacccccatttgggatacaaccgagaggcttacccttatggattgccgcctaattacacgccgccagtcatgcaagatgatgcgggtcatatctcttctcccatccttgaaagggagcctcttcgacagcccgacgaggtccacgaagatcatcaagagtacgcccaaggggatgtcgagttctgccccccgattcccgtcgagggaccgacacccaacactttgcctcagcccaacctcactgcacagccgataatcttgtccacagaaggaccacccccaatgttgttatccccccaaaattcaaagtgtcagactttgacaagtataaagggactacctgtcccaagaaccgtctcaagatgtattgttgcaagatgggcgcacactctagggatgagatgctattaa

SEQ ID NO: 47905 - DNA, 218 bp, Glycine max
  Peptide Sequence Number=SeqID_139590
atgggatcgagtcaagcgccttcgcttaaaaagaggttctatcaagtcaaggtcaagagcctaggaaccacccgtctaaaagaattggggcagttgatcggtcaactccagcgacaagcatttcgcaaagcttatggtaaaatctgggacctagccatggcaaaagtctccacagaggccattgcctccctcgcccagtattatgaccagtcgttgag

SEQ ID NO: 47906 - DNA, 330 bp, Glycine max
  Peptide Sequence Number=SeqID_139591
atgactagaggcaatccatctgacttacaaccctttgaccctgagatagataggacatttcatagattagttaggcatcattttataccttttgatcatcctgagcattccattactggtgaatctgtgcattttgttattggtgattttgaccatcctgattttgagcattacaattttgagtattctgattttaagaattctgattttgaacattctgagaacatggcacaacctccaccccgtgagaggactctaagggaaatggctgcacctgatttcacctacgaaagcttgtgcatccaataccctgatgaggatatcccatat

SEQ ID NO: 47907 - DNA, 319 bp, Glycine max
  Peptide Sequence Number=SeqID_139592
atgtcggggcgttcctccactcgccaatttcccagctggaaatcaggagggcatggtcgtaccaaatccaatgtactcggaacatcatcttcatccgatgacgagtcccccgaaggtactaatacctgggacccgcctatcaacttcgagcaagaaatgaatcaaacggaagatgaagggaacgaggatgtgggacttcccccagaattagaaaggatggtcgcccatgaggaccaagaaatggggcctcatcaagaagaaacagaactagtagacttgggaattggcagtggaaaaagggaagtaaagataggcacag

SEQ ID NO: 47908 - DNA, 339 bp, Glycine max
  Peptide Sequence Number=SeqID_139593
atggctctcattcttatccaaagaaagactaaggtcaaggcattcttggggcagcaccttctaagcccaaagatgattagaggaagacaaaagcaaccccctaagactagtatgcatgagaagactagctctataaagtactttaaatgccttggaagaggacacattacttctcaatgcccaaccaagaaaaccatgattatgaaaggccaagacatttatagtatccaagatgaggctactacttcaccttcctctagtgaaagtgaagaagcaaaatgggaaaaatctaatgaagaaatctacccccaagaagaacgacaacctttaatggcttaa

SEQ ID NO: 47909 - DNA, 447 bp, Glycine max
  Peptide Sequence Number=SeqID_139594
atggtggggtatgcaccttcaagctttgcggatttggtctttgccgacaaaaggatcgaagcgggtttgaaaagaggcaaatttgatcatcctactttgatgagtgagaaatctgcggcaaatgaagaggatgagaatgaggaaggaacccatattgtggctgccattcctacatggccaaacttcccaccagtccaacaaggtcattgctcagccaatatcggcccttctcattacccaccacccattcatccacaaagtttgttggccgcacatccaatgccaagcgcaaaccaaaacaccaaccaagaaatgaattttgcagcgaaaaagcctatagaattcaccccaattccggtgtcctatgctgacttgctcccatatctgctcgataattcaatggttgctataaccccagccaaggttcctcaacctccttttttctga

SEQ ID NO: 47910 - DNA, 907 bp, Glycine max
  Peptide Sequence Number=SeqID_139595
agggctacatgccctcgccttaagaaggctgcacgcccttgccttaagagggctgcacgccctcgccttcaaagggctacacaccctcgccttcagaggactacacgtcctcaccttcagaggactacacgccctcgccttcagaggactacacgtccttaccttcagaggactacacgtcctcgcctttagaggagtacacgtcctccccttcagagggctacaggagtacaggtctcttgcctttagaggactacatgtcctcaccatcagaggactacacgtcctcaccttcagaggactacatgtcctcacctttagaggactacacaccctcaccttcagaggacaacacgtcctccccttcagagggctacacgccctcaccttcagaggactacacctcttcgccttcaaaggactacacgccctcgccttcagaggactacacgtcctcaccttcataggactacacgccctcgccttcagggggctacacgtcctcaccttcaaagaactacacaccctcgccttcagcggactacacgccctcaccttccaatcgagtcatttgagacccaaaggcacccttgttgatgactggaagtttgattattctattcatgatgctcgccatatggctcacttgattcggtaccggatgcataaggcattacggaccaatgcacctctcccttatcctcacctcgtcaccctttttcttcatcatttcaaaattcctttggaagatgaaccatttgttcaagtaaaaaggtcttttgctattagtgctggtgcgattatctcgtttggttaccgtaaggatgatgatggtcagtgggttcggaaacaaaacttacctcaaccaatccctgacgaatgtactctttctcctccaccgataagg

SEQ ID NO: 47911 - DNA, 342 bp, Glycine max
  Peptide Sequence Number=SeqID_139596
atggataaagttgatatctttgtccctcatcctctcacaaacgcatgtttgcttattcaactttcaccggaatggtggggtgtaagtcattgggtctgtttgctcaagcaacctgcgctcctgagtgttgacttccaagaccggttcaatcagagattactcatcttgcacgttggtggggagagaagtgagttatcaagaataggatgttggacgaatggcctcagttaccttaagaaaaagggggaatcctctacaacaagagacccacggtctcttaatcccttttcagaaataagaagaagagaagaagaggtctctcgtaaaagaggtagattgtaa

SEQ ID NO: 47912 - DNA, 396 bp, Glycine max
  Peptide Sequence Number=SeqID_139597
atggaaattggaagttggaagtggaagttactggaagttggaaatgaaagttattggaagttgaaagttgaaaatggaggttggaagttggaaggggaagtggttgtcatcatgaaaaagggggagaatgtaaatcatgaagattttgatgatatcaagaagaatttgcttgagaaagagggagatgtaaatcatgcaagctttgatggtgtcgagaagaaatcacatgtttgtcatcatcaaaaagggggagaatgtgaatccttgtttcaagattcactaaagaccaagtcttgccttaaaacaatgtgctttcaagacatgcaaggctctggtaatcgattaccaggaagtgtaatcgattaccagaagacagggttgagaaatagctgttga

SEQ ID NO: 47913 - DNA, 378 bp, Glycine max
  Peptide Sequence Number=SeqID_139598
atgactttcaaaattgccccatgtgtggtgtcgcttgtcaacgtcgggacttatacgcgattctcctcaaatttcagccaggccgcatcaattagactttgcaccttacgcttcagggccatatcagaattgtacttgtcgcaacctacccttttgcgggcgagtgaggcgaggctcacgggtgcgtcttccaaaggaggaaaatgcgcggagtcgccaccaatgtttatttgtggaaaacgtcgaaaaaaccgaaggaaaccggtcatgaagaatattccagatttgggagttgtatttacgtttgaggaaggtcgacaaaagcagggctcttgctcctacgtaccctccatcgaagaggaaatcagacctacgtag

SEQ ID NO: 47914 - DNA, 747 bp, Glycine max
  Peptide Sequence Number=SeqID_139599
atggggtggtataggcgtaaagcaaagatgtttgtcgacccaaacaatgcaaacacaactgcattgggtgacgttgtggagactctacagtatatggtgtcaccacaagggaggaacacatggacagttgatgatctcgtgccttatgtggataagttagtgattatatcagaagagcaagagagaatcactgagccagtgtcacatggtcgagcattagagcgtgaatttccagcacaagagtttcacattcttcagtcaagtgttgaaactcgaggcatagggagacaaagggagcctgttaaagcggaacaatattcccaacaaatgatggagcgtggtcatggaatgtattacacgccagcgacattttccgaatatccttcacagatgtatcaatatccttttgaaggtcatcacactaatacttctgcgagcgaacattcattcggtggtgttgcggaaacacaacctcatttttcatggcccactatgactcattcacagcagcacgatgcccccatggcaacacctaacgccccatttgcttcgcaatggaatgtacccggagcaatacctgatatgggcgacttattaggtgttgatttgcgtcaggagttttctgctgaggctgagcaagcagaagtggggagacaacgtggcagaagaaattctgatcgtcaagcgcgaagatgggatcgaccatgtgacacatcctcacgacatcacggacaccataatgattga

SEQ ID NO: 47915 - DNA, 237 bp, Glycine max
  Peptide Sequence Number=SeqID_139600
atggggtgtacccatgggcccgaaatctaccctaaggctcataagaaccctagggccttctcttgcatctctggcccaatctacttggagttttctatccaatgcccttgcggggcctgggcaggagaggcaccagcagaggctccagcagaggctcccgacgaggcagatgaggcccgcgaggacgaggagatgaccgatttacttgatttcttaggaggaagcggggccacatga

SEQ ID NO: 47916 - DNA, 333 bp, Glycine max
  Peptide Sequence Number=SeqID_139601
atgattatgaggggtcaagacatttatagtagtcaagaggagactacttcttccccttcctctagtggaagtgaagatgaagtaagaggtgaagagtctagggaggaagtctacccccatgaagaaggtgacctcctaatggttagaaggctccttggagttcccatggaggcagggcatattcttttaggaaggccatggcaatttgataggaagatcatttacaatggcctaactaatgagattacccctcacccatcttggcacttaatttgtgttgcatcctcaaacaccttcacaggtggccaaatatcaactaactatgaaagataa

SEQ ID NO: 47917 - DNA, 279 bp, Glycine max
  Peptide Sequence Number=SeqID_139602
atgggaggtgcagtgaccttgttggatatccctggttctcacgaggagaaatacttgtacttggaggcatgtcactcggtttggaactcccttgagactcagactgatcatcgtgggggaggagtttcctgtgcacgacagggtgacctcgacacttacttcctagttttcctaagtgagagtgtcgtgtggacacacttaggctatttccttggggatggtaccacatttcatttgaaagttgagatcaggtgcaagcatcatattgagcatgattga

SEQ ID NO: 47918 - DNA, 220 bp, Glycine max
  Peptide Sequence Number=SeqID_139603
atgtcagaattcacaagcaattgtcctcctcaatttttagccaacctgcatcaattagactttgcacgttatgtttcagggtcatacaatgctcaatggaaagcctcggaactgctccatgataagcacatgttgcattcgagttgtatcctcgagaaaatgaatgttgatgaacctttgttgggtatggctaccattgcattattgagtagatatagga

SEQ ID NO: 47919 - DNA, 72 bp, Glycine max
  Peptide Sequence Number=SeqID_139604
atgggaaagtatggggagtttaatgttaacctcttgaggctttctttcattttctctcctatggggagtgag

SEQ ID NO: 47920 - DNA, 100 bp, Glycine max
  Peptide Sequence Number=SeqID_139605
agaagaaggcaaacaaacggggaaaggaagaaaaagagagaagggatctagcttgtaatgttggggcagacggatgtgttttcaatgtttgcgtctgcgg

SEQ ID NO: 47921 - DNA, 655 bp, Glycine max
  Peptide Sequence Number=SeqID_139606
caccttcaaagggttgcacgtcctcaccttcaaaggactacacgtcctcacctttagaggactacacgtcctcaccttcagagggttacacctcctcaccttcagagggctacacgccctcgccatcagaggactacacgtcctcgcctttagagggctacacgccctcgccattagaggactacacgtcctcaccttcagaggactagatgtcctcccctttagaggactacacatcctcccctttagaggactacacgtcctctcctttagagggctacatgccctcgccttaagaggactacacaccttcaccttcaaagggctgcacatcctcgcctttaaggactacacatcctcaccttcagaggactgcacaagactacacgtcttcaccttcaaaggactacacgtcctcacctttagaggattacacgtcctcaccttaagagggctacacgctctcacctttagaggactacacgtcctcgccttcagaaggctacacggtttcgccttcagagtgctacacgtcctcaactttagaggactacacgtcctcaactttagaggactacacgtcctcgcctttagtgggctacacgccctcatcattaaaggtgatggaatcctatcccgcaagggcattgggtag

SEQ ID NO: 47922 - DNA, 210 bp, Glycine max
  Peptide Sequence Number=SeqID_139607
atggattctactccttcacttgctcatcaaacttttggccacactgaacaaggtcaaagttcttcagctgcaacaaccaacattgaaaatactaacatagaacaacaacatcatcatgacgtgggagaaccagtcatactggaaagaagaaatccgcgatgtaatcggcgtccaccaccttgtgggactggtcatcgtcttggtcattga

SEQ ID NO: 47923 - DNA, 327 bp, Glycine max
  Peptide Sequence Number=SeqID_139608
atgagatttcttttcaatcttgtaaattcctctacaagcaaagatccaccagggatgtaccctccattgttctctttgaacaacctagtggatgtaccctccactagaactgatccacaagagatgcaccctttcttgttctcagtcaataatccaagtagatgtaccctctacttgtaccacaaagattataccctccaatgtgttaagacaaagttcttaggcgggagaagagagtcacaaaaagaattcaggcggttagtccttggcgaattctttttggcaaagggagaagagaatgaaaagatgaatagcacaagtttttga

SEQ ID NO: 47924 - DNA, 501 bp, Glycine max
  Peptide Sequence Number=SeqID_139609
atggtggtgacggctcgtaattggaccttgggtggggtcgatcggtccgcctccggtgtgcaccggtcggctcgtcccttctgccggcgatgcgctcctgtccttaactggccgggtcgtgcctccggtgctgttactttgaagaaattagagtgctcaaagcaagcctacgctctgtatacattacatgggataacaccacaggattctgatcctattgtgttggccttcgggatcggagtaatgattaacagggacagtcaggggcattcgtatttcatagtcagagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 47925 - DNA, 750 bp, Glycine max
  Peptide Sequence Number=SeqID_139610
atgactggtggtggtattttacctcttgagattgattttatagagtcagataggactaaccatgtttcaggaagtacacatacctttgactttctttatgaggtacaggatgagaaaccatctccttctaccactatccagccaaccacaccagaattgaagcctctgccatcaaatttaaaatacgcttacttggatgatagcaaaagttgtccagtgattatatctgcctcccttgctgatgcgcaagaggagaagttgttgtctaggactgtgcagctaactaagcggaagcttaacagagaagactgcaacccgagattacttgatgtaggcaagaaatgcataaccaagcattttgcaagcttggtaaatctttcctcaaattctctgacagccaagggtgagtgcaaagatccaggtacattcgaagaagacctgtcatctagtggaataatgcttgaagccttagcagttggatcagttcccatcattctaggcagaccctttatgaaaactgctagaactaagatagatgtttatgcaggcacactgtccatggagtttggtgatataactgttcattttaatattctggatgctatgaaatacccatctgaagatctttctgtatttcgtgctgaaataattgaccatgttgttgatgaatacatgactgatctttattctaatctgcatgcctctcactcttcatgcattgagtctgaaattgtacttgatcatatgtga

SEQ ID NO: 47926 - DNA, 372 bp, Glycine max
  Peptide Sequence Number=SeqID_139611
atgactaaagcacgtcaaaagggggtacggaaaggaaaaagaaggaggagcttgccacccagctcgcccaggcgagctaggttgcttcctccagaaggcaccgccttctggtggaacttcctggaaggcccaagatgttacggaacttcacagattgtgcaacaatgcttcctttttacttccggcatgtcacagaacttcacggattgtgcaacaatgcttccttttgacttccggtatctcacggaacttcacggatttcctaacgatggatgccaagtacctcaaagtggtcaaacgtgggtcgcatcccaacaaacggatggtccccgggcgaaattagggtatgacaattatgtatcattaaattga

SEQ ID NO: 47927 - DNA, 324 bp, Glycine max
  Peptide Sequence Number=SeqID_139612
atgccaagcacctcacaaggaccaaagaaaggtcgcatgtcatcaagcaaaggtccccggacgaaattagggtatgacacatgggaaaccccgttaaggaaagatcaagaacttaggggcattcgtaatggcattgtcgcaacctacccttcggcgggagagcgacgcgagactcgcaggatgcgtgttccacgaaaggaatacgcgcggagtcgccaccaatgtttatttgaggaaaacgtcggaaaaaccggaaaagacgcgatctacgaacttttaagtgaaaggttcgggagttgtatttacgcacggggaaggtattag

SEQ ID NO: 47928 - DNA, 402 bp, Glycine max
  Peptide Sequence Number=SeqID_139613
atgattatgaggggccaagacatttatagtagccaagataaggctactacttcaccttcctctagtgaaaaagaaggacaaccattagtggttaaagagaagtgtaaggaggtaagtgtctcctccaagaggttagctaagaaagaaactcattttacaataaagacaaacattaaagaaactttccctcttagacaacctccacattttctcttttgtaaaaagacacttgctagcattgccacgcctcttgggcatgagtttattcctcaagtaaagaagttgttggatgagggtttggttcgcaagagcttaaatccttgtgctttgttggtgcccagaataggtattattaggcaccaaatccctaaaataggtggtatgatgaatgtttttgagtga

SEQ ID NO: 47929 - DNA, 557 bp, Glycine max
  Peptide Sequence Number=SeqID_139614
ggaacctgagtgtgaagtatgcaattctgcataggattggcgctgcaaactgggtacccaccaaccatacttccactgttgccacagaatcatttgctgtcaaattacccattgccttcccaactgtattgtgtggcattatgttgagtcaacatcccaatgtcttaaacaatattgactctgtgatgaagagagaatctcctctatccctgcactacaaactgtttgaggggacacatgtcccagacattgtctcgacatcagggaaagctgctgcttcaggtgctgtgtccaaggatgctctgattgctgaactcaaggacacatgcaaggtgctggaagcaaccatcaaagccaccacagagaagaagatggagctagaacggctgatcaaaaggctctcagaaagtggcattgatgatggtgaagcagctgaggaagaagaagcagctgagcaagaagaagaagaagctgaggaagaagaagaagaagccgatgaggaagatgcagcagaggatacagaatccgatgatgatgattctgaagccaccccatga

SEQ ID NO: 47930 - DNA, 321 bp, Glycine max
  Peptide Sequence Number=SeqID_139615
atgacaaaaagctcaaagatcaatcaaagaacaactcaagtaaatcaagaacaattcaagagttcaaagataagaatcaagaagaattcaagactcaagaagaaagttaagagtcaagaatcaagattcaaggttcaagatctcaaaaatcaagatcaagattcaagacttaagaagaaagttaagagtcaagaatcaagattcaaggttcaagatctcaaaaatcaagatcaagattcaagactcaagattcaagaatcaagagaaggcttaattaagataagtataaaaagtttttctcaaaaattgagtagcacatga

SEQ ID NO: 47931 - DNA, 249 bp, Glycine max
  Peptide Sequence Number=SeqID_139616
gtttatgatcccaacatggttagctcatggtacctaagacatgcaactaagaatgcgtgccccatgtgtgcagttaagaagatgatatggaccttccggcttcccgtgacaaaagacgagaccaatatacaacgcttgcgtgacaacaggaggcagatgtgcaaaagcgcaacagggggatgcacacagcgtgttcacttcatgcccccatttttggaacctaaatgggaggaactaaaaggcttttag

SEQ ID NO: 47932 - DNA, 315 bp, Glycine max
  Peptide Sequence Number=SeqID_139617
atgttaggatttacacgcaattctcctcaaatttcagccagcccgtatcaattagacttcacactttatgcttcggggtcatacaatgctcaatggaatgccccagggctcctccacgataagcacacgttgcattcgagtcgtatcctcagaaaagtggaggttgatgaaccttggctagggttatggctaccattgaattatcaagtatatgtgggagcaagtcagcataggacactggaattggggtggtgttcgtcattggaagtgcagacagactttgtggtagattttagggatggcctttgtggataa

SEQ ID NO: 47933 - DNA, 648 bp, Glycine max
  Peptide Sequence Number=SeqID_139618
atgacggatcgcggccgcagaacgtcacagattcgtgcgggagatctttctcctcggctcacagtgcactccaagaaagaaagtgcaatattgcactctatggacgacagtgcagaatcattgcgcgagcagcgcaagcgcgaaacctctcgcgccctcaccgaggccgcccgtcgactgaccgccgaacgggggttcgccggcttcaccatcgaggaactgtgcgcggacgcgggcgtctcccggcgcaccttcttcaactacttcgagagcaaggagaacgcggtcttcgggttcaccacgatcgactcccgccagcaggccctcgaggaggagttcgcctcgcagccgggagacctcctcgatgacttcgtccagctgacgatccgccgcttcgagctcttcaaccccgtcgaggacgcaccagccctgttcgccgtgatcgagcaggagccacggctgctcaaggccgcgttcgagcagatgagcaagaacgagcagcacgacaggggactgatcctgcgccgcatgcagggaaccgcggaggccgagctgcgcgccgaggtcatcgtccacaccgtcggcgcgctggtccgcatgagcatggaccagctcctgcaccaccagtccaccgaggggatcctctag

SEQ ID NO: 47934 - DNA, 171 bp, Glycine max
  Peptide Sequence Number=SeqID_139619
atggaaatgatgatcaatgacgcatttgaacaatataggcaacatgaccctaatatagatgcttgtccaaaacactgcatgttgtatttgggagatgatgaaaaaagtttggatgcttgtaagcattgtggtacatctagatggtattacccaacaagaagaataaaatag

SEQ ID NO: 47935 - DNA, 195 bp, Glycine max
  Peptide Sequence Number=SeqID_139620
atgaagaaacaacaatggaagagaagcggaagacaaaggagaaaaggtgagaggaggcgccatccactagggaataagccatggaagaaggagcttcaccaccaagatgagccttggataagaagcttggagaggattcttcaatggaggaaaagaaagagggagagaaagagagaggcgggagcacgaaattga

SEQ ID NO: 47936 - DNA, 171 bp, Glycine max
  Peptide Sequence Number=SeqID_139621
atggggttctcagttgaaggaaatgaacacatggtgtgcatactaaagaaatcaatatacagtcttaaagcaagcttctcgccaatggtcagtgggactaacgatcttggtcttcttcatgagactaagaaatttctctctataaactttgaagtgaaagatatgggtgag

SEQ ID NO: 47937 - DNA, 54 bp, Glycine max
  Peptide Sequence Number=SeqID_139622
atggcctccatcatggatgcaagagaaggccctagggttcttatgagtcttagg

SEQ ID NO: 47938 - DNA, 126 bp, Glycine max
  Peptide Sequence Number=SeqID_139623
atggagaagagagacacaaagaattcagaacaaggtttggaaaccagaaaactcagaaagcttttggcaaaggaagaagaagaagaagaagttcaaaaagatgttcaaagagattcaaagttgtaa

SEQ ID NO: 47939 - DNA, 302 bp, Glycine max
  Peptide Sequence Number=SeqID_139624
atgaatgtttattttcttagggctgttcatgtgtcctccactttcgagtttggagctgagtttcatgattgcctaagtgcggaccctcaaggcaatcctccatactccacctttgtccggagcaccatgaatatcggttccttcgccaagtataagaaaaaagaagaagtagagatgagagtcgtcatcacggaaagggcagggtggacgaaatcagtgtcctatctttgctttcctcttatctccgatgagaggcttgcgcgatccgtgaaattccgtaatgtggcggaaatcgaaaagag

SEQ ID NO: 47940 - DNA, 330 bp, Glycine max
  Peptide Sequence Number=SeqID_139625
atggaggagttccttagtcaggtggcctggccaagagttcagccttctccattgggagggggtgaggcctccgtagcccaggagcctgtgctagaggaggacgagcccatccctcttgagccatttgtttataagactgatccaactagtgctcaggaggaggtagcatcaccagagcctattcctcagtcatctccagctccatttcttaatgatccacaacgatctgcaccagcatcggttcctgatcagcccattgttcaagatccaccagttgcaacggtgttggatcttaatgagcatgcacaggatcattcccacaacttttaa

SEQ ID NO: 47941 - DNA, 425 bp, Glycine max
  Peptide Sequence Number=SeqID_139626
atgggcaaatcctccacaacaacaacagcagcaacaacagcctgtccctctcttccagaatgctgctagtctaagcaggccatatgttcctcctccaatgcaacagcagcaacaacaacaaagacaacaagcaactgaggccccttctcaaccttccttagaggagttaggacagatggatactcagttgaaccaagctcagtcccaaaattctgacaaattgccttcacaaactatgcagaatccgaagaatgtgagtgccatcaccttgaggtctggcaagcaaattgaagtccctccactagtagcagcacctgcacctgaacctgctcagcttcattctacgcctgaaaaagaggatgagctagctgcacaacggagaaagcttcctgatcctgagggagctaacaaaaattttcatgcag

SEQ ID NO: 47942 - DNA, 164 bp, Glycine max
  Peptide Sequence Number=SeqID_139627
atgtcattgtctagcgctgttcatgtgtcctctgtcctcaagcgcggagcctctgaagaaaaaaaaaagagagaaggagtagagacgagagttgtcatcacggaaagggcaggacggacgaaatcagtgtcttatctttgctttcctcttatcttcgatgagag

SEQ ID NO: 47943 - DNA, 294 bp, Glycine max
  Peptide Sequence Number=SeqID_139628
atgttcgttgactatgttaacaaaacatggattatcccacataagaaaaatttattacagtctggacgaataagggttgaatatgctcattggactgtaaaaagaatattacaaaatagccttaaagacctgtgtagtgtttgggatgccatgaacaacatgatcatgctacaacacgttgaaattaaagcatccttcgaaaccacatcccagtggattcagtccatatgttctagaggagactttgctattcagaccaagggttatgtgaggtcgaagtcagcatcaagatag

SEQ ID NO: 47944 - DNA, 381 bp, Glycine max
  Peptide Sequence Number=SeqID_139629
atgcataaggcattgcgattgaatgctccattgccttaccctcatcttgttacccttttccttcaacacttcaacatccctcttgattctgaaccttatgttccaatcaagagatctttccttataggcactttagtcatagaatcttttggttatcaaaaggagcatgatggctcttgggtgaagaaaggtgctcgacatgatggtgaagaaggacatgatggagaggatttatctctcctttcaaagataatggacaggtttgatgaagtggatatgcatttcaatgaaatggagtcaagaatcacaaaggttgaagaagatgtgtcttacattcgttcaagcttcgatcttccaccaccgccgccaccatcatcttag

SEQ ID NO: 47945 - DNA, 207 bp, Glycine max
  Peptide Sequence Number=SeqID_139630
atgtcaggacttacacgcgattctcctcaaatttcagccagcccgcatcaattagactttgcaccttacgcttcgaggtcatacaatgctcaaaggaatgccccggggcttctccatgacaagcccacgttgcattcgagtcgtatcctcggaaaaatggaggtggtgttcgtcattggaagtgcggtagacaggctttgtggttga

SEQ ID NO: 47946 - DNA, 724 bp, Glycine max
  Peptide Sequence Number=SeqID_139631
atgtcgcggaactttgcggattacctaatgatggatgttaagtacctcgaggaggtcaagcgaaggttgcatgtcaccaaagaatggtccccagacgaaattatggttggttttggtttaagagagctcaaggggtattacacggatatgaaagaaaccactagctccatccgccaagtttgctccacacagaggcaaggcatggaggtcaagcttgaaaatttgaccttgtatgtgaacgacaactcccacgcaaagttggtgacattcgattttattggcattgcacactatgacccgaagtgttcgtcctgttggtcatcctcatcatctgcaatgagaagaaagaatttggaagagcatttgttcccccaactgaacttctcatcgcaattgaaaggaagcccattttctcggtggatcgccatctcctctggggacagacgtttgagtggtaatggtggtggttttgaaggggaagggtcctcatggggttgtcatactatgacaaagcaaagtgggcctctaaggcttgaaagagacctggccatgaagagatctgaccattgctggtcatccattggaaccagtggagtgatattcaaacaactgggtgatcttaaagatgcccaaggggtccgacccatcaaagtgggaattgccattttcaggagaattggtgggcatgttgttgtgggtggctgcaagggtcaactagttagag

SEQ ID NO: 47947 - DNA, 846 bp, Glycine max
  Peptide Sequence Number=SeqID_139632
atggctaaaccatcatctaatgttacaacaaggaaaaataagacagaccctggttggaaagccaaagaacacttggttgggaagtcgggtaacattgcatcttgtaagaaaactccactagatgtagtcgaagagcttaagggatatatggttaacaaaaaaagtgagaccacttacagtagtactggtagtggtaatgtgccaaatataagagattttgaatttggtgaaccagttggatgtgatgaaagtgaagatgagtttgaggactcttgcaatgctactgctttggccacaaagacaaactggtttgtcatcaagctcattaaattgaaaagctttgagaatatggttgcaaccattggtcaatatgggccacattttcccatttcaagctatcatgatatcagagttccactcctgaagaaggaagttgaatacgctgaaaatttgatgaaaggccacagggagcaatgggtcaagtatggttgtactattatgtcctatgcatggattgatcgaaaaaaaaatctcaaggttgaaaagaaatctcaaggatcacagattgcttggggactggatgtaggcacggagaagcgagggttttacatggagaacttgttcttgagggagtgttataagacgaaggggcttgggagaatgttgctctctgcggtggcaaagcaagccctaaaaatggggtgcaaaagggtcaagtgggttatgcttgattggaatgttctcaccatcaagttttatgaaaagatgggtgctaacttcattgaggaatataggtttttcagtttgattgaggaggctcttcaagcttatggaggacctaattaa

SEQ ID NO: 47948 - DNA, 87 bp, Glycine max
  Peptide Sequence Number=SeqID_139633
atggctcactctttctctaacatcaaggttctctctgcttttgtcgccgatggattctccaacactctcacctgctacaagggttaa

SEQ ID NO: 47949 - DNA, 183 bp, Glycine max
  Peptide Sequence Number=SeqID_139634
atgtgtgacatgagtcatgaagatgaggaggaggatgatgataacaataataccaacaataactacaatgatgataatgatgatggccatggtggtgatcatgtttctcaacaacaacacacaattacgcgtgagtatactagaacaagaggaggtaggggtcatagaacaagaattatctaa

SEQ ID NO: 47950 - DNA, 1506 bp, Glycine max
  Peptide Sequence Number=SeqID_139635
atgaaggagatgacgggagagtcacaaaactgcgtgtatttgtatccactgcatatgattgttgtgattaggattaaggtcattgcacaagggggatactgtgccttaagttgcgtggctgatcgggcaaatgagatatataagagggttgaagatcaaaagtctagtagaggaagaaatcaagatgctttattggctgcttgtctctacatcgcttgccgacaagaagacaaacctcgtactgtaaaggaaatttgctctgttgccaatggggccacaaagaaggaaattggccgagcaaaagaatacatagtaaaacaactgggtttggagaatggtaatgctgtggagatgggtacaatacatgcaggggactttatgaggcgattctgttctaatctttgtatgaataatcaagctgttaaagctgctcaggaagctgtgcagaaatcagaagaatttgatataaggaggagtcccatatcaattgctgcagcagttatatacatcataactcagctttctgatgataagaagcctctcaaagatatatcacttgccacaggcgttgcagaaggaacaattaggaactcctacaaggatctttatcctcatgtagctgcaactgttgttgaggatgttaagcatatgaatcatgcagctgacgaggtccatgacctgcctcaggaggttgttgttgatgataaacgttttgagttgaagttgtcctcccatggaaggaagatagagaaatttggaaggcttgcttcagagtttgaaagcatagtggctgtcacagaattaagtcctctgattgcatgttccttggacattggtgagaggggacttatatatgcttttgtagagaggtggcataaggaaacgagtagttttcatcttccgatagaaaatgtgactatcaccctcgatgatgtggcatcattgcttcatctgcccattacaggcgccttccatagctttgaggctcttcatgtagaccaagttgtggacctgttagttgacttgcttgaatgttggatctacgaacattttcttactgttgcttcttccattgctactgaagattatcatgagaggaaaccacatgcttgtcgttcaaagtctaggaaggcattactagtgtcgacgtatcgtaagcggttggatagattgacatctgatgttatttgtgttgcgcttggacagtgtgcaacatattacatggagtggttctacatgatatctcatcccttcatgagtccgacacagtttggggatcctcctagacatccacccatgccgattgtcgcagcagctatgccagaaccacttgtagttgcacctgttgatgaagacatgcctcgacatgcactggaggcttgccaagcaataacagaaaggttgaaacgcttgatcaacctaagggtagtcactaaaggaacaaaagcatacacagtgaccgaggagtgcctaaggatcgtcacgggtgtgactgtgcaagggaat

SEQ ID NO: 47951 - DNA, 198 bp, Glycine max
  Peptide Sequence Number=SeqID_139636
atggagaagatgcactggcgacatcctggggatatccgtgcgaataagccaagtgcagctgaatggcttgatcagttacccaaaaatttttggcaagaatatgaaggagatcggtggggtcctgatcaaggagaaagaggactgcaaatgatcgtccgatttcaacttgcattcctactgagatgggcggagaagtaa

SEQ ID NO: 47952 - DNA, 479 bp, Glycine max
  Peptide Sequence Number=SeqID_139637
atgggatatgctaggtgcacccagcattattgctggtgcacccagcaatttattgaaagcattccgttttctctcttccgcgaaaaagcttttctcctctcttctctcttctgcgaaattccttggtggtcttcttctctgcgaggcttctccggcttcatcttccatttgcattcgagggtagaggacgccggaaaaaatggcggaagcttggtgacggtgagccttccggaagacccgttaggggttcttcaggaacttccggaagaagatcttccggaagatttccggaagaagggttcttccggaggtaatgaaacgacttccggaagaacaggtctttcggaaagctctcggaacacctcttccggaatgtttccggaagatgtacttcttccgaaaacattccgaaagagggttcttgcagatgacctttcagtggtttcggaagcactttccggaagacccttcttccggaa

SEQ ID NO: 47953 - DNA, 877 bp, Glycine max
  Peptide Sequence Number=SeqID_139638
gtatattgtaccttacaatccaagattgcttagaaaataccaagctcatatcaatgttgaatggtgtaaccaaagcacttctatcaaatatttatttaagtacatcaacaaaggatatgatagagtaactgttgttttgattcatgatgataatgatccaattcacaatggtagtactcataatgatgagatcaaagaatatctagattgcagatacatatgtccctgcgaatctacttggagaatctttgggtttccaatacatggcaaaaaacctgttgttgaaagattacagttccatcttccaggccaacataatgttgtctatgaagaccatgatgatattgatgatgtgctgtctaaaacaaatatctcagattcaaagtttatttcatggatgaacatcaaccaaaattttgttgaaggaagaagtcttacttatgtagaatttgtttctaagtttgtatatagtaagaagaaaagatgttggcagcttaggaagaaaggctacaccattgagaagcatgttttgctatgggtcttttgcaagatgataaagaattcattgaggcaatcaaagaagcaaaagactggggctcagcacattataaggaagctatttgtgttgttacttttaactgcaacaatgaacaaacctgaacaagtttgggaccaaacttggcattggatggttgatgacattgtctataattataaaaaatcatcaacaagtccagcattacagcttgatgataggactcttcaaaatctggtcttgcttgaaattgaacaactattgcaaacaaatcaaagatcgcttacagactatccttcaatgccatatccagaagatgcgaattgcccaacctatctgtag

SEQ ID NO: 47954 - DNA, 1032 bp, Glycine max
  Peptide Sequence Number=SeqID_139639
atgaactttgttttctgcatttttctggaaaacgtgatgaactcgctaagcgcgcttgctgcgttaagcaagatggcctccaggaaacgtaagagcattggggcaaggccaactgctcaatatgatactagacggttcctttcgcttgatgcttggaaccgttatacagataatgtcttgggaaggagcattttgtcagagaggaaggttgtgatataccacaccgagtttgatgacttcaagacagagttggagaggggtaatcttcacaaacgcctcaccaacctggctgatgggtctattgatcttgctttggtgaaagaattttatgctaatctttacagccctggggatccttcaccaaagcaagccagagagggggagacattacccacctactctaggtactgcaggttacccacagatcatagagagattaaggatgctctttgcatactagggagagggttcaatttcaatgttgagggccatccgaggaggattcttaggaaagatctgactaccttggcccaggtatggagtgttctctcttactccaacctggcccctacatctcatacatcagatctcactatagacagagccaggttgatctttggcctggtctctcatatggacatgaacatcgacgctctcatctcaggatatatgacttctattgcccagtctaactcttacagacttgggtttcctactttgatcaccgccttatgccgagtccaaggggttgtctctgacagcctcacatttaagcgcctgagcccggccattaacttggcctacataaggaagaactgttggaacattgatgatctaacaattgctttccgaggggctaggagggcgagggcgaggccagctaatattccatcttcttctgcagctccaacacctactccagcatctacttctacagcttcttcagttccagctcatgttgactcacagtgctttgaagccatgcttcaaagtatccatcagggtcagattttattgttgcagagtctacag

SEQ ID NO: 47955 - DNA, 1057 bp, Glycine max
  Peptide Sequence Number=SeqID_139640
atcgttggctactagaccagttggggtggagagaccagtggttcatgtcgatcctatctctaagagagccaatggtccccacagaaagaaattaagaacatacttggggattgtcgctcgtgataaggtggatgttgcatatcataattggaaacaagtccctatagctcaaaaggatttgatcttggaggatattcaagctgaatttgatattcctgaatcatctgatttgagcacaaagaaaaaatactttagatcatcggagagaagtggaggcagtttaaacccttcatgggagggttatgattttcaagaacaaaagttgatgaaggagaagcaaaagaaacgatgggaggaagcagcccaatccgggagcactgacacagtcgttgatcctccatctcccattagacgacatcaaactatagataggattgtaagtgactatcatttgttagagggaagctttgtcgcccatgaacatcaagatgtattgacagctgccattgggcgaccagagcaccctggtcgtatccgtgctgctagagccgatgtcatgatcaaacactactttggaccagcttcaaggggctcccatacctcttcgtccatggctcttgaagacctagagcaactgacacaaaagatcaaagaccagttggatgagtcgatcacacaaaaagtgactcaacaattaatgatgtcctttagccaaattcagtcccagatgcagtcgcagatgcaatcacatggactcgcactacctcctgagactgagataaatgtgggttgtatgtcaatccctcttggaagagtttatgaagggttgacgatcatccacaatgttcctttaggaaatgatcaagtgaaggcacttaacactttccttgcttggctgatacatcttgtaaagcttttttcagaacaaaataaacaaggagctgagggaccggcgaaacctgtagatatgctggatcctgacgtcaatcccttgtacctgatgacattgaccatcctgcaagctgctgcaggtgtcgtgggatgctaccatgtttag

SEQ ID NO: 47956 - DNA, 222 bp, Glycine max
  Peptide Sequence Number=SeqID_139641
atgccacttgaaggagaagatgagtcaagaataagctcaccaccaaaggaagccatggataagagcttgaaagtacgagaagatgagtcgagggagaaggagagaagggtcaccaaatttatgcctcaaataagcctaagtgatgtgatccttgctaggagcagatcgcttgatacatgtcacaaagttttggatgacgccacttccagaaagggaagataa

SEQ ID NO: 47957 - DNA, 216 bp, Glycine max
  Peptide Sequence Number=SeqID_139642
atggctaggagactcaaggaagattgggctagggatgcaagagaatgctctagggttctcatgagccttaggtggcgtctccaatcacctttcctctttctccattctgctgccattgatcttcaagaagcaaaggacttaattgatgaagaagattcaagtcctacaagctctacatggatccatattatgtggtatcataacatcttcatctag

SEQ ID NO: 47958 - DNA, 231 bp, Glycine max
  Peptide Sequence Number=SeqID_139643
atggcagtggaatggagaaggaagagagagaggagatgccacttcaaggagaagatgagtctagaagaagctcaccaccataggaggcgatggataagagcttggaggaagaaggagatgaatgaagggagaaggagagaagaacacgaaattttgtgctctaaaagagctctgaaatctgaacccactaatccaagatcaattccaagattctctactaagtgtgcttag

SEQ ID NO: 47959 - DNA, 493 bp, Glycine max
  Peptide Sequence Number=SeqID_139644
atggcctcgagagttgatggaagattgtccactgcatccaccagagaagaaccttgcaagtattgtgggatagaaggtgggggcttgccgaaaatgaccttaaacggggaaaaccgagtgcccgaatgggttgcgggtacgattgaggatctctgtctgagggtgataccaagctttgaggaaatccatggtgtttgcagaccaagtcgaggaaaaggagggcccgaatgggttgctggtacgattgaggatctccgtctgagggtggtaagaggtgttcatccggagtttgaccaagtcgaggaaaaggagggcgaccttgtgcacggtgtagttggagggaacggtgctgaaatgggcacctttcgaaaattggtcgatgatgatagaatagtggtgaagccctgggaggatggtaacctagtgataaaatccagggatatgtcttcccaaattgaagaagggattggtaaaggctgtaagaggttggctg

SEQ ID NO: 47960 - DNA, 1386 bp, Glycine max
  Peptide Sequence Number=SeqID_139645
atggcttcgagtggaaaaatccttcctcaccaaacccaagtggtggctgttctcataccgttcgctgcacaaggccatctcaatcagcttctgcacctctcacgcctaatcttatcacacaacatagcagtccattatgtatgcactgccacacacattcgccaagccacacttcgagacaaaaactccatttccaacattcatttccatggcttcgaagttccaccctttgcttctcctcctcccaaccccaacaatgaagaaactgatttcccatctcatctaattccttcctttgaggcctcttcgcatcttcgcgagcctgtgaggaatcttcttcagtccctctcatctcaagccaaaagggtcattgtcatccatgatgccgcaatggcatcggtggcacaagatgccacaaacatgccaaatgttgagaattacacttttcaaatcacgtgtgcctttaccaccttcgtgtatctttgggataaaatgggaaggccctcggttgaaggcttgcatgtaccagaaattccttccatggaaggatgcttcacaccccaattcatggatttcattattgcacagagagatttcgacaaatttagtgatggatacatctacaacacaagcagggcaattgaaggtgcttacattgagtcgatggagcgcatcagtggtggcaagaagatttgggcactgggaccattcaaccctttagccattgagaagaaagaatcaaaaggaagacacttatgcatggaatggcttgacaaacaagatccaaattcagtcatatatgtgtcttttgggaccacaacaagctttaaagaggatcaaattgaacagattgcaactgggttggaacaaagcaagcagaagttcatatgggtgctgagagatgctgataaaggagacatctttgatggaaatgaaacaaaaaggtatgagcttccaaatgggtttgaggagaggattaaaggcatagggctaattgtgagagattgggcaccccaattggaaattctgagccacacttcaacaggggggtttatgagtcattgtggatggaactcctgcttagagagcataaccatgggggtgccaatagcatcatggcctatgcactctgaccagccaagaaacactgttttgataacacaggtgctcaaggttggtttggttgtgaaggattgggcacaaaggaatgcattggtgactgcgtcagttgttgagaaggttgtcagaaggttgattgaaacagaggaaggtgatgagatacgacagagagcagtgaggcttaaaaatgccatccataggtccaaagatgaaggtggagtttctcacctggaaatggagtctttcatagctcatatcactaattag

SEQ ID NO: 47961 - DNA, 318 bp, Glycine max
  Peptide Sequence Number=SeqID_139646
atggagacggcggaggtcggaccagttgttagaggttgcacggggagcaggaaaaggaagcacggtggctcgcgtggtactttcttggtacgtgctggtctcggggtggcttggcagatgtggttgaagattgatagggatagtaatatgggactgcaggaagtaaggggtctgcaagaagcacaaaagcgtgagttcctagccctcgaagctagggtgttcgcgtcccgtgcttggttcctaacaaagatctttgacgaagctcttgcgcttggtcgattggggatttgggattttagggtcgaaggcaatcgctaa

SEQ ID NO: 47962 - DNA, 189 bp, Glycine max
  Peptide Sequence Number=SeqID_139647
atggcttacatgcccttgaaattcctttttaaacaaggatgcttcccaacccaattcattgatttcataattgcacaaagagatttcattaaattcaatgatggaaacctctacaacacaagcaaggcaattgaagatcctatggaaaatatggctgttgatcctcccaacggcattcgaaggtattga

SEQ ID NO: 47963 - DNA, 150 bp, Glycine max
  Peptide Sequence Number=SeqID_139648
atgaggatgaaggatggttttgttggtcaaaagaggttgttgtatgaagacactggatcattgaggtctaggttgttgtacgataattgttgtggaggcagtaattgcagttatggacatgacggttgtggagacggtggttgtggttga

SEQ ID NO: 47964 - DNA, 2193 bp, Glycine max
  Peptide Sequence Number=SeqID_139649
atggcgggtcccaaacaacactacgacggacagcggcaaggacagactggacagcaacgcaaccaccatcaagcaaactggcgtgacagagccgatatcacgacgttttacttcactagattcccggaggatgcatcggacaaggagttgtggtaccatttcaagcagatgggggacgtgagggaaatcttcatctctaaacagagaaacaaagaaggaaggaggtatgggtttgtgagatacaaaggagtctcaaatgcgagttacatggaaagaaagttagataacattattgtagggggtctcaaactgcatgtgaacatcccaaagtatgggagaggaaaggagataaaagaacaaaacgcagccgaacacgggtggcagaaggagggtggtaatcagaggcgcagcgtggcagcagatccaaacacgaagaggtcgtacgtggaggttgtgacttcacacacagagaacaaggaacgaagaagacgcacctcctctctgatggcggcgcatgggagaacacactcctcgatcatactcgagatttcggaggaggtgaagaaaagatacgcagatacatgggtaggaagactgaagagacaacaggtgtttgaacgagtagacgatgaactctcttggatccttggctcaaacgtattgcccaaatatctcggagacgacatggtcctccgtatcgggctttcagacacaaaggcccaagagctgattagggaagaaatcaatcacggcacatctgcgttctacggcttggaaaaatggaattcgaagactaaaccaggcaataggctgatttgggtgcaatgctggggtatccccttagttgcgtggagtattgataatttgcgcaaaatcgtggctgcagtgggcgatttggttgaagtcgacgatgatttcgaagacatgcaacggcttgatagagcacgggtcctggtcagaacaccatggagatcgacagtagagcacatggtcacagcccatatagacggagacgaaatctattctgacgttgaagactccgacacctttcagtcgtggccgaccgacacctcgccgccatctaccacctccaaaatgcatggcgataccacgttccgacaaagcttggcaaaaaccaacaatcaaagtggtaccagtactccattgggtattgctcgtagcaaaagggcacgtggacctagtagcgcacttagccacccaggagctgagaatggaaaggagacttaccttgaagaatgtcacccgacattaccaggagcagggtacgaggaaatggaaagtcaacctgcaggggcagcaggtctaggtatgcaaaaatggaaagataacttacaagggttattggccagcacagaggagagccaaaaaggggaggtagctgtcttggaccaaggacatatgggggagagctttcaaaatcatagcaacagacctctgggggattctttaaataagtcacgtgatactaacgtgaacttaattgggcccaaccttaatatgggcccttacaaacccacaactccaacgaaccagcaaaatgcccggcagaaaaaacctgtaagtgccttgctggtttacttgaggaaaaaggggtgctcaaaaaaatgggctcaggatagggggaaagagatcaacccaaagacattggattttgcagacaaccccattaaccacaaggacagtgctgtttcatgtggttcggatgaagctttggtgtctccaaaacagggccagctccaacaaagcccttccctttcaagtagcttcaataaaaaagatatggaggatgaggatgatgtttatagggacttagccagagaattgggagtctcttttgcagagaacaaaagcaatgctgtaaaggtgatgactgacatggataacagagaaaattcttcaacatcagcagcttggtcagccatcagaaagttgaccttggcaaacaacattgacattctttgcattcaagaaaccaaaaaggaatctgttgatgtaaagttatgtcagtacctttggagtgacaacagtgtttcttgggagtgtgttccttcctctaatgctgctggaggacttttatgcatttggaataatggatcgttcttggtagatagaagggtgctggggagaggtttcataatgctggaaagcacgtggattaaagagaataagagg

SEQ ID NO: 47965 - DNA, 414 bp, Glycine max
  Peptide Sequence Number=SeqID_139650
atgacaacgatagagatattagtgatggtcatggtgacagtggcagtggcagtggacgtggcattggttgtggtggtgatgcaaatggtgatggcaaacaatggtgacgatgatggcgatgacagaagtggtattagtagtggtggtaacaatgtcagtgatgttggtggcagaggtagtattgttggtaatagtggcagtggtgacaataacgatggcggtgacattgatggtagtggtgatggtgatgtcaatgtcgacgattgtgacagtgatgatggtgttagtggtgacggtggtggttgttgcaatgacattggtggtgtttgtcaaacacgtttttgttttaaaaattgcatttcaagctcaaaactcaaactaacgaccaccccaaatgggtccttatgtttttag

SEQ ID NO: 47966 - DNA, 597 bp, Glycine max
  Peptide Sequence Number=SeqID_139651
atgacacttcgctcagtgaacatgaacaactcatccttcttccaaattcttcctcgtgctcagcagatggagtgttgcgctcatcttgagatagatcctgtgtatcctgagtctgagcatcctcctcatctatcagatggaaaaacaggggaatcagagagggcaacaacttctccagataaggaattagaaagatcaggggagcagcagcttctccagatgagggaatcagagatgataataataggtggagatgggggaagtacttcaagctcaggagaaggtggattcgccactggagattgtggatcagctggtactggttcaactcgtgcaggtgtgggctcaagaggagcagcctcgttgggtctcaccactaaaggtagagctccaggccatgctacttgctcaaggaactgctccgtttgggagctctggacatccgatcttattgttgttgacggaggagctggagtggatgatgaagggctgtcatctgctctggctctttttctcgatgccatatcctcgcttagtcacaggtatctcaacaggaggatgagtgttcatccttacaagatgaactcgcttagcgcg

SEQ ID NO: 47967 - DNA, 886 bp, Glycine max
  Peptide Sequence Number=SeqID_139652
gcctgctctagagattgaaggcttagtggcagctgtaggattaagtcctttgatcgcattttccttggacattggataccggggacttatatcaggttttgtagagaggtggcataaggaaactagtagtttccatcttcctataggagaggtgactatcaccctcgatgatgtggcattgttgcttcatttgcccattataggcgccttccatagctttgaggctcttcatatgaacaaagtcttgttgttgttaactgaattacttgaagttagttcagaagaagcaagagctaagacgagtgaaagctacgcatggggagttgtcgccctagtccatatgtatgggaatttgaatgatccatctaagagcagcgccaaacaacttgcagggtatatcacacttttagagaccattcctccacaccctgctgctccaacattatgcatagaagatattgatgatagatggattcaattttttgaataccttgcaccggtgggtcaaatatgtgttgcacttggacagtgtgtaacagactacatggagtggttctacatgatttctcatcccttcatgagttcggcacagcctagggatcttcctaaacatctacccgtgttgcatgatgacacatttattgaaccagatattcctcagcacccgatggtggcaggagctatggacgaagcacttacagatgcaccttttcatgtagagcaacctcgacatgtagtgcacccggtggtggcaagagctatggacgaagcacttacagatgcacctgcttatgtagagcaacctcgacatgcactggcttgccaagcaatagctgaaaggttggaaagattgctcaacctaaggatagtgactaaaggtacataa

SEQ ID NO: 47968 - DNA, 225 bp, Glycine max
  Peptide Sequence Number=SeqID_139653
atgttggccttcatcattgccaaaagagggtgtgaagatgaaagtgatgcgggttttgctctcgtggaggttgctcttgtgggggaccatgacgagcttaatgttgctactaatgctcccgcaaactttctttctcacatcctgacccaccttacaaagtgcttgccctctttcaaatccctaacaaacacacctaccctagggtccccttttccacaacaatag

SEQ ID NO: 47969 - DNA, 348 bp, Glycine max
  Peptide Sequence Number=SeqID_139654
atgaacctaacagtctccatcaaaacgtttatgaattatactccatcctacaaaaagacatggttagcaaagcaaagagcgttggagatgattcatggaagttgggaagaattatatgccaagctaccaaaagttttgggagctttgcaatcttgtgttctcgggactatggtcgctgctcaaacagggtacacatacatggagaagatgcactggtggcatcttggggatattcgtgcgaataagccaagtgcacctgaatggcttgatcaattacccaaaaaaaatttgggtacaatgcttcgacgaggggaaatgttggggacatatgactacaaatttgtctaa

SEQ ID NO: 47970 - DNA, 315 bp, Glycine max
  Peptide Sequence Number=SeqID_139655
atggagtgcctagagggtgtttgggagaccctcgaaggcaatgagaggtgccgattccgtggcacaattcgactcactgctacttcattaccaattcaagtgatagaggtgtcatcctctgaagaggatcttgaagaggaaccagaggagttacctcctgaacctgctgtggatgctcttgacttcccagaggatgatgaggacccactccctgatgttgattctccagaggatgttatgttagcatctgaggcagactctacagaggagagcggccctagagggacaacgaatagtgatggctcttcatcatag

SEQ ID NO: 47971 - DNA, 729 bp, Glycine max
  Peptide Sequence Number=SeqID_139656
atggcggccaattcctggacatacgctgatgccatgaggagttttgtgttgaaggctatttgggctgactggttccagacgaagctatccttagtcaacacggtggtcaaagggccaatgttgtatagcttgcactttcgcgtgtattggttcgaccccttgagcagaaacgaagtggccaagatgccggacatgctcctcgataatggaactatagatcaagatatcgtcaaaaaacacaataaagagccccgtgcccggaatgaggctattgctagaatggcagaaacagaagaaggagtttggttcgaagggaactctgctgccaatagacagatacaggtcccagagacttcaaccattgcactccgagaaccaagtcggcaccacagaggtcgagactccaaattggccaacttctgtaagagttcatcaagcttgagggtcatggagttttggttggctgttaacaaaagctgtgtcgggggcaaccaaggccactccctcagcggaagcggcgcgttgagcacccgacttgaaaatgaagttctcgtccgtgcatgggctgactgggaatttgtgagagggagaaggagatcgagggaagtagatgtggaagttcatggagcagccgagggtagggctgaaatgtctgaacctcttgttgtagcctccgaacatcttgccgctgctgatctcggtgggttttgtctccatatctggttctga

SEQ ID NO: 47972 - DNA, 1238 bp, Glycine max
  Peptide Sequence Number=SeqID_139657
atggccaacagcaaagctgctgacgagaaaactggagggataagcaggacgtttcgaccttctacttcacaagattttcagacgacatcacagaacgtgacctgtggtatcgcttcaggagtgaaagatgtgcatgagttggctagacaactggaccagcttgtcatcggaggcttgaaactgtatgtcaacatacctaaatacgggagggacatggcaacaaaggcagagacaccaccagtaccaaacaagcaagaggggaagcagcagaatgaagcaccatatcgaggtcaccatcaagcaacaaggagtttgacctcgtatgaggaggtagtggccagagacaggtacaaagtggaacagccaaaggaaacatacaaggaagacacaaagagaggcgaatctcgatcatcgttataccttgacatcccaatgaatgacaagcactggctcagacaagcatgggtggggtgcctgaaagacctgaggtggactcacggacgctacagcagaacgcatggtgaaggagacatcggaggaagtagactatatgttttattcgctggagaaatggcacccgagcctcagaacgggccagagattagcttgcgaatcgtggctgcaataggggaactggtggatgcagacgacaatacagaggaggctcgaagggtggatcgcgctagggtgcttatccgcatgccgtggagccccgccatccatcacaccatgagtgtcgatattgggggagaagtgtaccaggaaattgactccgacgacagttgctggggctcgccaacaaaggatactaagggagctcccaacaacaacgagacggaagagaagaacagctcgaaaggacagacaccgccggtgacaccaagcgtggtcaaggcaagggccgtcaaaggctcagaagcgccgccagggacagtcagtggtggcgttttaaccagcagtcatcccgctggagttggaccagcagaagctctgtttgtccagcgggtacagctgcccaatccgacgtttggagtaacggacacttgcggtgccgccagtcaatgccacgtggcgcgtcaccagttgacagaaggtttttcggaacccacatttgaacgcaatcagaagaggaagggggagcaggtgggagtcatcgagaatcctgagggggcacaaagggagcataaaaaaggaaatctagaaactgaaagtgcagaagctgagaaagagatgttggc

SEQ ID NO: 47973 - DNA, 726 bp, Glycine max
  Peptide Sequence Number=SeqID_139658
atgaaggaattttatgcaaatctatatgtcccagacgacaagtctcccaagcaagttagggttcgagggcacctaataaaatttgatgttgattccctcaacaccttcttggagactccagtggttgtggagcctgatcctcaggagcttgcagcccggctgtgtatccctgggaggggatttgttcttaatgccaagggtctgccgtggaagctcttgaggaaggatcttactactatggcccaaaccttgagtgttctatcttattctaacttggccccgacatcccatacttctgatcttaatctggatagggccaagttagtctacaggcttgtaatgaagatgaacatgaacttaggttcacttatttctggtcagatttcactcattgctcagtccaactcctcgcgtcttggatttccaaccctgattactgccttgtgcaaggcccgaggagtcacctcagattctcttacctttgagtcacttagcccagccattaatttggcttatattaagaagaattgttggaacctagatgaaccttcggtcacttttctagggacccaaaaatccagggctagaagatctgaggccccatctacatcagttgtccctgctcccctacatcagctccatttacttctatttttccttcatcaccaacagcttcagttcttccaagtccctccactcagagctcaaagctttccttgtctatga

SEQ ID NO: 47974 - DNA, 444 bp, Glycine max
  Peptide Sequence Number=SeqID_139659
atgaattcagtttctgcctttgctccaatagcaaatcctataaattgtccttggggacagaaggcattctcaaattatcttggtgacaataaatctgattgggaggattacgatgctacttgtttggtaacgaagtttcccaatgtttcttccaccattttgattgatcagggcatggtttcaatttataaaaacatgtacccacatactcgtagcaagtttctgctggttttatcatcctcttattgtcaatccacttttcagggggaagatgacaaatttttgcctgatcaacttctgcctcacaagtttgaacaggcttgcaaaaaagccaatgttcccctactgctacgtttccaacctggttatgatcacctttactattttatagccacattcatagatgatcacatccgacatcatgctcaagctcttaagtcttag

SEQ ID NO: 47975 - DNA, 414 bp, Glycine max
  Peptide Sequence Number=SeqID_139660
atgttcctccttgactctatacctcctcaaccacttgaagaaggtgcacttgccgaatttattttcttcttgaattggttaactgttgttcctgttagtgtttgcatgcgtagatcttctgcaggtgaattggttccattagatttagaaattgaagcaacttttagaagaaacaacgcagagagaaaaagaaagcttttacacgatagaacagtagcattaatccttgaagaggctcacttttctaagtcatcatcttctaattcacctacatccagggaatctcaagcagcagaatttgaagccaaagtcatggctgaagagcaacctcgacgagtgaccctggaagattactcaagtacatctgtgccgcagttctttactagcattttgcggttggaggttcaagcatag

SEQ ID NO: 47976 - DNA, 375 bp, Glycine max
  Peptide Sequence Number=SeqID_139661
atgtcctccaagcgatcttccatttctacatcaaacggttcaaattgggacccactctgcatgtctgtcaattcaccatgccatatccacgtcatgtgtggccctatcccattcaggaagactgtcttttatgttagtttcaaacgtcaggctaaaaagtcaagaacacttcatgataacaaagatgatgatctcaagaatcaaagaatgatttcaagattgaatcaagaacacttcaaggttcaagtttcaagttccaagaatcaagaatcaagtttcaagattcaagattcaagactaaagattctagaatcaagaggagactcaatcaagataagtattaaaaagttttttcaaaaactgagtagcacatga

SEQ ID NO: 47977 - DNA, 123 bp, Glycine max
  Peptide Sequence Number=SeqID_139662
atgtgggacaatgtgggtgtcgagcaagtggtttccaacagatttcaggcgagaggagaaagagaagaacaagtgcagggttttcgagcgcgcagaaaaccgatgttaacatcaactaggtaa

SEQ ID NO: 47978 - DNA, 1443 bp, Glycine max
  Peptide Sequence Number=SeqID_139663
atgacacccacccagcgcacattagtattcacccgtgcttcgcacaccggctgcgtctatgatctttctcttctctctcaccgcgacctttcttatccttcgcaccctttctttagggctaaggcttcttctcctctctccctaacctcttcttattcttcttcgctctttcggaaaattaggcgcatggatcgcaaatccaaacgcaaccactcgttctcctactccactctcttcaacctcgagcctttgaagaactttaaacttccacgtgaagatgatgatgattttgattattatgggaataatagtcaggaagatgagagcagagatagccaaggtgaaagggaaaattactgtaatggaaatgtgcacgcaagggagcagaattcgtcgagtaagagggtgtggtctgagaacagtgatactgatgatgagaataagggaagatattatgggacacacatgacacaggaacgatatcaatcaatgcttggagaccatgttcagaaatacaaaaggaggcgtaaggatgccatgtctaacactgatcaaaatcaggttgttgttcctcttgtcaaaagtaacaatggcttaaaaattcaaaagtcagggaatgattgtaggggagcatcacatgctgaagaaagggcatcggaatggcttcaggatcagaaacaaggaaacttcagtcgtgcagatttcaagcagcaatatggcactgataggattatgtatgaacctgctgttttggacattgggaatggtatctcttatgagattcctccaatttacgataagttggccccgatgctgaaccttccaaacttcctggatatccatgtcgatgaattttacttaaagagtaccttggatttggggtccttggctgcaatgagggctgctgataaaaggtttgggactagaaaccaagcaggaatgggggaacccctatcccaatatgaatcacttcaggcaagaataaaggccatgccagcttctaattcacctcataaattcagcttgaaagtgtctgatgttggattgaatttatccattccggagggtgctgctggaaccataaagcgatctattttatctgagggtggtgtattgcaggtttattatgttaaggttttggaaaagggtgacacatatgagataattgagcgaagcctaccgaagaagcaaaaggtaaggaaagattctgctttgatagagaaggaagaaatggatagaattgggaagatttggataaacattgttaaaatgaaagttagtagatcactcaaatggattaagggtgctaacattcgcacccggaaactagctagagacatgttgctgctctggaaacgagtagataaagagatgccaaagaattttgtaatggatcccaatttagtgcattacaacaacaacaacaaagccttatcccactag

SEQ ID NO: 47979 - DNA, 191 bp, Glycine max
  Peptide Sequence Number=SeqID_139664
cttttaagctaggcttagctggccaggaggcgctaagtgccaatcccttacggtttttgaactcttggaagtgcgctaagcgtgcctgttgcgctaagcctgaactactctctaaagcgctaagcgcagcctactacgctaagccccagatgctcattgtaccttacaacttcaagttgggcttagagtga

SEQ ID NO: 47980 - DNA, 282 bp, Glycine max
  Peptide Sequence Number=SeqID_139665
atggaggattttgatgcacaggtggcctggccaggagcccagccttctccttttggagggggtggggccttcgcagcccaggagcttgcttctaaggagccaacaatagtagagggggaacccctctcgagccttcttattttgatacagccatccttagcacccatacctaatgatgccacaccatctgcaccagcatctaagttagatcagcctatctctaaggattcaccagctgctcaggtgttggaccttaatgagcatgcacaagagcaaccatag

SEQ ID NO: 47981 - DNA, 174 bp, Glycine max
  Peptide Sequence Number=SeqID_139666
atgtcgtgcgaagcgcgttcatccatgctggtgaacttaagtgataagcccgctaagcgtatctgtgcactaagcgggaccagtgttctgacatttagggctaagcgcgccctatgcgctaagcttgagtgtgtttttgttgaggctgagctaagcgccagcatgctgcgctaa

SEQ ID NO: 47982 - DNA, 183 bp, Glycine max
  Peptide Sequence Number=SeqID_139667
atggaacgagtggtggctacggtgagcaactaccatggctccgagcgattcaatctcatcaagctgatttcacagactggcggcaattacattggcgctatgtcgaaatctataactcatctgtggccaaaagtgtcaaagggatctgcaaagatttcttgcaaaaagtacagtcgggaatga

SEQ ID NO: 47983 - DNA, 428 bp, Glycine max
  Peptide Sequence Number=SeqID_139668
atgggatcaaatcaaacacctatgcctaagaaaaggttctatcaagtcaaaatcaagagcttagaggtcgccagtttacgagagttagggcaattgatgggtcaacttcaacggcaagccttcaccaaagcctatgtgccgacggtggaagagtttgaagaaatcctgagatgcccgctgggaggaaagaagccatatcttttctcggggttctatccctccatggctagagtttccaaggcaaaggccttggcaaatcaaggtgaatgggcttcctttgttgacatcttggcgcttttgatcttcggagttgtcctctttccaaatgtgaaaggggtagtggacctagcagtgattgacattttccttgcctttcatcatggcaaggaaagcccgatcgtcgccattttggctgacatgtatgacac

SEQ ID NO: 47984 - DNA, 219 bp, Glycine max
  Peptide Sequence Number=SeqID_139669
atggtttttcacgccgtttctacaaagaggggatatatgattgtatatagaaaaggaaaaatattgcagaatatccggaatgacaaaggtagcgaggtggaagtggtgacaatgatgatggtgacgatagtgatggtgctggtgacgacgatggtggggtggaatactggcggtggtggtgaaatggtgatagtgacggtagtagcagtagaatggtga

SEQ ID NO: 47985 - DNA, 357 bp, Glycine max
  Peptide Sequence Number=SeqID_139670
atgtctcctccacctctaggacctcacaatcactcacaaactcatctcaatctctcaggacggcttccttttcaagctccagtctttgcagatctccgcacaacaaaatctctcaaactctctggaacttggacctttctctctctagaactctctagacatgcagaagcttcaagaaaacgccaaactcccatcaaaaatctgatttcaagcttaaatagcggatggactaaagcggcgcgcttagcgggatggctcttggctcagcgaacaagcacaactcatccttcttccagattcttcctcgcgcttagccaaggaatgttgcactcagcggatggctcgctaagccagtag

SEQ ID NO: 47986 - DNA, 237 bp, Glycine max
  Peptide Sequence Number=SeqID_139671
atgaagtataactgtgaccttatcaacatgagttatggcgaagcaacattactgccagactatgggtgctgctttgttgatcttgtgaatgaggtggtgaacaaacatcgtctgatatttgtgagcagtcctggtgttggcgcatatgtatctcttgctatggctgctggtgctcattgtgttgttgaacctccatctgatgggcttgaatacactttggtatattcacttctctga

SEQ ID NO: 47987 - DNA, 168 bp, Glycine max
  Peptide Sequence Number=SeqID_139672
atggtggttccaaatgtggggtttcaatggagaactatggaggttcatggtggctactggtggttgtgggtggtgaagaagaagcttgggacgttggggaagggttttggaagaaagaaggagaaaggaatggttgttttccaaggctacacgaaaaataagacttga

SEQ ID NO: 47988 - DNA, 105 bp, Glycine max
  Peptide Sequence Number=SeqID_139673
atgtcgcggaactttgcggattacctaacaattgatgttaagtacctcgaggcggttaagcaaaggttgcatgccaccaaagaatggtccccggacgaaattagg

SEQ ID NO: 47989 - DNA, 429 bp, Glycine max
  Peptide Sequence Number=SeqID_139674
atgtcttcagtcatttacgctttcaaagactacaatgtcttttgctttacgctttcaaagactacaatgtcttccgtcatttacacttttagagactataatgtcttcagtcatttatgctttcaaagatcacaatatcttcagtcatttacgctttcaaagaccacaatgtcttcagtcatttatgctttcagagactataatgtcttcagtcattcatgctttcaaagactacaatatcttcagtcattttcgctttcaaagactgcaatgtcatcaatcatttacgctttcaaagactacaatgtcttttgctttatactttcaacgactacaatgtcttcagtcattacgctttcagagactacaatgtcttctgtcatttatgctttcaaagactacaatgtcttcagtcatttacgcttttaa

SEQ ID NO: 47990 - DNA, 219 bp, Glycine max
  Peptide Sequence Number=SeqID_139675
tgccaaaagttacagttgagcttagctcatcattgggctaagcgcacatccaccgctaagcacagcttcagcgtgcttagcgcgatagaagaatccggcaggacatcaatatcaaggtcgcacactaagcgcgagatcagtgcgctaagcgcagcagttgtcttcagccaggctcagcgcacaattggcgctaagctcaaacccacttactcacgctaa

SEQ ID NO: 47991 - DNA, 225 bp, Glycine max
  Peptide Sequence Number=SeqID_139676
atgaagtgtcaaaagttacagttgagcttagctcatcagtgggctaagcgcacatccaccgctacgtgcagcttcagcgtgcttagcgcgacaaaagaatctgtcaggtcatcaatatcaaggtcgcgcgctaagcgcgagatcagtgcgctaagcacagcagttgtcttcaatcaggctcaacgcacaactggcgctaagctcaaacccacttactcgcgctaa

SEQ ID NO: 47992 - DNA, 210 bp, Glycine max
  Peptide Sequence Number=SeqID_139677
atgttgatggtggtggtttgtagtggtgatgccgatgacgataacaatagtgatggtggcgacaatgctattggtcatggtgaagagttgatgcaatcctaccccgcaagggcattggatagaaaactccaagtagattgggccagagatgcaagagaaggccctagggttcttatgagccttagggtagatttcgggcccaagggctaa

SEQ ID NO: 47993 - DNA, 312 bp, Glycine max
  Peptide Sequence Number=SeqID_139678
atgaaggctgatatggaggccatgaaggagcaaatgacgacaatgatggaggcgatgatggatatgaagaagataatagaggttaacgttgttgtagctgctgctgccagtaccattactaagagggacccaactcacccacccatttttaatcaagaaagtcacctagtgtcagatgtggaaggtcaaggatgtgcgacgggggtgcctgccaagaatgttactaatcctatccctgtttgtattgagattcatcaaactcaacccgatcagactcaagcctataactctaatgctagggaggaggcatga

SEQ ID NO: 47994 - DNA, 480 bp, Glycine max
  Peptide Sequence Number=SeqID_139679
atgggatcaagtcaaaagccttcgtttaaaaagaggttttatcaagtcaaaatcaagagcttagaggtcaccagtttacgaaagttggggcaattaatgggtcaacttcaacagcaagccttccgcaaagcctatgcgatcgacgtttttatcgcctatcataaccacaaggaaagtccgattgtcgctatgctagccgacctatatgacaccttcgaccgaagatgtgaagaaagcaatgcaaggattgtttgctgtactccagctctctatgtggggctggtttcacacctttttttccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaaggatgtccaaatgttcccttga

SEQ ID NO: 47995 - DNA, 399 bp, Glycine max
  Peptide Sequence Number=SeqID_139680
atgcacctcccccaactgatttctgatgtcatctattgtttacggggattgtgccgcaagacacctagtggacccgaagaaggccaacagggtcttggagttgccagctctaaatacgggtctctgtcagttctagggagtgcctgtcgcccccagcaaggtcatcaggtcccccctaccaatcgagctttcatcaagaagttctgcgtctccaggcaggcgcagggcgaaacaccacaacagcctggcaatggccggcagcgggcaacagacgcaccgccatcacctctagagttcacctctgctcatccacaaaaaggtttgagtattgcctacaccacatggccgaccaataggcgaccaagtccaaagccaaaggacgcacctagttgctcatga

SEQ ID NO: 47996 - DNA, 843 bp, Glycine max
  Peptide Sequence Number=SeqID_139681
atgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcggggttagcaggagtggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 47997 - DNA, 315 bp, Glycine max
  Peptide Sequence Number=SeqID_139682
atgaagctttgcttctacaaaagacaaaaaacaaaattggaggaagttgctcaatccgaaagcactaaggttgtgattgacccttcatctcccatcagacgacacgattctttggaggagcaggcgtcaaagggttcctttgtcccctatggacgtcaggatctcctgactgctgccattgggcgatcaaaacaccctagttgtgtgcgtgctgctggattcggtgtgaccataaagcaatactttggatcagttccacgaacctcttgtagttcttcctccttagctcccgaagaactcaagaagctgacttaa

SEQ ID NO: 47998 - DNA, 215 bp, Glycine max
  misc_feature (203)..(203): n is a, c, g, or t
  Peptide Sequence Number=SeqID_139683
atggtcctcctggttggacattcagaagcaatatgtcctctgcctaagcatttgaagcattttatgtttctggttccaatattggatgaggaagtggaagtgttatgtttgcttccaccaacactagatgctgctgactttccatgtggggatgttgctgctgggctggacaaattacctccctccttcttggatctgttggnccagttttggtt

SEQ ID NO: 47999 - DNA, 279 bp, Glycine max
  Peptide Sequence Number=SeqID_139684
atgaaactcgccaaatacaggctaaaggcccaagtggagaaggacgaaggcctaagtggagaaggacaaagcccccgagtggagaaggatgaaggccaaacttatcaaggtaatccttgtggcgtctaccctgacttatcttccttcaccggaagtggcgtctacccagacttatcttccttcaccggaagtggcgtcatccaaatcttcgtagcctgtatcaaacgatccgctcctactcaggttcacatcatctggtatcagagcttcggctcttga

SEQ ID NO: 48000 - DNA, 217 bp, Glycine max
  Peptide Sequence Number=SeqID_139685
gaggaagcaactgggcggcaagctcctccacgtttttgaaaaatggtttccggggcttctgcggcttccgtaatacttccgtaaaatttccgaaaaccttggagtcgaagtgcttccctaatgctttcgtaagcgattctgtggaaattcttcatcattcttcgtcgttcttcaccgttcttcatcctttcttcgttcgttcttcattcttcaacgg

SEQ ID NO: 48001 - DNA, 147 bp, Glycine max
  Peptide Sequence Number=SeqID_139686
atgaacgcgctcagtgcgcctgtgcgcttagcctgttcatcgcagctgtcaaaatttggatttccagatgaacacatggcacaaggaaggccaggggtaaaacaccctactacttcacctatccttcttcttccaagccagatttga

SEQ ID NO: 48002 - DNA, 540 bp, Glycine max
  Peptide Sequence Number=SeqID_139687
caaagttgcaatcccttccaagaagaggaaagaaatttcctcatctgattctgatgatgatgtcgaactagatgttcccgacatcaagcgggccaagaaatcagggaaaaaggtgcctggaaatgtccctgatgcaccattggacaacatctcattccactccattggcaatgttgaaaggagtggtgaagatattgctgcttctgagcatcaaattgccaaggaaatcactgccaaacaagtccagcattggccaaagaaaatgggaagcttctgcagggaagctattgaagtatgcaatcctgcacaggatggcgctgcaaactggatgtacccaccaatcatacttccaccccaggaatcaacagaagaagaggatcaagcctcagaggagacccctgcaccacgggcaccagaacctgctccaggtgacctcattgaccttgaagaagtagaatctgatgaggacccattgccaacagttggcacctggcattgcagaaagttacaaagcagaaaagggaaaacccccattaagag

SEQ ID NO: 48003 - DNA, 324 bp, Glycine max
  Peptide Sequence Number=SeqID_139688
atgataaatgatggaacatacgaatttggggatcccacggtcaagtggctccacatgccaccggactcttgggtcacggtaacaaaaggtggggtggtcgataaaagcagggcttttgctcctacgtatcctcaatttgtgatgaggaactcagacctacggcaaggattgacattctcaccctgggtcaaggtttatgataagttgggattttggctcaaggcttgtagaacggctggtcatgatatatgtcagggtttggccagcggttcggggataaaggggatgtcccacattatttccatgatacacatgcaacaatga

SEQ ID NO: 48004 - DNA, 66 bp, Glycine max
  Peptide Sequence Number=SeqID_139689
atggtgctcaaatgtcacaacgatccaacggtgaatgagtctgagatcgtcgtttttctaagacag

SEQ ID NO: 48005 - DNA, 133 bp, Glycine max
  Peptide Sequence Number=SeqID_139690
gaggattatgaagatggagatgaattgtgaagctggatttatgtgcgcacaagtatcacgtacagtgcatcaaacgggtggttcatgcacaggaaccatacccaggctgcaaacaaaaaacaaattatgctga

SEQ ID NO: 48006 - DNA, 360 bp, Glycine max
  Peptide Sequence Number=SeqID_139691
atggaggggcttcaactgtcggctgtttctggggttgttgttgttgttggactggtggaggaatgtcataattgttctgctgtggttgattttgctgctgaggttgaggaggtctattgtaaatatttgcagcataagcttcaggctactcaattgctccaggttgctgcatggaagggcaaaggactcagtaatatggagagaagtatgatagatgctgccagtggtggagcccttggagacatgactcctgctgaagccaggaatttaattgagaagatggcttccaactcccagcagaatttgatcgaggccgtacccgaatcaaataaacatgaaaatgcagtaactaggaagtga

SEQ ID NO: 48007 - DNA, 696 bp, Glycine max
  Peptide Sequence Number=SeqID_139692
atggagaggagtatgattgatgctgccagtggtggagcccttggtggtatgactcctgctgaggctaggaatttgattgagaagatggcttccaactcccaacaattcagtgcaagaaatgatgttattgtccttagaggagtccatgaggtggccacggattcatcttcatctgctgaaaataaaaatcttgagggaaaacttgattccttggtcaacctagtaactcagcttgccatgaatcagaaatctgcatttgcacctgttgtaagagtttgtggtctatgttcttctgcagatcaccatacagatctctgtccttctttgcagcaatctggagtcaatgagcaacctgaagcttatgctgcaaacatttgtaatagaccccctcaacaacaaaaccaaaaacaacagaataattatgatctttcaagcaacagatacaatccaggtcggaggaatcatccaaatctgagatgggcaagtcctccacaacagcaacaacaacagtctgtccctccctaccagaatgttgctggtccaagcaagccatatgttcctcctccaatgcagcaacaacaaagacaacaagcaactgaggccccttctcaaccttccttagaggagttagtaaggaaaatgacaatccagaacatgcaattcagcaagagacaagagcctccatcagagttatga

SEQ ID NO: 48008 - DNA, 444 bp, Glycine max
  Peptide Sequence Number=SeqID_139693
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtgccttcagccaggctcagcgcaaggctagcactaagcccaattccacttactcgcgctaaccgcgagggtggtgctaagcgtaag

SEQ ID NO: 48009 - DNA, 461 bp, Glycine max
  Peptide Sequence Number=SeqID_139694
atgcgttacgaaaacgacttctaccacaactacccgtggcagatttccgcgcgcaaccagcgcgccagctaccactacacgccctattcgccatggatcgacctgcgcgcgaccttcgcgagcaacaagacccggctgttctatccgccggtggaagattcaagctacatcggccgccgcacccacagcagcctgagcagctggaccctcgacaacaccagtcgcttcgacatcggcgcactgcaggcgcgctggaacaccggcatcaagcaccagtcggacatctatgtggccgatacgcccatcctgcgcggtgccaacccgcagggtcgcagccagctggacagcgtgttcagcacgctggaactgcagtacgacatctacgcgctgactgccggcctgcgccaggaccgcttcggcatccgtggccacatcccggtgtgctcggatgtacccggcca

SEQ ID NO: 48010 - DNA, 261 bp, Glycine max
  Peptide Sequence Number=SeqID_139695
atgggaacaaatcaaatcggaaaaagattctatcaagtcaagattaaaggcctagatgtcaccagccttaaggagttgggacggttgatgggacccctccagatgcaagccttccgcaaggtgaacggaaagattttagatttgaccatagcgggggtattcacggaagccgttgtatccctcacccaatactatgaccagccattgagatgcttcacgtttggagacttccaaatagtaccaactgttgaagaattttag

SEQ ID NO: 48011 - DNA, 303 bp, Glycine max
  Peptide Sequence Number=SeqID_139696
atgggtgtctgcaggcatttccctaatgaaaggggtgagtcgtctgctcgcttgaggcaaggctcacagtgtaagttctccatttgcatccgtctaaagatggagggccgaaaccgcatcaagcaccttgcgagcttcctctgtatgccagtagatgccacctggatagtggaagaatgcacagaattgctaaaggaccgagttgatctcatggtttggaatgcatctcctaataacctgggtctaatgccctacgaaatgatcatccccagaaatatcatcccgatgggtgatcctccatga

SEQ ID NO: 48012 - DNA, 492 bp, Glycine max
  Peptide Sequence Number=SeqID_139697
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaggataccaggcgtttccccctggcggctccctcgtgcgctctcctttcgctccaagctggactgtatgcacgaaccccccgttcagtccgaccgctgcgccttatccggtaactatcgtcttgagtccaacccggaaagacatgcaaaagcaccactggcagcagccactg

SEQ ID NO: 48013 - DNA, 192 bp, Glycine max
  Peptide Sequence Number=SeqID_139698
atgctagaggaaattatccattggcctacagtggatgactctgacttccttcacccaagaaaagaattcccaccacagaggcagaactttgtcacaggtgaagaacaaatgagaggcagactcagatttggtagaaaaaatcccattagtttcagctctccaaacccaggtgtccttcaggttgctatttaa

SEQ ID NO: 48014 - DNA, 126 bp, Glycine max
  Peptide Sequence Number=SeqID_139699
atggcatgtccgaaagggcaaaaagttgcttttggtacatacgctctagtggaagaagctgagtattggtgggagaatactcgccaatgcctagatgctgaagacaagtggcctcaaatatcttaa

SEQ ID NO: 48015 - DNA, 373 bp, Glycine max
  Peptide Sequence Number=SeqID_139700
tgataggtacattgagcaactgagtgaagtgcctcaaaatgttctctatgatgccattgggatatatcaacggtgtatggtgaaagttggaaccttttacgtgccgatcaacgtctcatattcgccaaaagttggcccagggcttcccggtatcaacagggacaccaggatttatttattctgcgaagtgatcttccgtcacagctgtccctcttgttcagctactgacggggtggtgagtaacggcaaaagcaccgccggacatcagcgctggcaagtggcgatcggtgcgggcctcttcgctattacgccagctggcgaaagggggatgtgctgcaaggcgattaagttgggtaacgccagggttttccca

SEQ ID NO: 48016 - DNA, 189 bp, Glycine max
  Peptide Sequence Number=SeqID_139701
atgatgatttggaaacaacgtgcaaaattagtcatggctacagctaggaaggtactcaagcatcctgtttatggcattgtgatactaaggcttgggatttatgcaagtagacccaatgtttccaaattacgttctttcattggttcaacgaatccatccattcttatcccggacgacgttcctaaatga

SEQ ID NO: 48017 - DNA, 387 bp, Glycine max
  Peptide Sequence Number=SeqID_139702
atgacccacgatcaagagcttttcagagaattggacaaatcactggtatcacaagttagaattggtaatggtgatcttatcactattaaaagaaagggaactgtagccattgaaagttgtgcagatgtcaatgacaagaaaattttcaatatcaaaatgagaggccaaagtttctcatttgatccattggaggaggagcaaacaacctatccagttattgtaaacaatacaaaagtctggcacaaaagattaggtcattttcatcatgtagctgttgaggaacaatacgtaatctcactcgaccattatgcaacgaatgctttaaataatgcaaattctaccatgaagaaagcatcgtcagtgtattcaaaagaaatggaccaatga

SEQ ID NO: 48018 - DNA, 751 bp, Glycine max
  Peptide Sequence Number=SeqID_139703
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggcgcataggcagaagggacttgccttatcttgggggtggaatcatatggtttggctgtgtctccactcaaatctcatcttgaatccccatgtgttgtgggagaaaccaggtgggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggaa

SEQ ID NO: 48019 - DNA, 1104 bp, Glycine max
  Peptide Sequence Number=SeqID_139704
atgggacctctccaaatgcaagccttccgcaaggggtacggaaagattttagatttgaccatagcggagatattcatagaggccgttgtatcactcacccaatactatgaccagcctttgagatgcttcacgtttggagacttccaattagtaccgactattgaagaatttgaggagattctaggatgtcctcttgggggaagaaaaccgtatcttttctctgggtttcttccctccttgagcaagattgcagttgtggtcagggattcggcaagagagttggatcgtgtaaagcaaactcgaaacgacgtagtgggccacagaagtacttggaaggcaaggcaagggatatggcgaatcaagaggagtgagtcccatttgtggatggtggacctagccgcaattgatgctttccttgcatatcaccatagcaaagagagcccggtggtagctatcttggtggacttatttgatacatttgaccgaaggtgcgagaagagtagctcacggatcatctgctgcttacccactctttgtgtatggttggtttcgcacctattccaacaagacataagacacccatgtccattccgaagccatcgctcgtgtgtcgaaaagagaagagtagattgggaccaacacttggctgggataggaggcagaacaatcaactggtttcctcgatggaaggaaggaaatgagggagttctcttctcatgtggggactacccaaacatcccgttgatagggacaaggggttgtattaactacaatcccgcacttgctataagacagttagggtaccccatgaggggagcaccggcggaagagagcatctctcatttccttgtgagagatttcggcgcgcaaagtttcaagattatacaaagagtccacaaggcatgggaaagaccgttaaggaaagataaagaacttaggggcattcgtaatggcatcatcggtggttatcatgaatggctgaaagttcgtacacgagggttagattggctctccaagttgaaaattatcaacgaggagaacttcgaagctccggaagaggatgaagaagttcgagctctaaaaacaaaactagtaaaagcatga

SEQ ID NO: 48020 - DNA, 553 bp, Glycine max
  Peptide Sequence Number=SeqID_139705
cctctacagccccattcatctttggccgataaggggtggagttatgatgctggatcttgaaatcctcgcacatttcctgcatcatcttattgttcagattggtgccattgtcagtaatgatcttcctggggagtccgtatcgacaaatcagctccttctttatgaatctgactaccacacttctcgtgacattagtataagaagccgcttcgacccacttggtgaagtaatctatcgccacaagaatgaagcggtgaccattcgacgctttgggtttgatggccccaatgacatctattccccacatggaaaaaggccaaggagcggacataatgttcagaggatgtggcggaatattgacattgtccgcgtatgcctgacatttatgacacttccttacatgagcgcaacaatcgctttccatagtgagctagtaataaccgaccctaaggatttttctggccatagcatgcccattggcatgtgtcccgctcgaaacctagtggatctcctcaatcatgaagttcgcctctttggcatctacgcatcgtag

SEQ ID NO: 48021 - DNA, 309 bp, Glycine max
  Peptide Sequence Number=SeqID_139706
atgacctcgtcatcagcggtaggaagatccaaggagattcgccacttgagtgaatcccccaccgagggtcaggaggccagacaagaaagattcgcgcgcctcaagacggttcttgactcagtcgacagccggttggatcaagcccgagaaatagatcgggttcgtgacaacgaacgtgctcggctacgggcagaaatggatcacgactgtgatcggtggagggctctcgagagaaagaacgcccaaatgcgattgaaagttaatgaactaaatttaaaaaagaggggacctcttattaagtttaagtga

SEQ ID NO: 48022 - DNA, 218 bp, Glycine max
  Peptide Sequence Number=SeqID_139707
atgtcattgcctagcgcggttcatgtgtctccattatcaagtgcgaagcttctggtgacttggaagcacaagaaaaaagaagaagtagagatgagagtcgtcatcacggaaagggcagggtggacgaaatcagtgtcctatctttgctttcctcttatctccgatgagaggcttgcgcgatccgtgaaattccgtaatgtggcggaaatcgaaaagag

SEQ ID NO: 48023 - DNA, 264 bp, Glycine max
  Peptide Sequence Number=SeqID_139708
atgcatgtgccctatgaaaaatcaccattgaaggacctcattgaagctcaaagatccagcctccatagaagctccacaagcaagcgtccatcacatggcttttgtcataccctaatttcgttcggggaccattgttcggtggcatgcaactttcgtttgaccactttgaggtacttggcacccatcgttaggcaattcgtgaagttccgagacatgtcggaaatcaaaaggaagcattgttacgcaatccgtgaaattccataa

SEQ ID NO: 48024 - DNA, 393 bp, Glycine max
  Peptide Sequence Number=SeqID_139709
atgtcagactctaaatggaggctcttgtctcttgctgaaattgcatattctggatggtcatttgcctcactaactcttctaagtaaggttgaggaggagcctcagtctcttgttgtctttattgtgactgctgctgtattggaggaggaacatatggcttgcttggaccagcagcatcctggaaaggaggaacagactgttgttgttgtggaggacttgtccatctcaaatttggatgattcctccaacctggattgtatctattgcttgaaaggtcataattattctgctattgttggttttgctgctgaggagattgctgcaaagaaggacagagatctgtatggtgatctgcagaagaacatagaccacagactcttgcaacaggtgtag

SEQ ID NO: 48025 - DNA, 153 bp, Glycine max
  Peptide Sequence Number=SeqID_139710
gcgcataatatatcgagacgctcgaaattgaacaacggaagctctcgagaaattcaaatggtcataacttatcactcggattgtccgattcaggcgcataatatatcgagatcgctcaaaattgaacaacagatccctcgagaaattcaaacg

SEQ ID NO: 48026 - DNA, 528 bp, Glycine max
  Peptide Sequence Number=SeqID_139711
atggggacaaatcaaaccggcaagaggttttaccaagtcaaggttaaaggcctagataccaccagtatcaaggaattagggcggttgatggaacctctccaaatgcaagccttccgcaagatttacggaaagatcttagagttgaccatagaaaagatatccatagaagccattgcatcactcacccaatactacgaccagcctttgagatgcttcacgttcggagacttccaattggggaagaaaaccatacctttcctccagatgtctcccctctttgagcagaattgcaactatggtcaaggattcagcaagaggtttgaaccgcataaaacagactcggaacggcatagcgggcctaccacggaggtacctagaagacaaggcgaggggtatggccaatcaaggagattgggtcccgtttatggatgtgttagctttgctaatttttggggttgtcctctttccaaacgtagatggtttggtggacctagcagcaatcgacgctttccttgcataccaccatag

SEQ ID NO: 48027 - DNA, 177 bp, Glycine max
  Peptide Sequence Number=SeqID_139712
atgacagaaattgtctgcgcggaagatgacgtaaatctcgcgtgtcaacgggcttgttggtcgcgattgacaaagggtgcagaagacgatgtcagtatgacagaaattgtggggcggccgacaaaagcgaggctcttgctcctacgtatcctcaatgaggaactcagacctacgtag

SEQ ID NO: 48028 - DNA, 101 bp, Glycine max
  Peptide Sequence Number=SeqID_139713
atggatcatcagaaagcagccataagagttatgaggtatttgaagagaacaaagtattacatgctcacatataagaggtcagatcagttggagatcactag

SEQ ID NO: 48029 - DNA, 866 bp, Glycine max
  Peptide Sequence Number=SeqID_139714
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccacacaacgctctaccgactaagctaacggagcacatcaatttcaagaccacacccgtataccaccttatgtgccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48030 - DNA, 255 bp, Glycine max
  Peptide Sequence Number=SeqID_139715
ctgttccctcctgttcagctactgacggggtggtccgctcacaattcggcacacaagcataccgaccggaagcatagcgtggcaagtgtagcggggtgcaacgctgcgcgtacactcacacccgccgcgcttaatgcgccgctcagggcgcgcccttcgccttcggctgcgcatgttcgggaagggccgatcggtgcgggcctcttgctattacggccaacgcggcgaaaggggatgtgctgcgtttgcgattaa

SEQ ID NO: 48031 - DNA, 270 bp, Glycine max
  Peptide Sequence Number=SeqID_139716
atggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtgtagcggcgcattaagcgcggcgggtgtggtggttacgcgcagcgtgaccgctacacttgccagcgctgatgtccggcggtgcttttgccgttacgcaccaccccgtctgtag

SEQ ID NO: 48032 - DNA, 402 bp, Glycine max
  Peptide Sequence Number=SeqID_139717
atggcatcagcaatcacctgggccacgtggacgctcatccgtgtcaggatggcatacaccaactggcagagggagatcgaagttatgatcgctaggcaagacattgctgagcagcagtgtcatccacgtctggttcaaagtggtcatgctggtgtgcatgatctgcacccgcctccctacagcgatccgggtgaaatcctaccccgcattcgcatagaactccaggactatctcagggtcaaacttagccatgggagtcaccaacggcgtccaatgtctgcgagctatctcttcctgaaagtccgtatactcatcctccctgaactggacgcgcctctctctgtggaacgaccatcctttgatggcctcgaagcgatgctggtgctcgtcgctctggaaatg

SEQ ID NO: 48033 - DNA, 216 bp, Glycine max
  Peptide Sequence Number=SeqID_139718
atgtggaccaccacgggggaggagcttgccacccagctcgcccaggcgagcaaggttgcttcctctcgaagcaacagccttctggaggaaggatctggaaggcccaagtggttgtcgaagaagttaatgaaactcacggattgcgcaaaaacaccttttttcgacttccgccacattacggaatttcacggatcgcgcaagcctgcttccttttga

SEQ ID NO: 48034 - DNA, 249 bp, Glycine max
  Peptide Sequence Number=SeqID_139719
atgttggcaacccattatgggtaccgagcgacagccaaaaacctagctgtagaagcaaagcttccatatgatgcaaaggtgatagcacatcctttcaaaagctcaaattgtgtaatcaaagattacaactcaatgagaatccaagattcaagaaccagtgattcaagagtttctgagataaaatcaagaagatgtcaagactcttcaagaagaaagtctagagttttcaaaggttttaagtttttctaa

SEQ ID NO: 48035 - DNA, 189 bp, Glycine max
  Peptide Sequence Number=SeqID_139720
atggagaataatatgacatgcccattgtcgcaacctacccttcggcgggagggcgacgcaggggctaacgggtgcgtcttccaagaaaggaaaatgtgcggagtcgtcacctacgtttattcgaggaaaatgtcggaaaaatcggaaaagggtgtttccctcgctcctacgtatcctcaattgcgatga

SEQ ID NO: 48036 - DNA, 86 bp, Glycine max
  Peptide Sequence Number=SeqID_139721
gtaatcttcacacatttatgctcatcatgtcaccctataactttgcacttgaagttgagatttcaactgttgtttacgatgtctaa

SEQ ID NO: 48037 - DNA, 135 bp, Glycine max
  Peptide Sequence Number=SeqID_139722
atgttggctactggtaatcgattactaccttctggtaatcgattaccagaaagatatgtggaagcaaagcttcaagatgaatcaacaatgattcaaagatgttttgatgataaaaatgatgacaacaaaagatga

SEQ ID NO: 48038 - DNA, 225 bp, Glycine max
  Peptide Sequence Number=SeqID_139723
atggccgtttgtatatgtgatgggcttcatattcatcctaagagcatctcgatatcttatgagcttcaatcgggaatccaagtcaaacgttatggctgtccgaatctgcgtggtcagtccatttctacattcgagggcgatgatatatattgcgcctcaatcggacatccgagtcaaaactttagcccgtcgaaattcaaccgagtcttccatgataaattatga

SEQ ID NO: 48039 - DNA, 318 bp, Glycine max
  Peptide Sequence Number=SeqID_139724
atgaccaccttgggaattatctccacggaggccattgcctccctcacccagtattatgaccagcctttgaggtgcttcacctttggggacttccagttaacacccacggtggaagagtttgaagagatcctaggatgccctttgggaggaaggaaaccgtatcttttctcaggtaccaaggaaatgtttggaagcaaaggcgagagccttggcaagtcaagacaaatgggctccattggtggacgtcctggtgctcttgatcttcggagtggtcctctttctaaacgtagatgggttggtggacctggcagcaattga

SEQ ID NO: 48040 - DNA, 471 bp, Glycine max
  Peptide Sequence Number=SeqID_139725
atggagttggacactcatagtgcaattctagctcaaaacaaagtcttgacgcaacaagttgaggcctcaacaaagcagataggccaacttcctcagcaatatcaccaaggtggaccacagaaaatgaatcaagctcaccaagttcaacgaatttttagatgtgatttctatggtggaagctacaaaggctatagaggtggctcaagttcgaatcagccttatggctggagaccacaaaattttggtcccactaacacttctttggtaggtccttctaacaactctaatggagattcttcaaataagggtccacaacaacaacaagctcaactagacagattgtccaagatggaagatactttaaaccagtttatgcaggataatgatgagaaaaagaataaaaaaggagttgaaaaagaaaacgagaaaaaggatgaagtggtgactagtgaagaagtggaagaaaaaatg

SEQ ID NO: 48041 - DNA, 609 bp, Glycine max
  Peptide Sequence Number=SeqID_139726
atggtgaaagttggaacctcttacgtgccgatcaacgtctcatgtttcggtccaaaagttcccaacgggtcgcggcacgggcccaggcattatctacttccgagggctgtgcagaaggctccatcacagtcttattcgcaataccgtgcgacctcgaggggggatgctccgaagcttattgattctagtctaacctcacacccgccgcgcttaattgctgccgctacagggcgcgtccgcatttcgccattcgggaaacctgcggcaactgcattaagcggccaacgcgcgggcgatcgagtgcgggctcttcgctattacccagcggcgctaaagggcggatgtgtgcatactggcgattactatgttgggtacactgagccagggtgtcccagtcgaagcgttgtagaaaaaaagcgacgggcgtcagctgaatatgtagatacgactcactatagggcgaattggagctcccgcgtggcggccgctctagaactgactcctcccggtgcaggattcgatagggttcgcagtcggaaatggccagttcacaacgggcgcggcagcatttcctggaagatgccaggaagatacttaacagggaagtga

SEQ ID NO: 48042 - DNA, 534 bp, Glycine max
  Peptide Sequence Number=SeqID_139727
ggaacaaaagctggtaccgggccccccctcgaggtcgacggtatcgataagcttgatttgtgtaaggtaactttcggaataaggaaatgtcctgcaatgacagctttgaagccaaccttcaaggtcgaagttcctgttgattttccttttgacattgaggacaatcctggagaaagaaccatacaactaaaaggaaaattcagagatgaaattatcaaagttcaagttgacatccctaatcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 48043 - DNA, 685 bp, Glycine max
  misc_feature (122)..(122): n is a, c, g, or t
  Peptide Sequence Number=SeqID_139728
agctagagtaatgggtgaagtagaggagatacaagagaagatgaagcccgacatggaggccattaaagagaaaatggccacaatgatggaggccatgatgagcgtgaagaagataatggaanccaatgcggttgcaattgccgctaccagcgttgttgctaaggtgaacttgatgtccccatccggcatcaaccaaatgaatcatccaacctcagatatggtaggcaaagatttgggaagtacgggcagcccccataatgtacaaattcaaaacgagcacgcctacccgcaatatggcttgcctctcaactatacgtcacccaaagtggcgtacactcccaataagaatgtcaataactccactcctatacccattgagagccaacaaccccaaactgatcatgcacatccttgcctcggatatgccactgaagggcaagcagttggtggcatacccctgcaaaacactttggaggaccctcagtgtcacccacaaccacaaccctcacattccacagcggttaaaaaccctcatgctatggcagaaatgggaaagaggaaaggcttagggccattgaaggaggtgctggactttgacaagtacaaggggactacttgccccaagaaccatccaaagatgtattgtcggaagataagggcatacgcaaagatgaggaactgctaa

SEQ ID NO: 48044 - DNA, 378 bp, Glycine max
  Peptide Sequence Number=SeqID_139729
atgcctcaaaatgttctttacgatgccattgggatatatcaacggtgcttattcgcaaaccgtgcgctcgagggggatgtgccgaagctttatgactttagttggcgttcatggtttctatcagctgtccttcctgttcagctactgaggaattggtcgcgtccaattcgcacacaagcataccgagccggaacatcagcgctggcaagtgtagccggggtgccagacgctgcagctaactcaccaccccgccggcttaatgctgccgctacagggcgcccgctttcccatgtcgggaaactgcggcaactgcttaatgaatcggcaacggcgggcgatcgagtgcgggcctcttcgctattacgccagcggcgctaa

SEQ ID NO: 48045 - DNA, 486 bp, Glycine max
  Peptide Sequence Number=SeqID_139730
atgataggaagagccgacatcgaaggatcaaaaagcaacgtcgctatgacgcttggctgccacaagccagttatccctgtgggatcgataggccacgctttcacggttcgtattcgtactggaaatcagaatcaaacgagcttttacccttttgttccacacgagatttctgttctcgttgagctcatcttaggacacctgcgttatcttttagcagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 48046 - DNA, 582 bp, Glycine max
  Peptide Sequence Number=SeqID_139731
atgagagattatattaattataatcccgtgttggccataggaaagttaggctaccctatgagaggtgtgtcgtcgaaggaaaccatcgcacctttcatcgcgcgaggtttcaatgaagctaatgtgaagatacttcagagaattcataaagcatggaatagggtggaaagaaaagataaggagtttaggggaagtagcaatggcattatcagcggctatcacaaatggttgaagtctagaacgcaagggataacttggttcccaaagctaaaaggtctaagtgggaaagaggctaaaattcctgaagaaagtgaagaagtgcaagctttgaaaggggagctcgaaaagacaagagtgatgaaagagaagctgaaggtggcagtcactagggtcaggaaagaatgtgataagctagaagatatcaacatagccacgattaaagcgctagagtgggaaacgagaaagccccgaaaggaagagtggagcagaaacaagttccgaggggctttgtggggcagtagtaacgagctcaaacttagaaaggccgagagggatgaacaaggatggaaagcatggtgttag

SEQ ID NO: 48047 - DNA, 195 bp, Glycine max
  Peptide Sequence Number=SeqID_139732
atgaggacacgcagccctccgaaggtgagggcgtgcagccctctcaaggcgaggacgtgtagtcctctcaaggtgagggcgtgcagccctctgttggcgaggacgtgcaatccttcaaggacgtgtagtcctcctcaaggtgagggcgtgtaccctacgaaggaggacagccctctgattggcgagggcgtgtag

SEQ ID NO: 48048 - DNA, 432 bp, Glycine max
  Peptide Sequence Number=SeqID_139733
atggaaattctcataccctgcttatcgagggcacaaatcgcttacaactatgttggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 48049 - DNA, 803 bp, Glycine max
  Peptide Sequence Number=SeqID_139734
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcctcgtggactccggcggcgcgttcctgccccgccaggacgaggtcttcccggaccgcgagcacttcggccgcatcttccggaaccaggcgctgctctcctcgctgcgcatcccgcagctggcagcggtgtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48050 - DNA, 330 bp, Glycine max
  Peptide Sequence Number=SeqID_139735
atggagcttacatcactctatgtaatcgattacacaacattggtaatcgattaccagaggccccctcaatattccagttccacttctaagcctggtagtcaattacacccctttggtaatcgattaccagaagccatctcgacttcctgccttgtaatcgattacccacccttggtaatcgattaccagaggccatatcgcaaatatcactcaagatccatagcgtgccagccaccacacaagcctccttgctttgtggtccttgttcttttatcggttgactgccaggagctcgcctgtttaggtacgtcacaggttctcactgactga

SEQ ID NO: 48051 - DNA, 310 bp, Glycine max
  Peptide Sequence Number=SeqID_139736
atgcaacaaagaaaggacaaggaacttagggggagcagcaacgggcccatcaacggttaccataggtggttgaaagcctacgcacaagatctggattggctcctgagtttgaggaccactaaggggatggagggtgaaactccggaagaagacgaagagctacaggccctcaagacaaaacttgagaaagcccaaacagtcaaagaaaagttcaagtcagcagctgttaggattcgaaaggagaacgccgaactgagagacgtcaatatagccaccaccaaggccttgaagcaagagactaagagggccc

SEQ ID NO: 48052 - DNA, 249 bp, Glycine max
  Peptide Sequence Number=SeqID_139737
atgtcatggcctagcgctgttcatgtaacctccaccttcgaattaggagctatgtttcaagattgcctaagtggggaccctcaagtgcaatcctccgttttccccttttttcgggagccccatgaatgtcattccctagcgctattcaggtgtcctccaccttggagttgggagctatgcttcctgatttccgaagtgtggaccctcaagtgcaatcctccattctccccttttttcggagccccatga

SEQ ID NO: 48053 - DNA, 369 bp, Glycine max
  Peptide Sequence Number=SeqID_139738
atgaataggagtgaaacagcaaaaatttgtatggtgtacttcaaatgtatgaaatggccccgaggaaacttgcctcaaagagatccaggaaggataaagcagccgaaggaactagttttgctcccgagtatgatagtcaccgctttagggagcgctgaaacaccagcagcgcttcgaggccatcaagggatggtcatttctccgggagcgacgtgtccagctcagggacgacgagtataccgatttccaggaggagatagttcgccggcggggggaatcactggtcacccccatggccaagttcgatttagacatagtcctcgaattttatgtcaatgcttggcaacagaggaggcgtgcgagatatga

SEQ ID NO: 48054 - DNA, 234 bp, Glycine max
  Peptide Sequence Number=SeqID_139739
atggcacgcaaagacaaattatggtcattctgcgcccttttgtcatccagaggcggcgggcctgatgacacgcgaagacaaattatggtcatccgcgcgcttttgctatctagacaaattatggtcattctgcgccttttgtcactcaggagcagcaagttgagtgataaacgcgcagagacaaattatgctcattctgcgccctttgtcgttcaggagcaacaagttgagtga

SEQ ID NO: 48055 - DNA, 721 bp, Glycine max
  Peptide Sequence Number=SeqID_139740
tgtatgatggtgtttatgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgtttggaagggcgatcggtgcgggcctcttcgctattacgccagctggcgaaagggggatgtgctgcaaggcgattaagttggagatcattctggtggctggagtactggcttctgcttcaagtcttcaaatctatcaagcttatcgataccgtcgacctcgagggggggcccggtaccagcttttgttccctttagtgagggttaatttcgagcttggcgtaatcatggtcatagctgtttccttcgggaaacctgtcgtgccaactgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgatcggggcggagatttcctggaagatgccacgaagatacttaacagggaa

SEQ ID NO: 48056 - DNA, 252 bp, Glycine max
  Peptide Sequence Number=SeqID_139741
atggcagcggaatggagaaggaagagagagaggagatgccacttcaaggagaagatgagtctaaaagaagctcaccaccataggaggccatggataagagcttggaggaagaaggagatgaatgaagggagagggagagaagagcaagaaattttgtgctctaaaagagctctgaaatctgaatttaatattcaaatgatcaaacccactaatccaagatcaattccaagattctccactaagtgtgcttag

SEQ ID NO: 48057 - DNA, 210 bp, Glycine max
  Peptide Sequence Number=SeqID_139742
atggcacttatccaatgtagttttgggcatcaaattgagggaagagctgttgtcaatgagtactttggccactatgtggtccatgcatttgacggacacgtgcaaagccttgttgtgtcccttgccctcaataggcatctcctcgtcggcaaaagtcgggtaattgtttgcagtgatgttgttgactatgcccctgaagccctcacctga

SEQ ID NO: 48058 - DNA, 258 bp, Glycine max
  Peptide Sequence Number=SeqID_139743
atgctctcgggaatggaaccttcgagcatactctgggtatcttctcaaagatcccaacggtcagatcgtggacaagttcatgagaaccccagggccttctttagcagctctagctctgatgaggacatgaccaagagcaagggcaaggatccacttgaaggacttggaggaccaatgacaagggctagagcaaggaaagccaaggaatctcttcaaaaagtgttgtccatactatttgaatacaagcccaagttttaa

SEQ ID NO: 48059 - DNA, 490 bp, Glycine max
  Peptide Sequence Number=SeqID_139744
atgcaatctcagggacttgcagtgcctcctgagcctcgggttggtccctccggtcctcgagtgagcacaaaggggagttgtgttgatccctcaggaaacgatcctgagacagatgactctgataggtgcggcttgtacatagaagcagatcatgcccgcctggttgccatggggagagtttatgagggatccactgttgttcataacactcctttgttgcctggccaagtaaaggtgagcacttcacaccttccttgcttggccgacacatctggtcaaatctttatcacagtagctgtgtctccggcaaaaccacctccaaagcccgatccggaggtcgatgatccgctttatcttatgacattgaccatgccagagcttttcttgaggccttatcaggttagatgggatgccaccgtgttcggggtctttaatctagatttcccgctctacataaagcacgaagacctctctgaaatctcacacggtg

SEQ ID NO: 48060 - DNA, 269 bp, Glycine max
  Peptide Sequence Number=SeqID_139745
acagcagaaagtttatacggataaccactcgggtatttccggccgtcagcgtgactcaaaagtcagtatgacagatcttgtgagcgtggaagatgatcaaaaagtttatacggataaccactcgggtatttccgcccgtcagcgtgactcaaaagtcaatatgacagatcttgtgagcgtggaagatgacgcttttcgtcttacagacaaccaaaagtttatacggattaccactccggtatttccggccgtcagcgtgactcttgcaa

SEQ ID NO: 48061 - DNA, 564 bp, Glycine max
  Peptide Sequence Number=SeqID_139746
atggcttccaactcccagcagtttagcggcagaaatgatgctatagtcattagaggagtgcatgaggtagctacaaactcagctgcatcatctgaaactaagaagcttgaaggaaaactggatgcattggttaaattggtaacccagctggccatgaaccagaaatctgtacctgtcgcaagggtctatggtttgtgctcctctgctgaccaccatacagacctttgcccttccatgcagcaacctagagcaattgagcagcccgaagcttatgctgcaaacatttacaatagacctcctcaacctcagcagaaaagtcaaccacaacagaacaattatgacctctccagcaacaaatacaaccctggatggaggaatcaccctaatctcagatggtctagccctcagcaacaacaacaacaacctgctccttccttccaaaatgctgctggcccaagcagaccatacattcctccaccaatccaacaacaacaacggccccagaaacaaccaacaacaacaacaacaacatccctccacaaccttccctcgaagaacttgtga

SEQ ID NO: 48062 - DNA, 774 bp, Glycine max
  Peptide Sequence Number=SeqID_139747
atgctgacgggcgcgtacgggctgccttcaccgacaatcaccggcagtgtcgaaaaagacgtggctctgatagacaaaattatcggcgtgaaatgcgcaatctctgaccatcgttcttccgcgccagcagaccaccagctcgccagtatggctgcccagtctcgcgtaggtgggctgttgggtgccaaagcgggcatatccgtgtttcacctcggcaacagcccaaagctgctggagccgctattaagcatcctgtataacgccgacgttccccgcgtaaaactgctgccaacccacgttaaccgcgcccaggcgctgttccatgccgcgctgaactatgcccgcgaaggcggctttatcgacatcacgaccagcatcagcgaaccgattgatgccgccagcgccatcgtgatggcccgcgaggcgcaggtgccgtttaaccggcttacgctcagttctgacggtaacggcagccagccgaaatttgatgagagcggcaatctggtgggtataggcgtagcggggttcgaatccctgctcgaaaccctgcaacagctggtcaaccgacatcagttgccgctggaagaggcgcttcttccgtttacgcaaaacgtggcggcgtttctcggtctggaacataagggccggatcgcgcccggatgcgatgccgatttcctggtgctgacggatgacctgcagatccgcgacgtctgggccaaagggcgccagatggtgcgtgaaggtgccgtgtgcgtcaaagggactttcgaatag

SEQ ID NO: 48063 - DNA, 588 bp, Glycine max
  Peptide Sequence Number=SeqID_139748
atgaccggccctctcgtacctatcttcttcagagggctacatgtcctcgccatcagagggttgcacgcccttgccttcagagggttgcacgccctcaccttcagagggccgcccgccctcaccttcatagggctacacgacctcacctttagagggctgcacgtcctcacctgcagaggactacacgtcctcgccatcagagggttgcatgccctcgcctttagaggactatacgtcctcaccttcagagggactatacgtactaaccttcagaggactacatgtcctcgccttgagagggacttcacacgccctcaccttggaggactacacgtcctcaccttcatagggctacacgccctcacctttagaggactagacaccctcatcttcagaggactatacgtcctccccttgagaggactacacatcctcacctttggagggctacatgccctcgcccttgtagggctacacgccctcaccttcagaggactacacatcctcgcctttagaggattacacgtcctcgcctttagaggactacacgtcctcgcctttagaggattacacgtccctcgcctttag

SEQ ID NO: 48064 - DNA, 522 bp, Glycine max
  Peptide Sequence Number=SeqID_139749
atgccaaaggtgaagcgttttagaaatccacaaaaatcagcacctcaaccacaatgtcatggacctctaacacaagctccaacacattctgttccagcaatgaatcctaaaatttcttccccaccaagtgattccacacaggctcttgaagtcccaactggtaatgtccctctttctcatgtatcaacatctgaagttccacaagaagatgaaacaactagacgtcatgttgggcgtgagtctacacaatgttggactgttgaggcaatagactatgaagaaacgatcaagaagattaaggtgaaagttaggggagtcaatagcttacctagggagttacgcatcattgtgaattttgatgaccaaggccaagcaattggtgaagcacaagccttgcttgcaggatttcttggaacactagcagctaattgcaaattatttcctatggattatgatagatggtctggaccttcaggcgtacctaaagcttattttgatgattgctttgaaacaattttaaag

SEQ ID NO: 48065 - DNA, 152 bp, Glycine max
  Peptide Sequence Number=SeqID_139750
atggctcaattgatttctgatgtcatctattgtttgcatggatcgcgcccacaagacgcccagtggacccgaagaagtccaacagggccctggggtttccagctctggttacgggcctttatcagtcctacagggtgcccacccccagcgag

SEQ ID NO: 48066 - DNA, 857 bp, Glycine max
  Peptide Sequence Number=SeqID_139751
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgttggcacttcaataggaccacaaatgtcagaactcactgcatgtagtggagagcttgctctcatagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48067 - DNA, 441 bp, Glycine max
  Peptide Sequence Number=SeqID_139752
atgagagcaagctctccactacatgcagtgagttctgacatttgtggtcctattgaagtgccaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 48068 - DNA, 780 bp, Glycine max
  Peptide Sequence Number=SeqID_139753
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaaggacataggagctttttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48069 - DNA, 288 bp, Glycine max
  Peptide Sequence Number=SeqID_139754
atggtgaaagtcggaacgtcttacgtgccgatcaaggtctcatattcgccaaaagtgggaccagggattcccggtatcaacagggacaccaggatttatttattctgcgaagtgatcttccgtcacagctgtccctcctgttcagctactgacggggtggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 48070 - DNA, 787 bp, Glycine max
  Peptide Sequence Number=SeqID_139755
tgatctccgtcacaggtatttattcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatttcaatactagagctattgattgcaccttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48071 - DNA, 189 bp, Glycine max
  Peptide Sequence Number=SeqID_139756
atgacatactcacttaggaaaactaggcagcaagtgtcgaggtcaccctgtcatgcacaggcaactccctcccatggtgatcagcctgagtctcaagggagttccaaaccgagtgacatgctcccaagaatatccaacatggtcactgcatccctgatcgaggccgtacccgaatcaaataaacattaa

SEQ ID NO: 48072 - DNA, 459 bp, Glycine max
  Peptide Sequence Number=SeqID_139757
atgaagcacttcactgacaccctcatcagtgccaacataagattagcacgacgggggctaattcatacaatgcagatccaaaatttaatgcatgcaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 48073 - DNA, 117 bp, Glycine max
  Peptide Sequence Number=SeqID_139758
atgaaactgagtgatatcatgaaggctactaacaacttcagtaataccaatatgattgggacaggaagaacaggaactgtttacaaagctgtccttgatgatggcacgacacttatg

SEQ ID NO: 48074 - DNA, 360 bp, Glycine max
  Peptide Sequence Number=SeqID_139759
atgggagagaaggctaatactccagcgctaaagattggaactggccccatcaaaagattgttggatacagaaaatgccttgattcgtaataccgagttgaccgggtatgggttcgggttcaggttttccccgataaccaaaagtcgggtacgggtacgggtatgggattcctgtatccaccccgaccctgaccctgaccctgaaaataacataaaaaaaaaaattaatagggtctgcagtctgcacattaaaaaagctaaagccaagccacattcagatttaacagcatcctacctcctacccccaaccctaaccctaacttcagaccttgaatctttctcttcttcttccttcaggtaa

SEQ ID NO: 48075 - DNA, 558 bp, Glycine max
  Peptide Sequence Number=SeqID_139760
atggaaggcgtgctcgactccctcgtgcgcgagcttctgaccgaggtgaacgattacgatctctgcgtgacggagtttctgcgcgtggtcgatatgttgttgccggtaaaatccttcttccgcctgtgccccgagctgcacaacaacagccggacctcttccggcacgctggtgcgtattcaactgctcggtcagtatccggaatggctggcggaaaacgccgcccgtgcggttgaactgggctcttacggcgtggatctcaactgcggctgcccgtcgaagctggtgaacggcagcggcggcggagcgacgttgctgaaagatccggagctgatttatcgcggcgcgaaagcaatgcgtgaggccgtgccttcgcatttgccggtgacggttaaggtgcgactggggtgggacagcgatgcccggcaatttgaaatcgccgatgcggtgcagcaggcgggcgccagcgagctgacggtgcacggccgcaccaaagaggacggttacaggcggatcgcatcaactgggcggcgatcggcgagatccgccaacgactga

SEQ ID NO: 48076 - DNA, 120 bp, Glycine max
  Peptide Sequence Number=SeqID_139761
atgtctcatcatcaaagaaatctatgtctaggtgcttcagatggtccgcggcggcgatgggcagcagcagcggtggtggaggatgatccctttcacttctttgacgattcttccatttga

SEQ ID NO: 48077 - DNA, 552 bp, Glycine max
  Peptide Sequence Number=SeqID_139762
atggggacaaatcaaaacggaaaaagattatatcaagtcaagattaagggcctagatgtcaccagccttaaggagttggcacggttgatgggacccctccaaaggcaagccttccgcaaagtgtacggaaagattttatatttgaccacagcggaggtatttacggaagccgttgtatccctcgtccaatactatgaccagccgttgagatgcttcacgtttggggacttccaaatagtaccgactgttgaagaatttgaggagattttaggatgccctcttgggggaagaaaaccgtatcttttctccaggtttcttccctccttgagcaagattgcagctgtggtcggagattcggcgagagagttggatcatatgaagcaaactcgaaatggcgtagtgggcctaccgcggaaatacttggaaggcaaggcaagggatatggcgaatcaagaggagtgggtcccgtttgcggatatactagctttgctaatctttggagttgtcctcttttcgaaacgtgacggtttggggggacctagccgcaattga

SEQ ID NO: 48078 - DNA, 318 bp, Glycine max
  Peptide Sequence Number=SeqID_139763
atggtggcccgggtaatgttggggaatggctacgagcccggaatgggtttaggcaaggacaacggcggcataactagcctgataagtgccaaaggaaatcgtggcaagtttgggttaggctacaaacccacacaggcagatataaggaaaagcatcgtgggaaggaaaagcggaggggatgaaggccaagtcgttgcaatatgcgaagatgatgctccaagtggtttggatttggtacgaccatgccctcctgatttccaactaggaaattggcgagtggaggagcgccaaggcatttacgcgacaagcataatgtaa

SEQ ID NO: 48079 - DNA, 264 bp, Glycine max
  Peptide Sequence Number=SeqID_139764
atgaaaggcctttttgttacaaaatttgaaagcaatgaaatgcttcttagtccaatagctcttaaggtggttggccctttgcttcttgactcaaattcttcaagggatggcaccaatcctcctttccaattccctatatggcaactcacaaacaaggaaacaaagagacaagcaattgttggaccttgtggcctcaataacttaagagggataggcttagaatgcagaagaagtaacaacaatcaatttaataatgttctttaa

SEQ ID NO: 48080 - DNA, 819 bp, Glycine max
  Peptide Sequence Number=SeqID_139765
atggatgagtcaccacaaagcgccatgaagaataaaaaagactcttctatgcgtgtcgccatcaatatggtgaagacgggggaggcgcaagcttgtgttagtgctgggaataccggtgctctaatggcaactgcgcggtttgtattaaaaaccttgcctgggattgatcgtcctgcgatcgcatctacattaccctctgaaaatggcagtacatttatgctggatttgggcgccaatgctgactgtactgcagagcacttgtaccagttcgccatcatgggtgccatggcggtgagttgtatcaataacaagcctaatccaaccattggtttgctcaatatcggttctgaagatatcaaaggtaatgaagttgccaaacaggcggcagagttattacgcggaagtcatttgaatttctatggcaacgttgagggtgatgatatttttaaaggcaccactgacgtggtggtctgtgatggttttgtgggtaatgttgcactcaaaaccactgagggtctggcgcatatgatggggaaattcctgacacaggagttcaagcgcaattggctgaccaagctgatggccttaggtgcgtttcccgtattgaaagcatttaaaaagcgtctcgacccccgtcgctacaatggcgccagctttttgggtttacgtggtattgtcgtcaaaagccatggcggggctgacagcattggcttctatcatgctattcatgtcgccatggaagaggcgcaaagcgggatgttaaaacgtatacaggcgcagcttgaaatcgaacatctcactccttctgagcagtcctga

SEQ ID NO: 48081 - DNA, 858 bp, Glycine max
  Peptide Sequence Number=SeqID_139766
atggtcgcactgtcgatctcgcatgccgctatggcggaggacattaaagttgcggtggtgggggcgatgtccggtcctgttgctcagtggggtgacatggagttcaacggtgcgcgccaggccatcaaagacatcaacgccaaaggcggcatcaaaggcgacaagctggtaggcgtggaatatgacgacgcctgcgatccgaaacaggccgtcgcggtcgctaacaaaatcgtcaacgatggcatccagtacgtgatcggccatctgtgttcatcctccacccagccggcgtctgatatctacgaagatgaaggcattctgatgatcacccccggtgcgaccaacccggagctgacccagcgcggctatcagcacattatgcgtaccgccggtctggactcctctcaggggccgactgccgccaaatttatcctcgaaaacgtcaagccacagcgcatcgccattattcatgacaaacaacagtatggcgaaggcctggcgcgttccgttcaggacggcctgaaaaaaggcggcgcaaacatcgtcttcttcgacggtattaccgccggtgagaaagacttctccgcgctgattgcccgtctgcaaaaagagaatatcgacttcgtttactacggtggctactacccggaaatgggacaaatgctgcgtcaggcgcgttcggtagggttgaaaacccagtttatggggccggaaggcgtgggtaacgcctccctgtctaacattgcgggtgatgccgccgaaggcatgctggtgacgatgccaaaacgctatgaccaggattcggccaacaaggctatcgttgatgcgctcatgcgcagaaaaaagatccgagcggcc

SEQ ID NO: 48082 - DNA, 456 bp, Glycine max
  Peptide Sequence Number=SeqID_139767
atgaattttgtagcgagaaagcctgtagaattcaccccaattccagtgtcctatgttgacttgctcccatatctacttgataattcaatggtagccataaccctagccaaggttcatcaaccttcatttgtccgagaatatgactcgaacgcaatgtgtgcttgtcacggagaagcccctaggcgttccattgagcattgtagggctctgaagcataaggtacaagttacaatgttaaatgaaatggataaagttgatatctttgtccctcatcctctcacaaacgcatctttgcttattcaactttcaccggaatgtgggtgcaagccattggtctgtttgctcaagcgacctgtgctcctgagtttggacttccaagaccgttcaatcagagattactcgtcatgcacgttggtggggggccgtaaaacaacgagtaaagttcaaaacaaataa

SEQ ID NO: 48083 - DNA, 400 bp, Glycine max
  Peptide Sequence Number=SeqID_139768
tctctgcgtgctatcaggcttttcgtcgtacagacagcaaaaaagaatatttgtacggataaccactcgggtatttccgcccgtcagcgtgactcaaatgtcagtatgccagatcttgtgagcgcggaagatgacacagcaaaaaagaatgtttatatggataaccacgcgggtatttccgcctgtcagcgtgactcaaatgtcagtatgacagatcttgtgagcgcggaagatgacacagcaaaaaagaatgtttatacggataaccactcgggtatttccgcccgtcagcgtgactcaaatgtcagtatgctagatcttaggagcgcggaagatgacgtaaatctccgcgtgtcaacgggcttgtcggccacgattgacgaagggcgcagaagacaac

SEQ ID NO: 48084 - DNA, 531 bp, Glycine max
  Peptide Sequence Number=SeqID_139769
atgtttagggatgctcgaaataaaaataaaaggccatattggattggagatcatgtctggaacaatccgttatcacattggaatgcacttgggtatccttccaatggttctatcagcttgcaggatcacgccatttgcttggaagaatttgaggctagactatctcaagttaggtctgatgttgcatcaagtgttggtgaatcacaactcactcctttagaccctgctgaaaaacaaaaacttaggagtcggtgttgggttgcagctacagaccaaagcgtaaaggatgcctttacggtactccagatcttgctcatacatataaatttggagatgagaacttcatgtagcatacgcaaggatcttcccattgtgctcaacatgccgcaaagattaaccaatcgacttaggaaggagcttcgtcaatcaaaggaggagatgcgtgtatttcagttagttgtccttcgattcctacctcctgaagtgtggaacattattcatcaacatcaacaacctcaccaacatcattag

SEQ ID NO: 48085 - DNA, 306 bp, Glycine max
  Peptide Sequence Number=SeqID_139770
atggaccatttcaagtgcttgaaagaatcaatgacaatgcttacaaagttaagctgcccggtgaatggagaatccaatttgaggacaaatccttctcaagagggagagaatgatgaggacatgaccaagagcaagggcaaggatccacttgaaggacttggaggacctatgacaagggctagagcaaggaaagccaaggaagctcttcaacaagtgttgtcgatactatttgaatacaagcccaagtttcaaggtgaaaagtccaaggttgtgagttgtatcatggcccaaatggaggaggactaa

SEQ ID NO: 48086 - DNA, 570 bp, Glycine max
  Peptide Sequence Number=SeqID_139771
atggaaacatgttcaacggtggaggagctgttacaacaaatgatggaccaaggccggtttgagatcagtgttgagaacaaggaagaacaacacatgtgcatgcagtcggtgagcaaagaaaaccctactaaacccaagcctttggtgatacacttcaccagggacgcggcctcccagaaaccccgaggccctcgccctgttacgggtagcaaacctattccattcccatatggaagcaacaaggcggtcccgtggagatacgcccctcagaagccaagcgaaaagaaagaagaggccaccagcactgacttaccttctgccaaagataccaaaattaccggcctcagtggtgtgacccgtagcggtcgcatctttgcagcacctgacccatcggtgcgacccacgaatgccaaaggaaaaacgaaggtggtcgcggaagagaccaacgaagcgagccccactctagatgaggatgtttcggctgggagatttgctgagaaaggaggagacttcgacagaaagaaagtgtccatggaagaagccaacgagttcctccggatcattcaatag

SEQ ID NO: 48087 - DNA, 848 bp, Glycine max
  Peptide Sequence Number=SeqID_139772
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatatcatttgctcagtatcgagtatttccaaatacaaacttgaatgaaaagtcttgccacaatactgatcaactgtattactgtttacactgtggtattattgatgtattggaatgtttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48088 - DNA, 216 bp, Glycine max
  Peptide Sequence Number=SeqID_139773
atgctgatctccccttatggaagtatcagttgggatcgcccccataagacaccgagtggacccagaggagtccaacaaggccttgggtttccagctttggttacgggcctctgtcagtcctatagggtgcccgtaccccctagcaaggggtcgcgctcgcaagacaccttgtggacccggagaagtccaatagggtcctggggtttcaagttctga

SEQ ID NO: 48089 - DNA, 225 bp, Glycine max
  Peptide Sequence Number=SeqID_139774
atgggtgaatcctcatcagatacacgttcgatccgtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacaaacttttaagtgaaaggttcgggagttgtatttacgcgcggggaaggtattag

SEQ ID NO: 48090 - DNA, 213 bp, Glycine max
  Peptide Sequence Number=SeqID_139775
atgagtgaacggggagattgtggaagcaatgtcttccaaggttattttgatgatgccaaagaatcaagagttaagcaaagtttcaagcaaagattcaagaaatcaagttccaagattcaagattcaagattcaagaatcatgattcaagaataatcaagatcaagattcaagactcaagattcaagaatcaagagaagactcaatcaagataa

SEQ ID NO: 48091 - DNA, 567 bp, Glycine max
  Peptide Sequence Number=SeqID_139776
atgacgcgcggcgaccatctcaccggcaccgaccggctggccgaggcggtcgaacaactcggcctgcccgacgacgccatcgtggtcaacgtgcagggcgacgagccgctgatcgaacccgaactcatcgacgccgtggccgcgcgcctggccgacagcccgcaggcggacatcgccacctgcgcctgtccgctggcggacgcccaggcgctgttcaatcccaacgtggtcaagctggtctgcgccaccgacggccgcgcgctgtatttctcgcgcgcgccgatcccgtgggcgcgtgatgcgctggccggcggcgagcgcgtgctggccgaggggctgccggcctggcaccacatcggcctgtacgcctaccgcgtgtcattcctgcgccgcttccccaccctgccgcaaggcgcgctggaacggttcgaatcgctggaacagttgcgtgccatggagcacggccacgtcatcgtcgtccaccaggcgtcgcatcctccggccgctggcgtagataccccggccgacctggaacgcgttcgcttgatctacagcaatcgtatataa

SEQ ID NO: 48092 - DNA, 408 bp, Glycine max
  Peptide Sequence Number=SeqID_139777
atgaacaaaaaaagatcttctacagatgatttgattcccattgatttggagattaatgccacttgtagaaggcgtaatcaagagagaattcgaaattttttgcaggacttagaggtagcaacaattccagaggaagaacctcaatcttctaaggcatcttctagttttcctattgtagaacattctcatttagatcctagtgaagactacatcatggctgaagagccaagaagagttactctggaagattattcaagttctaatgtgccacaaattttcactagcattgcacaaccaaaagttcaagcacaaaccattacttatccaccatcattgattctgttgattcagaataatttgtttcatggattactaaatgaagacccatatgcatacttagccgactga

SEQ ID NO: 48093 - DNA, 156 bp, Glycine max
  Peptide Sequence Number=SeqID_139778
atgatctcttggtttttgaaaggagagaatgatgcaatcctccctaggaagggaccagtcactagaaccatgagcaagaggctccaagaagattggactagagctgctgaagaaggccctagggttctcatgaacctcaggggctccatagtgtag

SEQ ID NO: 48094 - DNA, 153 bp, Glycine max
  misc_feature (103)..(103): n is a, c, g, or t
  Peptide Sequence Number=SeqID_139779
atgactaaagcacgtcaaaagggggtacggaaagaaaaggaaggagatgcttgccacccagctcgcccaggcgagctaggttgcttcctccagaagcaaccgncttctggaggaacatcctggaaggcccaagtgggtctggttgctatttga

SEQ ID NO: 48095 - DNA, 456 bp, Glycine max
  Peptide Sequence Number=SeqID_139780
atgaccatgattacgccaagctcgaaattaaccctcactaaagggaacaaaagctggtaccgggccccccctcgaggatcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 48096 - DNA, 237 bp, Glycine max
  Peptide Sequence Number=SeqID_139781
atggagaggagtatgattgatgctgccggtggtggagctcttggtgatatgatgatgcaagctccattggagcttcggaatggagaaagggagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 48097 - DNA, 582 bp, Glycine max
  Peptide Sequence Number=SeqID_139782
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttggaagggcgatcggtgcgggcctcttcgctattacgccagctgcgaaagggggatgtgctgcaagcgattaagttgggtaacgccagtgttttcccagtcacgacgtgtaaaacgacggccagtgaattgtaatacgactcactatagggcgattggagctccacgcggtggcggccgctctagaactagtggatcccccgcgcgcaggaattcgatagccccacgaattaattgccaagcgttgttcgtgcatcctccatcatcaaatgtttttcgaagtcccatgaatttattgtcgttcatgcatcctccaccattaagtccggagccccacgaattgattgcctag

SEQ ID NO: 48098 - DNA, 797 bp, Glycine max
  Peptide Sequence Number=SeqID_139783
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagagaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48099 - DNA, 525 bp, Glycine max
  Peptide Sequence Number=SeqID_139784
atggtgaaagttggaacctcttacgtgccgatcaacgtctcattttcgccaaaagttggcccagggcttcccgagtatcaactgagagacacaacaggattattttttgcggaagtgacattcccattcaggtgctccagtggcgtatcatggtttctatcagctgttccctcctgttcagctactgacggggaattggttccgctccaattcggcacacaagcatacacgccggacatcagcgctggcaagtggcgcgctttccatgtcgggaaacctgtcaggctgcgcaactgcttaagaatcggccaacgcgcgggcgatcgagtgcgggcctttcgcgtattacgccagctggcgctaaagggcggatgtgtgcatactggcgattactatgttgggtacactgatgccagggtgtcccagtcgaagtgcgttcatgtggcagaaaaaagcgcaccggtgcgtcagtcagaatatgtagatacaggactcactattccagggcgaattcctcgctactga

SEQ ID NO: 48100 - DNA, 552 bp, Glycine max
  Peptide Sequence Number=SeqID_139785
atgaagaacgtcgaagaacggtcgaaaccttcgcgaaattcatcacggaaacgttacagaaacgtttcggaagcgcctcggcttagattttcttcacggaaacaatttttccaagcaaattcgaaagagagagaagtgcctaaggggctgaacccttttcacttcacttctccccctatttatagaaaattgggggagaagcttgccacccagctcgcccaggcgagcagggttgcttcctccagaagcaacagccttctggaggaatcttctggagagcccaagtgggcctggttgctatttgcacccccatttttactaattacggaaacttacgaatttcgtaacgatacttgttttctttccgtaatgttacggaaccttgtggatcacataatcatcccctttttgacttacggaatgttacggaacctcactaattgtgcaacgatgcttccatttgatttccggtgtgtcacggaaccttacggattgtgcatcaatattttcttttgctttccggcatgtcccggaatttcacaaattgcctaa

SEQ ID NO: 48101 - DNA, 839 bp, Glycine max
  Peptide Sequence Number=SeqID_139786
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgattacctgagaaggcaaaaagcactgggacggccacatcaaaaacatgtcattgcacaagaggctaccgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48102 - DNA, 273 bp, Glycine max
  Peptide Sequence Number=SeqID_139787
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgcgtcccattcgccattcaggctgcgcaactgttgggaagggcgatcggtgcgggcctcttcgctattacgccagctggcgaaaagggggaatgtgctgcaaggcgattaa

SEQ ID NO: 48103 - DNA, 591 bp, Glycine max
  Peptide Sequence Number=SeqID_139788
atgtcagccagcgatcatgccattctacgcgacagagttcatcaacccacaaagaaaagcttgttagaactatcatcacatgatgctttattggcacaaaataagttgctttctaggcaacttgagattttaacagaaacacttgagacaaggatatactcaaggaggatttcaggcttccaacagggtccttataaccaacaagggcagtggagatcacaccctggaaatcaattcaacaaggaccagggtggaccttccaacaggtcaattcaacaagggcctaacatctttcgaaggactactaagctggaggagactttgactcagtttatgcaagtaacaatgtcaaatcataaaagcactgagtcagcactgaaaaaccttgaggtccaggtgggacaattatccaagcagatagctgacaagtcatccaacaattttatggcgaatatagaaaagaatcccaaggaggaatgcaaagctgtgatgacaaggagtaagaggtttgtggaggtgaaggatgaggatagtgttgtatccaagaagaaagctgctgaaaagaaaggtactgatgaaatgaaagatgat

SEQ ID NO: 48104 - DNA, 225 bp, Glycine max
  Peptide Sequence Number=SeqID_139789
atggatcgaagttggatgaatgaaagtcacatgagcccagaatatgaggatggcgtcgaacagttcttgcaatttgcttcagaaagaggtcgatcgaaagaagcctttgccaggtatgggtggagtgacaaaagtttcacctcactgcttgaggtagtgcacaatcttcttccagaggacaacatgttgcctaaaagaagcctttgtaaatggaaggatttttga

SEQ ID NO: 48105 - DNA, 303 bp, Glycine max
  Peptide Sequence Number=SeqID_139790
atgccaacctccccctgcagatgtatcggttgggattgcgcccataagacgcccaatggacccgaaaaagtccaacagggccctggggtttccagctctggttgcaggcctctgtcagtcctacagggtgcccgttcccccagcgaggaatcgcacccacaaagacacccagtggaccctcagaagtccaacagggccctggggtttccagctctggttacgggcctctgtagtcctactgggtgcccgttccccccggcaaggtcacgtcatcatatgtcagtatgcacatcgctcaactga

SEQ ID NO: 48106 - DNA, 171 bp, Glycine max
  Peptide Sequence Number=SeqID_139791
atggacaacgagtcaggaggcaggcggagataccttatggtcatccgcacctttcgtcaactgaggggaacgaatttgacggttttactctcgtcatccgaaaacattcaagcccgacgacgcgtaagattcttctctgctaggcgggggcaatcgagtgcgatggcgtag

SEQ ID NO: 48107 - DNA, 435 bp, Glycine max
  Peptide Sequence Number=SeqID_139792
atgaagattgttatctctattccatttataaattgtgattttgctggaggagaacattaccaggatagttgttatttctattctataaataaacctgactggagacaggagtcaaccatgtacaattatcatgagaaaggaagagctcttgatcttgaaagtgttttggtagacttcatgatatatcaagctagctctaaaggtgatttctattcaatgcaacagcatggaacccagtttgaaagggactattcttttgcagattatcaatgggagtcagaatggcaaccttattgtcataccctaatttcgtccagggaccatccgttgttgggatgcgaccctcgtttgaccacttcgaggtatttggcacccatcgttaggcaatttgtgaagttccaagacatgtcggaagccaaaagaaaagcgtcgtag

SEQ ID NO: 48108 - DNA, 204 bp, Glycine max
  Peptide Sequence Number=SeqID_139793
atgactcactataatccttaccctcggaagcaaaaaaggaaagaaggaaaatttccaatcaaagagaaagcaaaaagaaaagaaaggaaattcccaatcaaaaagtgggagaaagcaaaaagaaaagaaaggaaattcccaatcaaagagtgggagaaagcaaaaagaaaagaaagaaaattcccaatcaaagaatgggagaaa

SEQ ID NO: 48109 - DNA, 147 bp, Glycine max
  Peptide Sequence Number=SeqID_139794
atggtggaaactcaaagtgcctgcaagattcaatgtctaagatctgataatcggaaagagtatacatcagcaaaatttaatcaattttgtgaagaagctagaattgaacatcaactcacagccccctacactccagagcaaaatggg

SEQ ID NO: 48110 - DNA, 273 bp, Glycine max
  Peptide Sequence Number=SeqID_139795
atgtgggtggaaaaagggtgggagtggaaatttaaatggagaagacacttgtttgacagagaccttgagatggcatattgtttctgtaatgatgttgctgacagctgtattcagattcacaaaaaagatgagtggatctggaaaatagaccctactagacaatattcgaatacttccattatggtgggaatctatgacatgggtcaacattcatggagcttttctgcagaaaccgtggcagcacttttcccaacacgcgttctgtttgcctag

SEQ ID NO: 48111 - DNA, 759 bp, Glycine max
  Peptide Sequence Number=SeqID_139796
atggatgccggtagctgcgttggcgagatacctgtgccgccatttccaatggtgagaacgttgctgacctggaagggtgccgccgggaggaatggcgaaaccagtgatgccgccattcacaatggcgagaagcttgctaacctggagtgctacaggcgtgtgttgctagcaccaattgcggcaagtgctccacgaaaatatgttgccttgcaaaattgtgatgacgaagatgttgaaactatgatcgaaagttttcaacaacaacaacaaatgtcagttctagaattgtacgtagaaaaggatgttgccggtggttccatgtttcattttgcaaattctgttatgtcatgtggacataatctatctcttcatgagtcggaactgccaagaaatataagcaatgtacatgatgatgaagatgatgatgatgatgattatcttgcgtctaactcatacattgaagagtctttggatgaagatgatagtgttgaaggaatatcagatacagacgatgaaggcaccgacattattgaaccagtttcaattgttcacccaacagaaggtgtactaggaattcaaaatccattttggaatgatgctttgcattataacaatatcaattggagtcatccggacgaggaagacatttgtggtttggacatgccaatgacttttaatgttggacaagaattatatgttggcatggattttgatagtaaagatgcagtaaaaaatgcactaaaacaatatgtgatgaag

SEQ ID NO: 48112 - DNA, 450 bp, Glycine max
  Peptide Sequence Number=SeqID_139797
caggagagaatcattgagcctgtgtcacatggtcctgcatcagagcgtcaatttccagcacaagagtttcacattcttcagtcaagtgttgaaactcagggcataggcagacgcagggaggttgttgaagcggaagaatgttcccaacaaatggcggagcgtggccatggaatgcattacacgccacaaacatttgctcagtatccgacacagatgtatcagtatccttttcaaggtcatcacactgatacttctgcaagtcagcattcgttcggtggtgttgtgttgatttgcgtcatgaattttctgctgaggctgacaaagaagaagcagggaggcatcggggcagaagaaatccttatcgccaagcacgaagatgggatcgaccatgtggcacatcctcacggcatcacggacaccaaaatgaatgatttgcatgtctccgtttaa

SEQ ID NO: 48113 - DNA, 330 bp, Glycine max
  Peptide Sequence Number=SeqID_139798
atgcgcgtttatcactcatcgagtgtgcggagaaccgcatgtcatcaggcctgccacctctggatgacaaaaggcgtagaagacgacgttagtctctgcttgtgttgcaacatgcccttttgcgggcgagcgaggcgaggctcacgggtgcgctttccaaaggaggaaagatgcgcggagtcgccaccaatgtttatttgtggaaaacatcgaaaaaaccgaaggaagccgatcaaaatgaaaattctaagttcgggagttgtatttacgtttgaggaaggtattagcacctctcacgtttgtctcaaaggacaacagcctattttttag

SEQ ID NO: 48114 - DNA, 470 bp, Glycine max
  Peptide Sequence Number=SeqID_139799
acttggctcagagtgagagctatgcctggggagctgccgcgctggtgcatatgtatgaccagtcaaatgaagcttctcagagcactagacaacagattgttgggtaccttactttattacaggcttatatgaagggattaacagcatcgccgtaccagacatgtatagatgctttgacgatcactaacgtgtgctggatgccttatggtgaccaccgaggagttagggcgtttgacctcatttcatgcttccagggtcagcttagatggggtcttattgtggtcacacttcgaccaaagaggatggtgcgacaattcggctacattcagaccatccctccaccgcctattagtgccaccttgtcatataaggatatcaatgacaggtggatgccctactcggaccatttagcagttacaggtcagatttgtcttgtgcctgggcaggtttcaggagattacatggaatga

SEQ ID NO: 48115 - DNA, 327 bp, Glycine max
  Peptide Sequence Number=SeqID_139800
atggtgacaccgccaaggtcccctccgcagtcagatggtaatacagagccacaacctaagaagacaagacaaagcacacgtcttagaaggctgactttaagaagtttagatcagcctagaccaacagttactgtggatcctgcaactggaagagcatcaggcccagagaagcaaaagttccacagttttttaagggtcctagctcgagaaaagatcccgattgtccacagcaattggaaaaatgtgcgagaaactcttaaggacatggtatggggggacattttggctaaatttgatatcccagaagccgaaaaggccaagaaaaag

SEQ ID NO: 48116 - DNA, 570 bp, Glycine max
  Peptide Sequence Number=SeqID_139801
atgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttggtagtgaaggaaatcattttatctactaatagcggacaaattggagtattaccaaatcatgcgcctattgccacagccgtagatataggtattttgagaatacgtcttcttaaagaccaatggttaacgatggctctgatgggcggttttgctagaataaacaataatgagatcactgttttagtaaatgatgcggaaaagggtagtgacattgatccacaagaagcacagcaaactcttgaaatagcagagctaatttga

SEQ ID NO: 48117 - DNA, 297 bp, Glycine max
  Peptide Sequence Number=SeqID_139802
atggtgaagaagtttagaaaatttctcaaaagatcaaaagacaaaagattctctaaaccttcaaagaagacagaaagcaacaacaacaccttcagatgcttcgaatgtgggaaacaagatttaatggatgactcttcaaccattgaagaaattgaggtaaattctgaatttgaaaaagttttggaagcatttaatgaaatgcatgaaaaagcgcaaaggcttgctgtttcaaacaataagctgagaaaggatctaaaattgcatatctcaaattggcttcaacacaaagtaagctag

SEQ ID NO: 48118 - DNA, 217 bp, Glycine max
  Peptide Sequence Number=SeqID_139803
atggatgagagtttctctctaggttcttggttgaacaattatcagacttatcaaggtggcgtctacccagacttatcttccttcactggaagtggcgtctaccctgacttatcttccttcactggaagtggcgtctatcctgacttatcttccttcaccggaagtggcgtcatccaaaaactctataacctgtatcaagcgatccgctcctactcag

SEQ ID NO: 48119 - DNA, 366 bp, Glycine max
  Peptide Sequence Number=SeqID_139804
atggagaaggacaagggcggtcttgcttggcgcaaaggctgctggttcgggggtaggaacttcgattcgcccggccagcaggcgggcggcgtgcttatcttgtgtgacaacactacagagcgagtggctcttctaggcgggcagctgtgtgacaacactacagagaaagcggcgctttcgtttaacatgctatggtctcaacgcccttacgagatagtgatgagtttcacgcgctctaagcccggcccgcgcgcggttaggaagattggccgcaatctgagcggtaccacccaccctaccctaccacctataggcggccgtccgttctacagccgcccgaaaaggaactgcagtgatcttgaatag

SEQ ID NO: 48120 - DNA, 1191 bp, Glycine max
  Peptide Sequence Number=SeqID_139805
atgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccattaactatatatcaacgttccaacaaaaatacttgtatgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgg

SEQ ID NO: 48121 - DNA, 246 bp, Glycine max
  Peptide Sequence Number=SeqID_139806
atgagaattttcgaaactggaaatgcaaggttcattgaaaacggtgaaatcagtgggagtacagttccacgagaagtggaaattaaagaagttagagtgcaagtccctttagcttttgcctctagcagtaaggtgattactacttcagttattgctacaaacagtaatgaagaagtacaatacaatgatgagcccatgatacataatgaacccattttgtggaagaaccaacaagaagtacattaa

SEQ ID NO: 48122 - DNA, 150 bp, Glycine max
  Peptide Sequence Number=SeqID_139807
atgcaacaaggacaagcatacatccccatagttaggttccctaaccccaactatgcaagcaacggttgctcgtggtggccaccggcggtcgtgggtggtggagaagaaggtgttagggtttgggtgggcttttggagagcaggagagtga

SEQ ID NO: 48123 - DNA, 553 bp, Glycine max
  Peptide Sequence Number=SeqID_139808
gatggacccttgcgtactagtaccctcacctttagaggactatacgtcctcgtcatcagagggctgcacgccctcaccatcagaggactacacgtcctcacctttagaggactgcacgtcctcgccatcaaaggactacacgcactcatcttcagaggactacacgtcctcacctttagagggttgcacgtcctcgcccttagagggctacacaccctctcctttagtgggctggacaccctcaccttcaaaggtttccttttatcagttcctgggccaccccctgatattggagggcgaccaactgtgcgagcacaaccagagagggaagctatcgcccaactactttgcataccggggcaagatttcacccgtgccgctacaaagagacgagtgcgggtcatgcgcaccaacatgaccactcttacacagatatggatgacgctgctacttagcaacattccacccggtgaccgcaatgccgatctccccctgcggaaatatcaggatagtgcccacaagacacccgatggacccgaagaagtccaacagg

SEQ ID NO: 48124 - DNA, 923 bp, Glycine max
  Peptide Sequence Number=SeqID_139809
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcccaaaatctagaagtaaatctaggatctctattagcatagagtctgatagagatcctaggtttacctatagattttgggagagtctgaacaaagagttgggaaccaagcttaggctagaatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48125 - DNA, 249 bp, Glycine max
  Peptide Sequence Number=SeqID_139810
atgaagatgctcttgataccacatgatgtagctccatgtggagcttgtaggccttggatcttcttcatcaatggagtcgtgtgcttcttgaagatcaatggcagcggaatggaggaggaggaaagcccactaatccaagatcaagtccaagattctccactaagtgtggttaggtgtcatgaggcatggtggatacatcttggtagcaccagggtggatgctcaggttgctcctatgtccttcctctaa

SEQ ID NO: 48126 - DNA, 176 bp, Glycine max
  Peptide Sequence Number=SeqID_139811
aaaacgtgatgaactcgccaagcgagcatgctgcactaagcaagttcatcaatactcattgtatgcaagcgttatctgaagaactcgctaagcgcgcataccgcactaagcgggttcatcctttgaggatgaacactcatcctcttgttgaactacctgtggctaagcgaggctga

SEQ ID NO: 48127 - DNA, 171 bp, Glycine max
  Peptide Sequence Number=SeqID_139812
atgggggtgcaaatagcaatcaggcccacttgggccctccagaagattcctccagaagccgaggcgcttccgaaacgtttccgtaacgttttccgtgaagaatttcgcaaaggtttcaaccgttcttcgacgttcttcattcgttcttcatcgttcttcgatcttcaacgg

SEQ ID NO: 48128 - DNA, 608 bp, Glycine max
  Peptide Sequence Number=SeqID_139813
gttatcatgaacacctagagcaatcctcagaaaagatttcagaagacaaacacgagcagtggaagaaacttgattatcagctttgtgctctcttgtggcagtttgttgagccaactatattgacaaatttcagagccttcaaaacttgttattctttcaggaaaaagacacaaagtgtttttgctaatgacattcaacaattgtatgatgctactcagaaattgaccactcttaaacaaactgatcatgacatggttgcctatgttttgaaagcccaatctgcagtggaggagttaaaattatcattggataaacttgaagacataaagacgaaacttgataatctatatatagtgttggtactaaatgggatgcatccagattttgatcatattcgtgaccaagtcttaactggccaagttccttctctagagaatttaattacccggctccttcgtgtcccctcaccaaaaataggaggaaattcagttgacagtattgaactcctgccatggtatctagttgagggggacgaggtggtcgtggaaaccgaggaggacgagctggaagaggaggtcaccctcaatgttcttactataagaaagtga

SEQ ID NO: 48129 - DNA, 280 bp, Glycine max
  Peptide Sequence Number=SeqID_139814
atggaaaaatccgacaagaaaactttcaaagataagaaaggaaagaaagcatatatcacttgggaagataatgacatagattcatcaagtgattcagaaaatgaaatcataaatctaagcctcatggccaaagactatgaaagcaaagaagaggactccttgaagcaaaattggtacattgatagtggttgctcaaaacacatgacgggagatgcatcaaaatttactcatatttctcacaagaatagtggacatgtgacatatggagacaacaacaaag

SEQ ID NO: 48130 - DNA, 190 bp, Glycine max
  Peptide Sequence Number=SeqID_139815
gcaacaagatgagaattggttccacctgttggccccaatcattagtcagtggaacaatgcagcgcagtttagggtcgacgtttatcctcgacagcagggcctactaggttttaactcggactatatggtgtggtataggcgtaaaacaaagatgtttgtcgacccaaacaatgcaaacacagctgcattg

SEQ ID NO: 48131 - DNA, 129 bp, Glycine max
  Peptide Sequence Number=SeqID_139816
atgggacaccttagtaatcatggggttcccatgaactctaagagaataaaggtcattcctaagtggcgcactccaccaagtgttgagggaaaaagcctagagtttcaagaaccttgggatttgaggtaa

SEQ ID NO: 48132 - DNA, 366 bp, Glycine max
  Peptide Sequence Number=SeqID_139817
atgtccaaatcttgtggatttgggatgaccggccctctcgatgagtcgatctcttgctttctcataagggtggcaccttggttaccctcaccgttgagaggactacacgtcctcgccttgagaggactacacgtcctcaccatcagagggctgcacgccctcacctccagaggactacatgtcctcgccttgagagggctacacgccctcaccttgggtactagttaccctcaccgtcagaggactacacgtcctcgccttgagaggactacacgttctcagcaccagagggctgcacgccctcacctccagaggactataagtcctcgccttgagagggctacacgccctcaccttgggtactag

SEQ ID NO: 48133 - DNA, 414 bp, Glycine max
  Peptide Sequence Number=SeqID_139818
atgtcgcgggggtcaggagaccttggggacatcaggcttggaaaacgagtagtgcaggaagctataagggcttctggtaatcgattaccaagggggtgtaatcgattaccaacggtcagaaatgaaggcttatgcctagagttccgtaaaggaggccttcgaggaatgggtcactggggctttaagtcggaattaccaggtatgtgtaatcgattaccatgccttggtgttggcagagttttcatgtcctttgaagcctgtgtgattcgagtttggcctctgactcggaggcgggcaaccaggggatggtgggtttatgcgcaatttgtggatgtggaaaacttgttgtgcaccatcgcccgaccgccacctagtaccacatgtgatgggtaccccataatcctacaagcttga

SEQ ID NO: 48134 - DNA, 729 bp, Glycine max
  Peptide Sequence Number=SeqID_139819
atggcagaagtctccacagagtccattgcctccctcgcccagtattatgatcagccgttgagatgcttcacttttggggacttccagctatcacccatggtggaagaatttgaagagatcctaggatgtcctctagggggaaggagaccatacctcttctcagggttttatccctcattagctagaatttctaagatattccaaatctcggcgcaggaattagaccacagaaagcaagtcaaaaatggggtggttggaatactgagaaaatgcttagaggcaaaggcaagaatcttggcaggtagaggcgaatgggccccgttcatagacattctcgcactgttgagcttcggaggagtcctctttccaaatgtggatgggttggtggacctagcagcgatcgacgcttttcttgcttatcatgaccacaaggaaagctcggttgtcgctatgctagccgacctatatgacactttcgaccgaagatgtgagaagagcagtacgaggattgtttgttgtactccggctctttatgtatggttggtttcacacctttttcgccaagaggtgaggcatgcttgcccgctagaaagccaccgttcatgcacagagaaaggaggggcaaattgggaccgactcttagcaaacaaagaagaagcttcgtcagctggttccctcgatggaaagaagggggaaccggggttcttatttcatgctgaggatttctga

SEQ ID NO: 48135 - DNA, 357 bp, Glycine max
  Peptide Sequence Number=SeqID_139820
atgggggtagacttcctcactagactcttcacccgttacttcatcttcacttccactagaggaaggggaagaagtagtctcctcttgactactataaatgtcttaacgcctcatgataatggttttcattgtggggcattgagaggcaatgtgacctctcccaatacatttaaggcatttaatgttgctagtcctttcttgggaactagtcttaggggtgtatttctctatggtcttacccttatcttccttgggtttagaaggctaaaggcccaagtggagaaggacgaaggcccaagtagagaaggacaaagcccccgagtggagaaggatgaaggcccaagtggagaaggatga

SEQ ID NO: 48136 - DNA, 486 bp, Glycine max
  Peptide Sequence Number=SeqID_139821
atgtgggcttttctcaccggtcgtcagatcgactgggcccatttggttcggtaccgaatgcataaggcattacgggccaatgcacctctaccttatccacagttgataactttgtttctgcgtcattttcaaattccgcttgatgatgagccatttgttcaagtcaagcgttcctttgcaattggtgctggtgttgtgacttcctttggttaccgtaaggatcggaatggtcaatggctgaagaaagacgcactcccacctcaagatgagcgtactccttcacctcctcctcagcatgaagattcagcactcctgaatggagtccttaccgaattacgaggtcttcgttcttatgttggtgaacgtttcgactcattggatacacgctttgccgacatggatattcgcctcacacaagttgaagaagatgtctccttcatccatacttgctttgatccaccaccgccgcctccatcatcctcttag

SEQ ID NO: 48137 - DNA, 222 bp, Glycine max
  Peptide Sequence Number=SeqID_139822
atggatcaattagacttttttgggaatggtgttttgtgcggggtgagaaagtcgctagcgcacaggattttggttggcaatcaaagggaggggaccacttcaagtcgtggttttctttctaatgagaatcctgaaactggccaaaaacaggctaaaggatcaagtggagaaggacgaaggcccaagtggagaaggacaaagcccccgagtggagaaggatga

SEQ ID NO: 48138 - DNA, 249 bp, Glycine max
  Peptide Sequence Number=SeqID_139823
atgactcactataatccttaccctcggaagcaaaaaaggaaagaaggaaaatttccaatcaaagagaaagcaaaaataaaagaaaggaaattcccaatcaaagagtgggagaaagcaaaaagaaaagaaaggaaattcccaatcaaagagtgggagaaagcaaaaagaaaagaaagaaaattcccaaccaaagaatgggagaaagtaaaagaaagggaaggaaagaaagttcttgatcaaagaaactag

SEQ ID NO: 48139 - DNA, 252 bp, Glycine max
  Peptide Sequence Number=SeqID_139824
atggagcgggggcaagtgcagatccatgagtgtctctaccagctcagcctcagtcagcagagtcagggtttcgctccttttgcgtgccctactccagatcagttcaggactgaggttgcatggcccggagattggcctgaggcccaggcaggggaagctcctgcagaggctcccggcgatgcagaggaggcccgcatggatgaggagatgacagatttactcggtttcttgggagggagtggagccacatga

SEQ ID NO: 48140 - DNA, 391 bp, Glycine max
  Peptide Sequence Number=SeqID_139825
atggctaagtttgaccctcaggtagtcctggagttttatgctaatgcttggcccacagaggagggagtgcgagacatgcgttcatgggtgaggggtcagtggattccttttgatgcagatgccctcagccaattcctgggtgacctgctagtgttagaggaaggccaggagtgcgagttcagtcagaggaggaacagggtcgatgggttcgacaaggaggccattgcccagctgttatggacaccggggcaggatttcgcccggaccgctgcagggaggtgggtgcggatcatgcgcaccagcatgaccaccttgacccagacgtggatgatattgctactcagcaatgtcttgcctagcgatcataactcggatctccctctgccgaagt

SEQ ID NO: 48141 - DNA, 543 bp, Glycine max
  Peptide Sequence Number=SeqID_139826
tgttggatctatgagcatttttcgtctattggctccgccttagctgccgaggattatgatgggaggagaccacgcacatgctggtggacctttggcaaggcactgcccgtgtcgacgtatcacagagaatttgaggtcatcacgttgttttccggccatctcagatggggtcccttaatggtcattcaccgaccagagagggtggtacgacagtttggatacatccagactatttcgtcacatcctgctacgacttcggtttcttttgaagaaatggacgatagatggatgcagttcagtgactacattgcacctgtaggacaaatctgtgtagtgcctggccagtgttcaccaaattacatggattggttatgcatgatatcacacccattcatgagtccagcacaactaggggatcctcctagagttctgtcggttcagcaatatgacacatttgttgaaccagatgtgcatcagcaacaggtggcggcaacgacacttgatgaggcagatgctgatgtgcatcatgttggacatgcaatg

SEQ ID NO: 48142 - DNA, 264 bp, Glycine max
  Peptide Sequence Number=SeqID_139827
atgaccaaagtgaacaaagagccatttctagggcaaatttgggtgttgaagagtcaaattttgattcgagttttctgcctttgccctgttttcttggctgtgcttgggaggattgatggggacccggtgttgagagaaacgaggttatgggctacgtgggagtacgtgagctcagttggaggtgggcaacaggggatggtgggtttatgcgcgctttgtggatgtggaaaacttgttgtgcaccatcgcccgactgccacctag

SEQ ID NO: 48143 - DNA, 732 bp, Glycine max
  Peptide Sequence Number=SeqID_139828
tgctggatctatgagcacttccctagtgtgcatcagtgcgtgactgatgatacataccaggagacgtccccacgtgcttcccggtggttgacgtcgaaggcgcacatgaagggcatcacaggagcaccctacagggcacgttgtgatgttttgaccgtcacagatgtgtcctggttgccgtacacggagcatgggggtcagctcagatggggtcctatgatcgtcacagttcgaccggagaggatggtgcgccagttcggttacatccagagcatccctccgccgcctgttagtgcacgattgtcacacgatcagatagataataggtggatggagtttgcggatcacttactacctgcgggtcagccttgtctagtgcctgggcaggtatctgcggattacattgagtggtttttccgcatatctcaccctttcatgacaccgacccaggcagctgaccagcagagggatgcaccagctgtagaccctgaggactacatacagccgcccagcccccaggttccagtggcatttgacccccctacatatgtggatgattacgagggatatgaggcgattgcacagaggttggagcgtgtgctcaaccttaggatagtcactgcaggcacagagttatatgacattatgcaggactgcctgacgatcgcgagagggggacccagtgctgatgggacggtcagggctcgtcagagacgccgcacggaccattga

SEQ ID NO: 48144 - DNA, 483 bp, Glycine max
  Peptide Sequence Number=SeqID_139829
atggctacttccggtcctgtgttttccttctctgctgtcagccactgtctctactgggcagggttcgatctggtcaagaaccctactttaggtcatttgttgatcctgttgtctagcaacttcttgcttgtctttgtccttgaagtaattgttgtccttggggttcaatctgtactaatcactttgaagtccagccctgcagcaagtgcagcttttgtttctgggaatttgttgtttccttcttcaagtcctgccacatcttttgaacttggcacccctgcttcctcttcggtggtctactctgttagctccaatgtggtccaattctccagtgcatcaactcctcaattttcatttactccggcagcagcagcctctacctccacacaagccagcaacctgccccagttcaatcaaattttgtatttgggagcatcaactccatcaggaggcagtcctttccagtttggtggtgcagcttga

SEQ ID NO: 48145 - DNA, 564 bp, Glycine max
  Peptide Sequence Number=SeqID_139830
atggcttctatcatggaggccatgctaaaacttcagaaaactatagaagataatgccacggcggccgcctccaatacagctagggaagcggaatcggtgctaccgcccgtaataaacttgggccgaaacacgacggtgttaggtcggaggtatagtcctcaagcctacccttatggtttgcctccagacttcactccccgtaccgctccggatgatttgaaccaagcccttaccttcgaggggaaactccctccttatgccgactatcccctgcaagaagatgatgaaggagatgcccatctaggccctctgcttcccctcaaagatccggccccccatgaattgccccaaccaaacatagtccgccatgtcccgtcttcacccgcacccgtaaaagaatccgttccctttgcaaaagataagggaaagattgatttacttgaagagaggctaagagcggtagagggcctcggcaactacccgttctcagatttagtggatctatgtctagtacctgacatcgtcatccctcccaagttcaaagtaccagattttgataaataa

SEQ ID NO: 48146 - DNA, 477 bp, Glycine max
  Peptide Sequence Number=SeqID_139831
atggttaaggaggagtgtaaggaggtaagtgtctcctccaagaggttagctaagaaggaaagacaatttgaaataaagacaaatattaaagaaatttcccttcttaaacaacctccacattttctcctttgtaaaaagacacttgttcgcattgccacacctcttaggcttgagtttattcctcaagtaaaggagttgttggatgagggtttggtattattaggcacccaaatccctaaaataggtggtatgatgaatgctttgggtggtgcaacactcatttgtaaaatcactcgtgcacccaacatcttcatgatttgtgtacacagggactcattaggtaggaataatcaacatgaaaatacagaaaaaggggttcccataaaccctaagagaataaaagtcattcctgagtggcccgctccgccaagtgtgttgagggaaaaagcccagagtttcaagaacctcgggatttga

SEQ ID NO: 48147 - DNA, 558 bp, Glycine max
  Peptide Sequence Number=SeqID_139832
atgtccaccgttgggaccagatggaggcaatttaagtcctccctgacgaccagatatgtatacgctgagaatgacgatgaacaaaacaaggatccatctgctaagtatggtattgatcgaaatacatgggaagaatttgcaaagactcgacatacccctacttggaagggaataagcaaaaaagcccaggagattcaaaaattcaatgaatctccccacgtactgtcttgtggaagctacgatgtgcttgaaaaaaaattaatggccgagaaaacaaagtcaagactgaatgaaggtgacaatagtcaaaatgcagatatggtcgtcgaccctccatcccctattacgagacatgagaagtggaaaaaggctaggacaaacaaatttgggcaaatgacatctgcagcaactcaagaaatcgcagacaaaattgatgaattacaagaacaaactaaacagggagctttttgtcccacatggtcgtcaagacatcctgaacactgccattggctgtccagagcatccccctccttgttcgtatcgatggacatggtgtga

SEQ ID NO: 48148 - DNA, 124 bp, Glycine max
  Peptide Sequence Number=SeqID_139833
atgagtcatcattcatctagtgttaatggcgagggtactagtcataaagaccctttatctagaatcttagatgagttgatgatgcaatcctactccgcaagggcattggatagaaaaactccaa

SEQ ID NO: 48149 - DNA, 818 bp, Glycine max
  Peptide Sequence Number=SeqID_139834
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggagataccatttgaacttaacaatcttggacctttgattgagaagtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48150 - DNA, 387 bp, Glycine max
  Peptide Sequence Number=SeqID_139835
gctgtcattatgttggatgagttgctagaggtctcgggtgaggagcttagagctaaggctgcgcagtggcttggggcacatagtgggagctatgcatggggagctgccgccctggtgcatatgtatgatcagttaaatgatgcttctcagagcactggccaacagcttgttggttatattactttattacagtgttggatatatgagcactttcctaatgttcatgcgagtgtgactgatgatgggtatgatgagacgtcaccacgtgtctgccggtggcttactatgaaggcttatatgaagggattaaaagcttctctgtactggacacgtatagatgcactgacgattcctgacgtatgctggatgccttatgttgaccactga

SEQ ID NO: 48151 - DNA, 514 bp, Glycine max
  Peptide Sequence Number=SeqID_139836
atggcgtcaataaagcggtccagctctacctgtgctttccagattcccggctcaaccatagacggcgtcccggttagttcaaccgcgcgaaggcatggcgcgtcatctgatgaaacctatccgcctgctcgagcaatatccagctcgctaattccgccggtgatcgggatcatctccgctcgcggacgaatatcagaatacttctggtgcgccacgcgggactcatcgcggcctggtatagatgcaccggataagcatctttcaatcggcgctgccgaacggcgcggcggaaaccgcgccctgacgggtcagcatgccttcaatctgtaccacgctgtgccggtacaaacggcgccaggtgcgaaacgtttcagcgccgataaagcccggagaagtgatcccgacctgggcgttcatgttggcgccgtcgagataaacctggccgccgaactgatgcactatctcgcacacttcacggatggtctcttcatacacgccgtgggtcgacggatag

SEQ ID NO: 48152 - DNA, 357 bp, Glycine max
  Peptide Sequence Number=SeqID_139837
atgacaaaagacaaggttggtacctcaaagccctacactgaggcaatgaggggcactgtgcatgagccacaagcgaacctaggagcagatcaaaagtactcacccgtcgatgtttttaaacaaagaaagggggacaaaccctgggatttcaatggattgattaaaagtcaaacggctccattgtcgtcactccaaaatggtcaagtgactaaatcaaatagaacatacactctgagggagttccaggagagatttgcaaaagataggataaggttgcatgaattatcacctctttcaaaaggacagtcaatttgtgttttccgaaataatcaaatcaaaatcaaaatcataaaatag

SEQ ID NO: 48153 - DNA, 303 bp, Glycine max
  Peptide Sequence Number=SeqID_139838
atgatattgcacgagattataaggcctaactctctcaaaacagtccccagtggagtcaccaactgtcgcaacctacccttcgacaggagggcaaggcgagactcaagggtgcgtcttccaagaaaggaaaatgcgcggagtcgccaccaacgtttattcgaggaaaacgttggaaaaaccggaaaagggtgtggtctacgaactttaagtgtgaaaggttcgggagttgtatttatgcacggggaagggtgtttcccttgctcctacgtattcctcaatggtcggatgcctaatttaccctag

SEQ ID NO: 48154 - DNA, 1107 bp, Glycine max
  Peptide Sequence Number=SeqID_139839
atgagtcatcattcatctagtgttaatggcaagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaaataagagaggaagaaagaagaaaaataatgaaagaaatgaaaagagaaaaacatgcctactatagtagtcataactcttgcaaaagcctaagtgaagaacttcgtgactattacgaaggaaggcataggtcacatcttagacctcactcccatagaagagaaaaggaaagaaagcctcaagaggctaacattaaactctcatacttccatgggaaggacaatgtagaggctaacttagattgggaaataagggtagagcaacaacttaaaaagaagtctacttcaaaatcttatggctctcactcttatccaaagaaagaccaaggtcaagacatattaggggtgacaccttctaagcccaaagatgataaggggaagacaatagaaaagcaagcccctaaggctagacacattacttctcaatgccccaccacaaaaaccatgattaatgaaggggccaagacattttatagtagccaagatgaggctactacttcaccttcctctagtgaaagtgaagaagcaaaaggggaagaatctagtgaagaaatctacccccaagaagatggacaaccattagtggttaaagagaagtgtaaggaggtaagtgtctcctccaagaggttagctaagaaggaaactcattttacaataaagacaaacattaaagaaactttccctctaagacaacctccacattttctcttttgtaaaaagacacttgctagcattgccacacctcttgggcttgagtttattcctcaagtaaagaagttgttggatgagggtttagttcgcaagagcttaaatccttgtgctttgttggtgcccaaaataggtattattaggcaccaagtccctaaaataggtgtcatgatgaatgttttgagtggtgcaatccttttttgtaaaatcactcgtacacctaacatcttcatg

SEQ ID NO: 48155 - DNA, 321 bp, Glycine max
  Peptide Sequence Number=SeqID_139840
atggctaagtttgaccctgagatagtcctggagttctatgctaatgcttggcccacagaggagggagtgcgagacatgcgttcatgggtgaggggtcagtggattccctttgacgcagatgccctcagccagttcctgggtgactcgctagtattggaggaaggcaaccagtgtgagttcggccagaggaggaacagggtcgacgggttcgacaaggaggccattgcccagctgttatgcacatcggggcaggatttcgctcggaccgctgtagggacacaggtgcagatcatgcgcaccagcatgaccaccttgacctag

SEQ ID NO: 48156 - DNA, 282 bp, Glycine max
  Peptide Sequence Number=SeqID_139841
atggcacgcagcgtgtccgcttcgtgcccctattcaagggacctaaatggaagggagctaactaggcttttagtgataattcccaaggtggtcatatctcacttaatggtctctagagtccccaatggagtcgccaattgtcgcaacctacccttcggcgagagggcgacgcgtgactcacgggtgcgtgttccaagaaaggaatacgcgcggagttgccaccaacatttatttgagggaaacgtcggaaaaaccggaaaagacgtgatctacgaactttaa

SEQ ID NO: 48157 - DNA, 210 bp, Glycine max
  Peptide Sequence Number=SeqID_139842
atgcaactaacagtgtactggattaaattaaattaccatgaaaactcacctatcagcttcatcagtatcactatcttgtgcctccccgaggctcagcgtgacattcttctgagcaaacatcttgatatcccagaagcaatttccagagcaaaactagacatcatgaaaaagagccgtgtgcctcaaagcggaacgagttcaatagcatag

SEQ ID NO: 48158 - DNA, 558 bp, Glycine max
  Peptide Sequence Number=SeqID_139843
atgaccggaaggcttcttgccggttcattggctttcgaaagtcgcatccttcattatctaattgttcgcatcttgcttccgagatcttcaaaccttgcacaggtttctgaagaagatctcattgttatgtgggcctttcataaaggtctacaaattgattgggcacatcttgttagatatcacatgcataaggcgttgcgattgaatgctccatttccatatccacatctagtcaccctcttccttcaacactttaacatccctcttgattctgaaccctatgttccaatcaagagatccttcctaataggcgcttcagtcattgctcgacatgttggtgaagaaggacatgatggagaagattcatctcttctttcaaagattttggataggtttgatggtcttcaaacctttgttggtgaaaggtttgacactttggaattacaagtggagatgcgcttcaatgagatagagtcaagaatcaccaaggttgaagaagatgtttcttatattcattcaagctttgatctaccaccgccaccgccaccatcatcttag

SEQ ID NO: 48159 - DNA, 384 bp, Glycine max
  Peptide Sequence Number=SeqID_139844
atgcaatctcagggacttgcagtgcctcctgagcctctggttggtccctctggtcctcgagtgagcacaaaggggagttgtgttgatccctcaggaaacgatcctgagatgggtgactctgacaggtgcggcttgtacatagaaacagatcctgcctgcctggttgccatggggagagtttatgagggatccactattgttcataacactcctttgttgcctggccaagtaaaggtgagtgtggaggaggttacagatgcaaatgctctagttcctgtacccactgatgaggtttccttagtgggtgatgcaatcctaccccacaagggcattggatataagactccaagtagattgggccagagatccaagggaaggccctag

SEQ ID NO: 48160 - DNA, 78 bp, Glycine max
  Peptide Sequence Number=SeqID_139845
atgaagatagatcaggcctacggattaggaatcttccgttcaggaaacagagaatttgaagaggccagaatcttgaag

SEQ ID NO: 48161 - DNA, 690 bp, Glycine max
  Peptide Sequence Number=SeqID_139846
atgtggtcatctgcgccctttccggagatgtcagcattttccgatggagacttttcaagtctcacaagttatctagaactacaggcggcgggcccgatgatacgcggagataccttacggttatccgcacccttttgtcatccagaggcggcgggcccgatgacaagcagagacaaaatttggtcattctgcacccttgtgtcatccagaggcggcgggcccgatgatacgcggagataccttacggttatccgcacccttgtgtcatccagaggcggcgggcccgatgatacgcgaagataccttacggttatccgcacccttgtgtcatccagaggcggcgggcccgatgatacgcgaggataccttacggttatccgcacccttgtgtcatccagaggcggcgggcccgatgatacgcggagataccttacggttatccgcacccttgtgtcatccagaggcggcgggcccgatgatacgcggagataccttacggttatccgcacccttgtgtcatccagaggcggcgggcccgatgatacgcggagataccttacggttatccgcacccttgtgtcatccaaaggcggcgggcccaatgatacgcggaaatacccgagttgttatccgtataaacattcttttgctatctgtaagacagaacgcttgatagcatgcagaggctga

SEQ ID NO: 48162 - DNA, 48 bp, Glycine max
  Peptide Sequence Number=SeqID_139847
gtgggaaggattttcttcgatgtacaacctgcgtttgtgatcgaggcc

SEQ ID NO: 48163 - DNA, 216 bp, Glycine max
  Peptide Sequence Number=SeqID_139848
gtcgcttggggactggatgtaggcacgggttgttgccgaaccagtataaaaactcttgtgatgcaagctccattggagcttgtaggcctaggatcttcttcatcaatggattcctttgcttcttggaagatgaatggcagcggaatggagaaggaagagagagaggagacgccacttcaaggagaagatgagtctagaagaagctcaccaccatag

SEQ ID NO: 48164 - DNA, 389 bp, Glycine max
  Peptide Sequence Number=SeqID_139849
cttcatcctcaattcaagaaggaagtgataaagaagatttaaatgaaatagacgaagatgatgatttcagtttctttgtaaagaggttcaacaaatttctaagaaacaaaggaaatcaaagaagatcaaatttcaaatcaaagaaaagagcagaagattcatcctctcttccaaaatgttatgaatgcaatcaaccaggacatctgagagttgattgcccaagtttcaagaaaagaatagagaaatctgaaatgaaaactttcaatgataagaaagcaaagaaggcctacattacttgggaagacaatgatacagactcatatgaagattcagaaaatgaagttgtaaacctgattctaatggccaagaattatgaaagcgatgaagag

SEQ ID NO: 48165 - DNA, 935 bp, Glycine max
  Peptide Sequence Number=SeqID_139850
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggatatttgggcctctttgaggctttcgttggaaacgggatttcttcacataatgctagacagaagaattctcagtaacttcttttgggatgtatgtattcaaatcagagagttgaaccttcctttagacagagcggattggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccacgaagatacttaacagggaa

SEQ ID NO: 48166 - DNA, 495 bp, Glycine max
  Peptide Sequence Number=SeqID_139851
atgaccatgattacgccaagctcgaaattaaccctcactaaagggaacaaaagctggtaccgggccccccctcgagaaatcccgtttccaacgaaagcctcaaagaggcccaaatatccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 48167 - DNA, 486 bp, Glycine max
  Peptide Sequence Number=SeqID_139852
atggatatggaggacgttgctattttagtaacattctgcccgacgaccacaatgccaaatctcccctgcagatgtatcgggatcgcgcccaccaagatgcccagtgggcctgaagaagtccaacaggaccttggggtttccagctctggttacgggcctctgtcagtcctacagggtgcccgttcccccagtgaggaatcgcacccacaaagacacccagtggacccggagaagtccaacagggccctagggtttccagctctggttacgggcctctgtagtcctacagggtgcccgttccccccggcaaggtcacgtcatcatagttctacggagtacctgtcacctccagcaagggcatcaggccccctactaatcgagctttcatcaagaagtactacactcccaggcaggcgcaaggcgaaacaccacaacagcctggggatggtcggtagcgggcaacagacgcactgccaccacctctag

SEQ ID NO: 48168 - DNA, 779 bp, Glycine max
  Peptide Sequence Number=SeqID_139853
atgctgaaagccctgaatgaccagagcgctgacaattactacgatctgctggaaaacgccctgatcccggtggcgaagcaatttgataacgctatgcaggcgtttcagaaatggagtgaagcgcgaggccaggcagaagtcagtgccgtgcaggcgagtaaaacccgcgtactgatcctgattatcgtcgcagcgctgctgacggcaggcattatcgtgctggcctggctggtgttgcgccatatgctgctcaagccgctctcggcgtcaatcgctcagctggagaacgtggcggcgggtgatttaacccatacgctaaatgcgcccgcgagccaggaatttaaccgtctcaatgccgccatagaggagatgcgccagtcgctgatgaactcggtgctgcgggtacgtgatgccagcgcgcaaattgacaccggcagccgcgaactgacggcggggaaccgggatcttgccgagcgcactgaatccaccgccacgtcgctggaacagacggccgccagcatggaagagatcaccgccacggtgaaactcaacgccgataacgccgagcaggcgcaccagctggcgaaatcggtgtctgatactgcagatcatggcagcgaaatggtctgctatgtgattgagaaaatgcgggatatctccggcagctcggcgcgtatcgccgacattctgagcgtgattgacggcattgccttccagaccaatattctggcgcttaacgcctccgtggaagcggcgcgcgcgggcgagcaggggcgcgg

SEQ ID NO: 48169 - DNA, 999 bp, Glycine max
  Peptide Sequence Number=SeqID_139854
acctgtgggaagatttgggacctagctatggtagaattctccgtggaagcaattgcatcccttactcagtattatgaccagcccctaaggtgcttcacttttggggacttccagctagtaccaactgtggaagagtttgaagaaatcctggtatgtctactgggaggaagaaagccacatctcttttcggtgttctatccctccatggcaagagtagccaaggcgaaggcattggcaaatcaaggtgaatgggcttcgtttattgatgtcttggcactgttgatatttggagtcatcctctttccaaatgtggaggggttagtggacctagcagtgattgatgctttccttgcttatcaccatagcaaggaaagcctggtcattgctattttcgtcgatgtctatgacacgcccacttgtcctctgcaaggtcaccgcttatgtgccaaaaaaggaaaggcaaactgggagcaactcttggctagtgtggtaggggcatccattaattggttcccccgttggaaggaaggaagaacaagggttttgtcctcatgcgaaggatttccaaatgtccccttaatgggaacaatgggttgtattaattataatcccatcctcgccataagacagcttggctaccccatgagaggagtgccattggaggaaagcatcacgcctttcatcactcggggatttagtgaccccaatgcgagagtacttcaaggagtccgcaaggcatggggtgcagtgcaaaggaaagataaagagcttaggggaagtagtaatgggatcatcgacggctatcataagtggctgagagctgcaagagaggaagtggttgaaactccagaggagagtcaggaagtgcaaaccctaaaggtggatcttgaaagagcccaagcagtaaaaaagaagttcaagtcaacggccatcaaagttcggaaaaagtacgatgaactaagggatgtcaatatggccaccaccgaagccttggaatga

SEQ ID NO: 48170 - DNA, 237 bp, Glycine max
  Peptide Sequence Number=SeqID_139855
atgcggatttttgagggtcacattgagctgcttacagccaattgtcgcacgatctgtccattaggaagcttcaacatgaagcaattagctcgcctgggcgagcatgttgcttctgaactaagccaccagctcgcttgggcaagctgggtagcaagctcctcccttattttggctatgaaagggcgtgggaggctgaggggaaggggtcagcacccttggtattcagatttcacttaa

SEQ ID NO: 48171 - DNA, 812 bp, Glycine max
  Peptide Sequence Number=SeqID_139856
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgaaatatttcaaccctaaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48172 - DNA, 331 bp, Glycine max
  Peptide Sequence Number=SeqID_139857
atgccgctcaacgccctggcccatcagctctgtgacgaccagcccggtgcccatctctttcagcatctgctcaaagctcaggccctgtccggcgatgcgccagttatggatgccgcctgcatgcccggtgcttttcagccccagcttgcgcgcggagtagttggtcagcaaccactgggtcagcacgccgtctttgacgatatcacgacgttcggtacgcacgccttcgctgtcgaacggtgtggaggcgaggcctttcagcaggtgcggatgctcttcgatggtcagccagtccggcaggatctgcttgcccagcgagtcgagcaggaag

SEQ ID NO: 48173 - DNA, 336 bp, Glycine max
  Peptide Sequence Number=SeqID_139858
atgctaggctttcctggaatcgctttcaggcaaataaggaagcggaagagtgggggattggcttaccgaagcaattcttatcttcaagagcagatcgactcacaccgccatcaagagataccaagacctaaaccttatccttatctgggtagccttcggcttcctcaggggctactacttcctgggaaacctttggctaggatcctagcagcaacttcgctcctaaccgtcaacaccgtctcagtagttagaaaaaggaaaggaagcgctgggaagagtttagcagcaggaatatctagggctaactcgggatttcccatcagtcggagcagctaa

SEQ ID NO: 48174 - DNA, 189 bp, Glycine max
  Peptide Sequence Number=SeqID_139859
tttgtgaagaatatttttgaatcaagattcattgctgacaaagccattgcagaaattgaggcaaagtgtggccaaaaaattgaagaatgcaaagaagaacaaaggcagcagttgatgcgcattgaagatgaacacacgttgctcgtaagcatagaaaaagtcttgaatttgaaattattggctgcttag

SEQ ID NO: 48175 - DNA, 393 bp, Glycine max
  Peptide Sequence Number=SeqID_139860
atgggtgatcaagaggagacacaggaacaaatgaaagctgacatgtcggctctgaaagaacaaatggcttccatgatggaggccatgttaggaatgaggcaactcatggagaaaaatgtggccactgctgccgccgttagtttggctgccgaagcagacccaactcttctagctaccgcgcaccatcctcccccaaacgcagtaggacgagaaaagagtacacaggggcacaacaacaacccccatttgggatacaatcgggtggcttacccttatggattgccgcctaattacacgccgccagtcatgcacgatgacgtgggtcatgtctcttcccccatccttgaaaggaagcctcctcaacagccccacgaggcccatgaagatcattaa

SEQ ID NO: 48176 - DNA, 393 bp, Glycine max
  Peptide Sequence Number=SeqID_139861
atggtgaaggagtgcattttcttggggcacatgttatcccatgttagcacaaaggttgatcttgccaaggtggaggttattgcaaatttgccactgccaaattgtgtgagagttgtgaggagcctttttgggcatgctagattctctatgaggcattacttggttttgtctaagagacaccttggtatgtgtcgcaacctacccttcggtgggaaggcgaggcgaaaagctaaaggtgcatcttcgaaaaagaaaacgcatgggagtcgccaccaacgtttattcgaggaaaacgttagaaaaaccaaaaagaggtctatgaattttgaaaataagggttcaggagttatttacgcacggggaaggtgcgatgaggaattcaaacccacgtag

SEQ ID NO: 48177 - DNA, 537 bp, Glycine max
  Peptide Sequence Number=SeqID_139862
atggctccgaggaagcttgcctcgaagaggtccaggaaggacaaggcagctgaaggaactagttccgctccggagtatgatagtcaccgctttaggagtgctgtacaccagcagcgcttcgaggccatcaagggatggtcgtttctccgggagcgacgcgtccagctcagggacgacgagtatactgatttccaggaggaaatagggcgccggcggtgggcatcactggttactcccatggccaagtttgatccagaaataatccttgagttttatgccaatgcttggccaacagaggagggcgtgcgtgacatgagatcctgggtaaggggtcagtggatcccgtttgatgccgacgctatcggccaactcctaggatatccgttggtgttggaagagggccaggaatgtgagtatggccagaggaggaaccggtctgacggggaggcgagtgcgaatcatgcgcaccaacatgaccaccctgacccagatatggatgacgttgctcctcagcaacatcctgcccaccgatcataa

SEQ ID NO: 48178 - DNA, 268 bp, Glycine max
  Peptide Sequence Number=SeqID_139863
gttgcaggatgtaccatttgtgggggagctcatgaatctaaatgttgtatccctattgaagaacaacccactcatgaagtcaattacatggaaaatcaacccagaaacaattttaatgaaggaggattttctggattccaacatggctagcaatacaatcaacaacaaggacaatggaggaaccaccctggaaatcaattcaatagagatcaaggtggaccatccgcaaggccacaacaacaaggacctagtctttatgattgcataa

SEQ ID NO: 48179 - DNA, 603 bp, Glycine max
  Peptide Sequence Number=SeqID_139864
atggaagaactggcagcctttaaccaactccagatttggctagtgctgctcattggcgtattcggttttgccggcatgtttactgtgtttagttacatggcaccagtgctggtcaatgtcaccaaggtgtctgaatcatatatgccctggctggttgtcgcctttggcataggctccatcatcggcatgttatcaggtggcaaaattgcagatgccatgaaattcaaaggcgcatgcctgctgattgtgtggtcgatatttgtgctagcgatgatcccattcatttccgacacactgccaggcattattatcgcagcagtcgcagttggcaccatgatggcgctgccagtcacattgcaaacgcatttgatggaaattgctggagatgcacaagtattatccgctgccgccattcaagccgctttaaataccgcgaatgctctaggcccctggttgggagggttggcaattgaccatggattaggttacaacgtatttggtacgattggtgcggctacttcagtgcttggattattgctttgggtgatctcttacaaattaactcaagcaaacatacaacgtattagaaaatataagccttag

SEQ ID NO: 48180 - DNA, 399 bp, Glycine max
  Peptide Sequence Number=SeqID_139865
atgggcactattagcaaaatagtcatggataatcattcatggtgttatccagcttgcattcaatgtcataggaaaaatgacatccaaacaggaccattcacatgcggatgtggcaaggataatgatcagcctgttatgaggtatagagttgaagtaatggatggtgatcttgatttgaatgcttcccctcaagcacttgacaagctgttgggttatgtgcttgcttttaaggtcaggattcaatcaaaattcaagaatgtcattgttcttagatactcaaatgaactagatttgatcaatgatgtgctcgagatgctggctgatagtgagacatgctccaaaatagatgcttcgaatgttgattgcaataatgctacccatcctgaatgtgtaacttaa

SEQ ID NO: 48181 - DNA, 1038 bp, Glycine max
  Peptide Sequence Number=SeqID_139866
atggccccgaggaaacttgcctcaaagagatccaggaaggataagacgaccaaaggaactagttctgctcccgagtatgatagtcaccgttttaggagcgttgaacaccagcagcgcttcgaggccatcaagggatggtcatttctccgggagcgacgcgtccagctcagggacgatgagtacaccgatttccaggaagaaataggtcgccggcggtgggcatcattggttacccccatggccaagtttgatccagacatagtccttgaattttatgccaatgcttggccaacagaggagggcgtgcgtgatatgaggtcctgggtgaggggtcagtggatcccgttcgatgcaaatgctatgggccagctcttgggatatcctttagtgttggaagagggccaggagtgtgagtatggccagaggaggaaccggtctgatgggttcgatgaggaggccattgcccagttgctatgtataccagggcaagattttgcccggactgctgccgggagacgggtgcggatcatgcgcaccaacatgaccaccctgactcagatatcgatgactttgctgctcagcaacatcctgcccagcgatcataattccgacctccccctgccgaagtgtcagctggtgtacgccatcctgacacggatgagcattcatgtggctcagttaatcgctgatgccatctatacatttgcaggtatggcgcctaccaggcaccctctggacccggataagtccaacagggccctgggatttcccgccttgatcacaggactctgccagtcgttcggcgtccccgtcacacctagcaaggtgattcggtcgcccatcacccgagcttttattaagaagtactgcacgcagagacaggtccagggtgatgcaccacaggccgcggacgcgccgccaccacatcaggctggtccagccggattgtttgatacggagcagtatttgcggcatttggttcgccagcgggcggccaaccaccgggcacatgtacagacccatgattgtctttattag

SEQ ID NO: 48182 - DNA, 597 bp, Glycine max
  Peptide Sequence Number=SeqID_139867
atgactaacgctgcggctaggaaagaggaagagcgtgtagagattgaaatacatcaagaaagcattcgtcaggttacctccatccatcaccaattgactaatgaagaggaaaagcctgaagtctccagtactccagaatatctgtacttggccactattggctatgttggagggaaagataaaggtagattggaactcagcatggaagatcaaaagatttcttttgacctctttgaggccatgaaacactcagatatgggtgatgcctgtttcaaagaaaaagaggtggagcaggaaatagcattgttagcctcaaccatggtactacagtctcctatggaaaaagaacctggttgtgggagagattgcttagcttgtgatgaagagcttgatgattcaaaagatagttgtgttgaccaggtggtttttgaagaattggaaaaactgagaccaatagaaaagcccaaagcaaaattaaagacccttccgacacatttaaagtatgtattcttggaagaagatgagaccaaacttgttataattagcaactctttgaagaaagaagaagaagatcaactggtgcagattctaaaatga

SEQ ID NO: 48183 - DNA, 384 bp, Glycine max
  Peptide Sequence Number=SeqID_139868
atggtgaaagttggaacctcttacgtgccgatcaacgtctcattttcgccaaaagttggcccagggcttcccggtgctccagtggctatcatgtttctatcagctgtcccttcctgttcagctactgacggggtggtgccgtcacaattcggcacaaagcataccagccggacatcagcgggcaagtgtagcggccaaccgggcgatcggtgcgggctttcgctattgggcgcaaagggcggagtgtatactggcgttactatgttggccgtaacgcaggaatatgtgaatacgactcactatatggcttcctcgctcactgactcctacgctcggtctcgagcggcagcggaaatggcttacaacggggcggaattcggataa

SEQ ID NO: 48184 - DNA, 672 bp, Glycine max
  Peptide Sequence Number=SeqID_139869
atggtggcaaaaaaggttgcaggttatgttatatgtggtggagcacatgattctggctgctgcattcccacagaagatagaacacatgaagtgaactacatggggaaccagccaagaccaacctttaatgtaggtggatattctggatttcaacatggccaacaatataatccgcaacagggacagtggagaactcaccctggtaatcagttcaataaagaccagggtgggccatctaacaggccacaacaacaagggcctagtctttatgaaaaaatgacgaagctggaagagactcttgctcagttcatgcaagtatccatgtccaatcaaaagagcattgagtcagccatcaagaatctagaagtccaggtgggacaattggcaaagcaactagtagaccgatcgtcaagcagctttggagccaacatagagaagaatcctaaggaggagtgcaaggctgttatgactagaagcaaaatggtgagcatgaatgaaggtgagaagaggataggtgaagaaaaacaacaactggtgactgaaccagaaattgacctagtggtagaacctttgagtaagattggggaagaagtggaagcagaagatgatcagcagaaggagataccaataattgtgagtgaaaaagaaataagtgagaaggaaaagaaataa

SEQ ID NO: 48185 - DNA, 1112 bp, Glycine max
  Peptide Sequence Number=SeqID_139870
tttcacaccttttttgccaagaggtgaggcatgcttgcccgctagaaagccaccgttcgtgcacagagaaaggaggggcaaattgggaccaactcttagcaagcaaagaaggagcatctgtcaactggttccctcgatggaaggaaggaagaaccggagttcttatttcatgtggaggatttccaaatgttcccttgatggggacgaggggttgcatcagctacaatcccgttcttgctataagacaacttggctaccctatgagaagggcaccactagaggatgagctcgcacctgaggtgttgcaaaagaaggacaaggaactcaggggcagtaacaatgggcccatcgatggctatcgtaagtggttaaaagcccacgtgcaaggattggattggctcccaagtttgagaaccgctaaaagagaggaagttgaggcactggaggaagacgaagaagtgcaggcccttagggcggaactcgagcatgcccaaacagttaaagaaaggttcaaatcaacagctctgaaaatccgaaaagagaataccaaactgagagatgtaaatgtggctaccaccaaagccttggaacgagaaaccaagagggctcgtagggaagaacacggccggaacaagttccgaggggctctgtggggcagtaacagcgagcttaagctccggagagaggaaagggaccaatcgcaagtagacagtttgatcttgaaggatgagttgaaggcttgctcgaggtccaagagaagtttgtctcagcggttatgcgagacagagaccaacatgttagccatcatcagcaagtaccaagaagaactaaatctagccacggcccccgagcatagagtggcggacgagtatgcccaagtgtacacggaaaaggaggctagaggaagggtgatcgactcactacatcaagaggcaacgatgtggatggaccgattcgctcttaccttgaacgggaatcaagagcttccccgattgctagccaaagccaaagcaatggtggacacctactctacccccgaggagatccacggacttctcagctattgtcagcatatgatagacttaatggcccatataattagaaaccactag

SEQ ID NO: 48186 - DNA, 165 bp, Glycine max
  Peptide Sequence Number=SeqID_139871
atggctgagtggttgatagccccggtcttgaaaaccggatctcatgtctcaattagaggagtccttatggaaagaactggttcaaaatctcgatcaattcctttttacgaaatcctgcggcaagatctgggggaggggctttcccgcgtttttgatctgacataa

SEQ ID NO: 48187 - DNA, 110 bp, Glycine max
  Peptide Sequence Number=SeqID_139872
tgtacacctatccacatcacagacaaaagcctatccattgcatcatgacttttgatcgcactgtttcacatcgcttacctagcccacacggattattgacatccgcataa

SEQ ID NO: 48188 - DNA, 372 bp, Glycine max
  Peptide Sequence Number=SeqID_139873
atgccaatctcccctgcagatgtatcagttggtctgtgccgtcatgacataggtaaggatcgcgcccacaagacgcccagtggacccgaagatgtccaacagggccctggggtttccagctctggttacgggcctctgttagtcctacagggtgcccgttcccccaacgaggttgatgaggacatgaccaagagcaaaggcaaggatccacttgaaggacttggaggacctatgacaagggctagagcaaggaaagccaaggaagctcttcaacaagtgctgtccatactatttgaatacaagcccaagtttcaaggaggaaagtccaaggttgtgagttgtatcatggcccaatggaggaggactaaatga

SEQ ID NO: 48189 - DNA, 539 bp, Glycine max
  Peptide Sequence Number=SeqID_139874
atggctacctcaccaaaagaaacttccgcttctggttcacccgctgtacgatcatctccgcaccaggaacaaccggaattcaacatccaacccatacaaataattcctggtcaagcttctgtccctgagaaactggttcccagaagacaacagggagtgaagattgctgaaaaccctagccttgcaacaagtcctagggaagtagacacggagatggacaagaaaatccgcggtattgtgagtagcattctgaaagatgcttctgtgcctgatgctgagaaagatgttccaacatcttccaccccagatgtttctgtgcctgatgtcaataaagatgttccaacatcctccgctccaaatgctgaagccctcccttcacccagtgaagaggaatcaacagaagaagaggatcaagcctcagaggagacccctgcaccaagggcaccagaacctgctccaggtaacctcattgacttggaagaagtcgaatctgatgaagaacccattgccaacaggttggcacctggcattgcaaaaag

SEQ ID NO: 48190 - DNA, 462 bp, Glycine max
  Peptide Sequence Number=SeqID_139875
atgacaccggtaaaccgaaaggcaggaacaggagagcgcacgagggagccgccagggggaaacgcctggggggcggagcctatggaaaaacggctttgccgcggcctctcattccctaccgacatcgaattccgccccgttggggtaaccactgttctgcgctgccgcagtgacgaccgagcgctggcacggtcgcttttctacaacgcttcgactgggaaacaccctggcgttacggccaacatagtaatcgcccgaagaggcccgcaccgatcgcccttcccaacagttggccgcagccttgaatggcgaatgggacgcgccgctgatagcggcgcattaagcgcggcggcaattaagtggtggttacgcgcagcgttggcacccgctacacttgccagcgctgatgtccggctggttgcttgtgtgcgttggacggatcaccaccccgtcagtagctga

SEQ ID NO: 48191 - DNA, 207 bp, Glycine max
  Peptide Sequence Number=SeqID_139876
atgagtaccgcccgggcggggggaggcactcggtcctccggattttcaagggccgccgggggcgcacccggacaccacgcgacgtgcggtgctcttccagccgctggaccctacctccggctgagccgtttccagggaattttaacccgattccctttcggagtacgcgcacagagcgctatcagacgggcttcccccgtcccttag

SEQ ID NO: 48192 - DNA, 153 bp, Glycine max
  Peptide Sequence Number=SeqID_139877
atgaagatgctcttgataccacatgatgtaagctccattggagcctcggaagggagaagaagaagagttgagaggagatgccacttcaaggaaaagatgagtcaagaagaagctcactactataggaagccatggataagagcttggaggtag

SEQ ID NO: 48193 - DNA, 579 bp, Glycine max
  Peptide Sequence Number=SeqID_139878
atggaaatcaaacctggtttgtcagcactcattactggtggtgcctctggaatcggaaatacagtggttgcaacttgtggaggtggggcaaaagccaagcttctgaaagagttgggagttgacagagtcatagactatcatagtgaagatgtaaaaactgttctaagggaagagttccccaaaggtattgacatcatctatgagtctgttggcggtgacatgttaaacttgtgcttgaatgctttggctgtccatggacgactcattgttattggcatgatttctcagtctgatagaagagtgtatgaagctggattagaaattgcatatcaaggagagaagggttggacgccatcaaaataccctggactattggagaagcttttagcaaagagccaaacagtgtctggctttttcctggtgcaatatggtcacttgtggcaagaacatcttgacgggctatttaatctttactctacgggaaagctaaaggttgctgttgatccaaagaaatttataggcctgcattctgctgcagacgctgtagagtatctccattcaggcaaaagtgttgggaag

SEQ ID NO: 48194 - DNA, 1095 bp, Glycine max
  Peptide Sequence Number=SeqID_139879
atgataaggtcctccagcagcttcagtggacaccaaccactggcactcaaatatcttaacatcccaacaaagtcaaactttccattcgtaaatttgactagctattccttccttccatctcttccccttaaagctcataaccatcttccaattccttctcagaaacttccaaaacccttaaactctacaccaccctcatcgaccatggcttcaaccaccacagacgacagcgaagaagtaacctacgacctctcccctgtcctcaaagtctacaaaagcggtcgcatagagaggctagccggcaccgcggttcttcctccgggcctcgaccccgaaaccaacgtggaatcgaaagacatcgtaatctccgaagaacacggaatatcggcgcgacttttcattcccaaaaacacttacacttacccgcagaagctccctctccttttctacacccacggcggcgccttctgcatcgaaaccccgttttctccgaactaccacaacctcctcaacaagtttccaaggctaatgttgtcgctgtctctgtccactaccggagggcatcagagcacccggttcccactggccatgaagactcgtggtgtgcactcaaatgggttgcttctcacgtggcgtcggcgcaacatcgcgagctatttgggaattcgggtcggaacaaaagggttgcttggggtgaagcttaaaggggttgttttggtgcatcctttcttctggggcgaggaaccgtttggtagtgaaacaaacaggcccgatcaagcgaagaagattcacgatttgtggcggtttgcgtgccctagtgagagtggatccgatgacccgatcataaacccgattaaggatccgaagctggggaagcttgcttgtgaaagattgcttctttgtgttgctgagaaggatttggtgagggataggggtttgtactataaagagttgcttgagaagaatgggtggtttggagttgctgaagtggtggagacgaaggatgaggaccatgtttttcatttgttcaaaccgaactgtgagaatgctctagttttgatcgaccagattgtttcctttctcaaacaggattga

SEQ ID NO: 48195 - DNA, 729 bp, Glycine max
  Peptide Sequence Number=SeqID_139880
atgttgcacaacataagcagtattgggtctcgtgaaggtgatatattgaagagcccctgcaaggcttcaataatgagatggattggcatatggtgtgttggaattagcactgagctttggtttcctgtcaaccagagtgaaggtgcaggctctgggatgggtaagggttattgttgtggcgattgtaggctaggtgtggatgggtcggatggaggtgtaggttgggtagcaagtttcgggttgggcaagacctgctgggctggttgttttgggcctaacgaagaggttgaatggtggaccacgagcttgattagtggtgatggtggtggtgatgggataaaggtcgccccgactctcacatctcatgagatgaccttgctggtgccccgatggatgagtagtatgagcaaggtggaagagcccgaggcatccatgtccccttctggtgccccaattgccgctggtcggattgctgctgtcagccattattgcaaccaccaccatctgacttctggcttagcgccagtaatgcttgctcagcctggaggttcaagcgatgcgcttagcgaatttattctcgctgagcacatcattgacaactcatatacttccaagatcttctacgcgcttagccatgaactgctgcgctcagcggatggctcgctaagccagagaattggcttaacgagcggctcaaaatcagcacttccaccaaacttgcctaattag

SEQ ID NO: 48196 - DNA, 357 bp, Glycine max
  Peptide Sequence Number=SeqID_139881
atgtcgtcgaagaacatcgcagtgaatttgcgcaagaatggttggagaagggagttcattgttccctggaaggataaccatacggtcgaacgttcactggggaggctgaaggatggagggcaatacggtggtctatttgtcagggtggtggatggtggcggggaaaaactagcggtagtcgaacacaaagccgttgccaaccataacgcgcaaaggagatgtctcttgagtggggaggctggagagggcattaaggctgatgtgggaaaggtaggggttggtttgagttcaaatttggggcttaagggttctggtggagaggaaataggcgagggatctgggtcaagttggcaataa

SEQ ID NO: 48197 - DNA, 201 bp, Glycine max
  Peptide Sequence Number=SeqID_139882
atgaagaaactgagaaaaagtggtcaggcgctctccctcctaaatgatgaccggtgtctccaagaaggcattcaactttggggcgtcggtgccactgcctccactccaactcctcaagaaactcattgtactggctgtaggctcctcaagaatgttccggaggtgaacgttgtcctggtagcgatgctaggcgacctttga

SEQ ID NO: 48198 - DNA, 915 bp, Glycine max
  Peptide Sequence Number=SeqID_139883
atggaggtggaagtgatggttccaccggtggacttcaacttcgacagcaactgctcctcccccttcatcaccgccccttcaagcccccaattctttgctgcctccaacaaaccaaacttcttcttcttcagcgcccccaccagccccacacgtgccacctcctcctccttccatgaagaagaacaagatttccagttcaatttcagcggccacctcgaccgcccttctctctccgccgctgagctctttgacggcggaaaaatccgtcctttgaagccgccgccgctgcttcagtctccggtaacatccccaaggtcgaaactttctccccgcaacaagaagaaagacttggacccttttgcattggcaatgaaagaaactctcagaagtgaagaaaaaacacgagggagggaaagggtttcggtttcgttctctggtcgtaaaggaagcaggtcgttgtcccctctgagaatctccgtcgtgtgcgactccgaagacaaaaacgtttcttcctcgacaagcaacatcaacaactcaaaagcctcgtttttgtcttcgattcccttcacgagaaaatggaggttcaaggattttctcctcttccgaagcgcctctgaaggaagagcaaccgacaaggaccctctgaggagaaaatacgcagttctgtcgaagaacaacgaggatgttcgggactgcagcttccggtccaccgagagttcttccggttcgatctcgaagcggcacgggccggtctcggcccacgagctgcattacacgctgaaccgggccgcgtcggaagagatgaagaagaagactttcttgccttacaagcagggcttgttgggatgcttgggctttaaccctggtatgcatcatcatttttctaagagggttgggtctttgacgcgttcttaa

SEQ ID NO: 48199 - DNA, 357 bp, Glycine max
  Peptide Sequence Number=SeqID_139884
atggatgggtctattaccgtccaacctttggattttgctcttcataagaggattgtggaagggccactcaagcccagtctatggtctcgctctagtttagctctagggagtttctacgtgcaaccagcattattgctggggcacccagcaaacagtgaagtgatttttttcggaaactttccggaaaacttctttccggaaattatccggaagaaccttcttccggaagaagaatttgtgatttccggaagtgctcaggaactacttccgggagaacgtcatccggaatgttttcagaagaagcttcttccgaaagatttccattttcttccggaagaaggttcttccggaagttag

SEQ ID NO: 48200 - DNA, 190 bp, Glycine max
  Peptide Sequence Number=SeqID_139885
atgaatggccatgtacctggaaatttactagttcttcatgggaaaaactggtccaaatggagtgtgcagatgagagccctctttggttttcaggatgtctatgaggtggttcaaaatgggattgaagagcctacagccagcacaccagatgctcaaagacaagtttggaaggatttgaagaagaaagact

SEQ ID NO: 48201 - DNA, 189 bp, Glycine max
  Peptide Sequence Number=SeqID_139886
atgaggcgtttgtctcttcctgcgttaagcgtgcctagctcgctcagtggatattcactaactcacgctaagcgtgaaaatggcgctaagcgagccttcgagaacaggaagccctttttaaggctgaagttggaaaaatcaagaaaaaggctaagtttgacgagacatccgagaacgaggtttaattag

SEQ ID NO: 48202 - DNA, 1029 bp, Glycine max
  Peptide Sequence Number=SeqID_139887
atgatgtgtctatttccatcaggagcacatacaattggttatgctcgatgcttgaccttcaaaaggagacttttcgactctcaaggctctggcagacctgatcccatgattgatttttcacttttcttaagattgcaaaataggcgtccaaataatgacgcttcaaacagcaatctagctcctctggatgctgcaactattttgacgttcgacagtgtgtattatagaaatctcttgagcgaaacagggcttctagaatctgaccaagcactaattcgggattcaaggactgcttctatggcttatttttacagcaccgaccaatcttcgttatataatgattttgctgcatccatggtgaagcttagtaatcaaaacctcaacaatataattgaggaagccaatgtaagttacttggagcataaatgctatcctgctgtatattatgtcaagtccatcatctttgtaggtgttggcggttcgtcatggagcgcgcctttgaagttctggaagattccttcggagtctgctagctccatggcggcatgcttgggcggtgcgtgtgcgagtcatggccgtgcgcaaaggcgcgttggtcgccgatctccctcaatcgaacactcagaggatgctgttgctttggagctagcgtcagaggagcggcgatctcggcacttggttgtgacgtcgttgccgaagccagagctgcaatttcctccgcggcatccggtgcggaggggattggaggttccggcggcgatggattgttttcgagctcttccgccattgtggttacagtggttgtggtggtgtgtgctggataagggagatggagagttttctggtgaggtagggtgcaatttgaagcttactttgaatttgaagctttttctgaagaggaagaggttgagcttaggggagagaggagaatttgggtttggttttgatttgaaatttaggactaattctgtgattgttgaagagagaggtatcagaaaacactatttggtagaagaagtggacaagtga

SEQ ID NO: 48203 - DNA, 306 bp, Glycine max
  Peptide Sequence Number=SeqID_139888
atggcacaggcccaacctgaagagaggatccatgaaaacccagaaaaagaaacccaagaaacagggaactctagcttcaaatttaatgcccaagcacctgaatttgttccaagatcacagatccagatgccagtttcaggttatttctacccttacttccaaattcttggtgggtctggtgagtctgattggttctttgttggggaccaagacccttcttgtttgatccccactgccaatgctgcgctacccaattcctccaagaatattcttacccctgatcttcaacaaaaaatcgtcaaacag

SEQ ID NO: 48204 - DNA, 615 bp, Glycine max
  Peptide Sequence Number=SeqID_139889
atgcagattatggatagaaccagaggattggattggactttaggcaaggttataggaagaaccttagggagagaagttagtggtgatgcagatgaatcccctcggcggcgaagacccacaacatctgcacataggcaacgggaagttgcatcttttgttgaggatgttgagcatgtggatcatgtagttgacgaggtccataaacagcttgaaaaggcaactgctgaagatgtagatgctgatgcccaggattttccagacaggccccacgatacatcaattttgatggactatattcatcatgtggcagtcacagtttggaatagagaggaacgtcctgagttgaagttgtcatcccatggaaggaaggaagagaaatttggtagacctgtttcagatattgaaggcttagtggctgccacgggattaagtcctctaattgcatgttccttggacactagtaacaggggacttatatctgcttttgcagagagctttaaggctcttcatgtggacgaagtcgtggacctgttagttgacttgcttgaatttagttcagaagaagcaagagatgagacattgcaatgccatgaggcacatgttcggctatcctag

SEQ ID NO: 48205 - DNA, 348 bp, Glycine max
  Peptide Sequence Number=SeqID_139890
atgactttcctcgtgccttgtcatgttgttgtatatcgatccaaagcaatcgccgtgacatgcaagttgaagatcaacggcacaattgtgatagctaatccaataaatgaaggaggaacacaacaaattggtaaacagttcctaaagtctgacacgtgtaacatcatttattggagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 48206 - DNA, 186 bp, Glycine max
  Peptide Sequence Number=SeqID_139891
atggtgggggagacaatggatatggtgaactggaggaaaaagaaaagggaaatggggaggaagaagaggggagaggaaaagaagaggaacaagttgttgaaagcaatgcagggaagcaggctaaggagtctcaatattaaatcagaaaattcatccacaattgttgagttgagaccacctgaatga

SEQ ID NO: 48207 - DNA, 513 bp, Glycine max
  Peptide Sequence Number=SeqID_139892
atgggaaatcctgtcatggctcctcctatgccgatgtctgctcatcttgggctggtgcaagctcgccatgaggtgaggagggagcatcctaggctggctgggcctctggagtggcctcatgaggtacctccagttgtaactgaggctcctaggctgcgaaagcctcacctccccccaaaggagaaggctggactcctggccaggccacttgagaatggtggtgctaaagtagaaggagctggagttggagaaggagtaggtgcagaggaagcaggagcaggggtagcagaggaagatagaccctcagatcctcgagcccgtgccttgcgggtccctagaaatacgatcgtgggatcgtccaagttccagcagttcttctttatgtatgccaaattaatagcagggtcgagggacttgaaggtcagagaatctgagactactcctcggcccacgcaaagtgtagaaatcaaggctgggaagccaagccgcaaggagttggactgggccatctga

SEQ ID NO: 48208 - DNA, 279 bp, Glycine max
  Peptide Sequence Number=SeqID_139893
atgtcccatgttttaggtgaaaagatgaagaagaagaaggttgcagcaactggtgtctcgctaagcaaggcatatgcgcttagcgagcaacattcgctaagcgaggcactcagctcgcttagcgagttaggagaatctggaagagaatctgctaagcatgcacacgcccagcgcgccattagctcgcctagcgagtcatttgtctctcctggtgctaagcgcgcctggctcgctaagtcaaaatttactaactctcgcttagcgcgaaaatggcgctaa

SEQ ID NO: 48209 - DNA, 771 bp, Glycine max
  Peptide Sequence Number=SeqID_139894
atgttgacaaagggcagagctccttcacgtattactaaggaaatgcaagtaaagattggaaaatgctcagagtcaatgtggaagctaacatattatgctgcagttgaagcatttgttcttaaaattacctaccatgaaccctggttcactaatacgaagttatacttcaatgactggccaaatcatgagttgaagagtcccctagtgttgtactacatgtgccagtgtgggttctacatatatagcattgctgctattctcacatgggagactcgaaggaaggatttttcagtgatgtttactcaccatgtaattactgttttactgattgggatttcatatctaacaagtttttttagggttggctccataatcctcgcccttcatgatgcaagtgacgtattcatggaagctgccaaggttttcaagtattctggaagggagtttggtgcaagtgtgtgttttggattctttgctgtttcgtggctcatactgcggctaattttctttccattttgggttattaaagcaacgagcattgatcttcagcaagtcttaagcctgtcagagggttttcatatgtttctttactatgtttttaatacaatgctcataatgctgctcatcttccatatatattggtggaagctcatttgtgcgatgatcttgaggcagctgaaaaataggggaaaagttggcgaggatataagatcaggaaccaccgctgttaggatatgttccactgagtttattcatactatcttgcactga

SEQ ID NO: 48210 - DNA, 8337 bp, Glycine max
  Peptide Sequence Number=SeqID_139895
atgctgagggatttcaagctcccacgccgaaacgctagcaaacacgaagagccggagaatgtagatccttatgattcatccaccacaattcagaggcacgcggaaggttctagacatccgttgaatacaattcaagagcctgatgcgcattgcgaaagcaagattgacaagactccttcgaagagaggaagaggaggagctgagcttcgcacgccggataagcacggcggagggagcatgcttgtgaagcaccggttcgggtggaatcacaagcacgaaggagtttcgtcgttcggtgatgacaggagagcatctggtgttgggaatgtgactcctcgcgtgcctcgcaccgtggggagagcttcttcgagtgttgctgcttgttccgagagcaactccactcagagcactccgaataagagtgtgactaagccacccccgagctcgagtgttcggagcaaggcggatgggggaggcttcagtgctcgtttggggaattatgctgcattgtataaaggggttcccagttcggcttgctccatgcccacggttgttaacacggtcgaagtgcctcactttgatctcaaggaagattcttcattttggattaatcacaatgtacaggttattattcgtgttcgtcctctcaatagcatggagcgatgcacacaagggtataacagatgcctgaagcaagaaggctctcagagcattacttggattgggcaaccagagaaccggttcacctttgaccatgttgcatgtgaaaccatagaccaggaaatgattttcagattggctggtcttccaatggtagagaactgcctttcaggatataatagctgtatgtttgcgtatggacagacaggaagtgggaaaacatatacaatgctcggtgacattgaagatttagatgtgatgcctagtcctcatcgtggaatgacaccgcgtatatttgagtttttgtttgccaggatccaagctgaagaggaaagccgaagagatgagaacttaaaatacaactgcaagtgttccttcttggagatttacaatgaacaaattacagatctacttgatccctcctctactaatttgctactgcgtgaggatgtcaagaagggtgtttatgttgaaaatttatccgagttcgaggttcaaagtgtgagtgacataataaggcttctaattcagggttctgcaaatagaaaagttgcagcaacaaatatgaatagagagagcagtaggtcccatagtgtttttacatgtgtaattgagagcacatgggaaaaggattctacaactaattatcgttttgcaaggttaaacctggttgatctagctggctcagaaagtcatgttattatgatactagtggatgtggcaaatgggaagcagaggcatgtaccttacagagactccagactaacgtttcttcttcaggactctcttggcggaaactcgaaaacaatgatcattgccaatgtcagcccttctatctgctgtgctgctgaaacattgaacacacttaaatttgctcagagagcaaaacttattcaaaataatgctgtggtgaatgaagattctactggggatgtaattgctttacagcatcaaattcggcttttgaaggtggaagagctttctaccctcaaacgacggcagaatgtctctaggtctttgtcattttctttgtcatctatcagagatataaaacaatcactagaactagaagactgttgcctagaaaatgcaaccgacgtggttgatcaacatgaagaaaacatgcctgattatgaatccaagggcatcagaatgtcccacaaacagcttctatgggaggtgagccttagtgcaatgttaaaatcattggagacaactcttgccggtgctttgagaagggaacagattgcagaaatttctattaagcaactagaagctgaaattgaacaattaaactgtttggttcgtcaaagagaggaggacactaggagttgcaaaatgatgcttaggtttcgtgatgacaaaattcatagattggagtcccgacttgctggttccattcctatggacacatttttgcaggaagagaataaagcactttctgatgagattcgaatacttcagagcaaacttgatcgaaatcctgaagtcacccggtttgctgtagagaatatcaggcttctagaccaacttagaagatatcaagagttttatgaagaaggggagagagagattctattgactgaagtgtcttctttgagggaacagttgcttcaatatcatggaagaaactccatacaggctaattcaaattgtgacattcaacctcaggaagctcagtgctgcaataaagaaaataaccctactgatctagagctaataaacacccttgatgagttagaggaatgcaggcgtaatttaaattattgcttagaggagaatgcaaaactcaatagggaaatagattctcttcactcaatgttaagcagcacaaatgctacaaaggtttctaccaaaggaccattttgtgaagctcaggcagtttcacagatgggggtcaagcttgaaactcatatgttacaacacacagatgatattttaaatttgcagttggaattggatataataaaggtcattctgaaggaagagaggtctttccgtggcatattggaggagcaaaaaacatacttaaatcaggattttttgatggcaaaagacaagattgagcagacaagcaaacagttagaagatgcaaaatctatcattgaagctctagaatcacagcaaatattatctatcaaagagatagaagagatgaggaacaagaacagccattatatggagcttatggggaagcaagagcatgaaatcatgaccttgaagaaccaacttgcatctaaagagtttagagataatttgctttcaaattatacagagtttgaaaacaagtcccccttacaggcaaaattcagaaggatgcatgaatctcttgaaaaggccaagcaactgaacatgtcataccaaagtgatcgtgcattccagatatccactgaggaagagagggatgaaatccgtcggcaagccgaggctgaaactgttgaggtgattgtctgtatgcaagaagaacttgccctgctccagcatcaagtaaatgatagtcgtttgaaggaaacagaaatgaaagagagtatgctgcatctggaaactgaattgaaggagttgcagaaaaaattgcttactactattgatgataatcaaagtttaagggaggagcttggccagaaagatgtagaactcatatcactggctgaagaatgggagctgttaacctctgagattgaagaggttcttcttgatggatgtgaggcaatagttgatgcctctgaggaacttgggaatataaggaattcatttccacagaaaaggatctggatttctgaacaagttggcatgatagttagaaaaatttctgagaaggaattattgattgatgaacttagaagatgtttggaagatgcaagcaataaaggaagtgatatggagtgtatgctgaagtccttaagaagtgcagcattagtcattaccaaatcccaccagagggagtgtgctgaaaaagaaaaagaaattctcctattgacctcacagctgagtgaaaaaacatctagtgaggcacagctgaaggagcatttgataatggcagaagatcatatcagaaaagcatcaaattgtgcaactgtggcttttgtagttgtgaatagattgtcagaagtgaatcttggttaccttgatgatctaaagcataaggatattctgcttagtgaattagcagaaactggtaataggaaggatatccttctcagtgaccaatccacttcatttgttcaagcagagagacagataactgagttgcaggaaagatgtaatgaattatggcagaagctgtctgaggagcaagagcattcttgtgctttggaacaaaagcttgaagatattgaaaagaattccatttcaaagacaagggagcagctagtgacattgcaagatggtgtctcttcaatcagatcatgcatggcttcttttgcagaccattcaggaagtcttgataatagaaattcattggatgcatgcacatcagactatgatgatattggtgaaccaaggcagacaagttctgaaacacatcaaaatagtgattcagatcccctttctgttgaagaacccatagttgacctggctgacttacacttggtcaaaagtggatatgatacgaaagacctgaaatcaaaaaatgttggcaaggatgtgcgtgaaagagatgctactattaggcttttgagaaaagaaatagagtgtgctcttgaaagcttaaaagaagtgcaatatgagatggccagattacatgaagaaaaaaaagagatgtccatgtctgaaaagaagaatcagcaaagcatagagtgcctcacaaatcagatacttttcctgcaagaagctatgaatgactttgaggagcaatctaaagtcaagattgatgtactctgtcacagagttagagacctggagaaacttctgaaggaagctagctcccattggtataaaaggaaagagtcacttgaacttgaagttggagaggcaaagatcattcaagctcagaaagctcaagaggcatcttgtattcttgctaaattcgaagaagcacaagatatgatgagagaagcagatattatgatcaatggattggtgatagctaacgagtcaatgaagattgatatagaaagactcaaagacagagaaacgactttactcaatgagaaggttacattagtcagcaatattgaaagcttacaaactgttgttgatttgaagcataaggagatagaggaccttgttgaatcgagtctagtagaaacaagggatctaattgttacgttggatgatgtcattaaagacatccaattgatgatgacagaaaatttcaagtctttagcttgtgatttagagtgcttgaagtctcaatgtttatattccactaaattgatacagccatggcttgagaagatatggtcagagatagtttttaaagattgtgctatgtctgtgctacatctttgtcacatgggtattttactggaaacagtaacggggatgcatgcagaaaatggtttgctttcacacggcttgtgtgaatcaaactctgtcataagtgatttgaaggaacataattataggacaaagcaagagcttgatatgtgcagaatcttgaaagggaaactgctggctgacatcaagaacagttttgattgcattaataagaaagaagttgaagctggagagatcaccatcaagctaaatactttttctaaaaacatatcagacctacagcttcaagaggagataatgctgctaaggtcgaatgaaatgggatcccaacttgctaaactgatgagggaattggatgtgagtaatacagatattgtgacatcccttttagatcaagagaaactagtgaaacagaaagtagaggccatagaatctgaggctgaattttttatggcagattggtatgccaaagactttgaatcacttatccatgcttctgaattgaaaaatatgtcatgtaatatagctaatatggaggagcattatgtcaactactccttattaattgagcaactgaagaaagaaacaatcttttcccaagtagaaaacgagttagcagaacaaattttgatagataaggaagttgaagtttcccttttagaaagagaagttcagcaggcaaaagtggaaaggaaggacctagtaacagaattaaaccggaatgtcttaaggattacagagatgggtgaagtaaacaaggtccttgaacaaaatattgagtttctaaaggatgttacttgttctaataatgcattgaagggtgaacttatcgaagctaacaaggaaaagaaaagactgctggataggattcttgatctggaagctgattgtgataaattacttggtgatgtcatagagaaggatgtgacttctgaattttctttccaacaggtttattttctcgaacatcaaaaaacagagttaaagaaagtaaactatatgttggaaaattcatcttgcggactgaagaatgagctgaacctaaaggattcagagttaactagaatgcagagctttctggaggtcgagttatccagaaaggatgatgtaataaaaggactgttgtatgatctgagcttattacaggaatctgcatccaacaataaagaccaaaaagatgaaaatgaaaaaattgtggctacaatggaggcattagaaacggagctagctgttaaatcaggtgaacttgctgacgttgttgcaaactgtcaatcgcttgaagctcagttgcaggacaaaacagtcatagttacagctcttgagttggatctctcaaaagagcgtgaggctctaaagttgcaagtcagtgaaaataaaaaacttgcaactcatattgaaggcgccttggcagcgagacaactggctgacaatgagataacagaaagaatgaagttaacagagagcttagaaaatgcaatgctggaaatgaacagtgttattagccaaatgaacagtgatctggatgaactcactaacgagagggatcagcttcagggtcaagtaatttgcctcaaaaacaggcttgaaaaagctgaagcacaagctgaagctaatgaagcaattgctcaagaagctcagaaggtggcagaatcaagacaaatttatgctgaagacagggaagaagaggtgaaacttctagcaagatcagttgaagagctggaaagtactgtaaatgtactagaaaaccaagttgacatccttaaaggagaagcagaacgacagcggctgcaaagagaagatctagagttggagctacatgcattaaaagatcagatgcaaaatgtcagaaatgttgatggtgacatgagaagatttttggatgaaaaagagaaaagcctcaatgaagccctaaatcacatacaggttcttaagagggagttagcaggaaaggatgcagagattcaacaaatgaaagctcatatttcagagctaaatttgcattctgaagcacaggccatggagtacaagcagaaattcaaagcattggaagccatggctgagcaagtcaaacctgagggcctttctagtcattccaccagtgctaattcccacaatgcattgtcaaacaagtctgagaagaatgccaccaagtctcgaggttctagttctcctttcaaatgcattgggctgggcttgtcgcaacaggtaaaatatgagaaggttgaagagctgtctgctgcaagactgcacattgaagaactagaagcccaggcagcatgtcgacagagagagatatttgcactgaatgccaaattagcatctgctgagagcatgacacatgatgtaattcgagacttacttggagtaaagttggatatgacctcttatgcgtcactaattgatgatgagaaagcggaggagattacagagaaagttaaatttcttactctggaacctcaagacaaggaggttattaagctaaagaagcagctgaatgaattcattgaagagagacaaggatggctgcaagaaatggatagaaaacaagcggaattggtagctgtacaaattgaattggaaaaccttcggcagcgagaccagttactaaagacagaaaatgaaatgctgaagatggaaaatgcaagtaagaagaataaagttgtggaactggaggaagaaattaaaaagttgtctggtcagcaaaaccttcagcagcgtattcatcaccatgctaaaattaaggaggagaataacaagttaaagatacagaacgaagaactcagcgcaaagctccggaagtcagagatcttccagtcgcgtgtcaaagaagaccttgcacgtcttcgtgcttctgctggcgtgaaaacaagcattaattttgacgaggaacaacgtctgatgataaagctgaaggagatcgaggaagagaaagtacaattagcccagcaattactgagattgtccactaatgttctaaaggtggctggaatagtaagaccaatatcagatgtaaatccttctatggctgaggaagccctacaggacctaaagaataggataacaactctggaaatggaacaagaagatttgaagtttaagaataaaattattaaggaaaagattcgattatccgagctcatgccacaagcttcttctcctttgaaccctagatctgaggagaatcgtatgactccaccaagggcatccctggctccattcctttccagttttgatcgataa

SEQ ID NO: 48211 - DNA, 273 bp, Glycine max
  Peptide Sequence Number=SeqID_139896
atgaagaacgaatttgctcgcatggacgataaggttcactgcctaagccagagcaaccagaccttcacctgtaggtgtgacttcaaactcctcactgcaatgccgtcgtcaccatcaccacaccaaacaaactctttgtctccaactgcaacaactcccgcatcgtactctaccacaatggcaccaccatgtctctctcctccgatcacaagattaacccgacgaattgctccaagtccaatccaagggaagaggaaaaattggattttttga

SEQ ID NO: 48212 - DNA, 117 bp, Glycine max
  Peptide Sequence Number=SeqID_139897
atgaagaacctcatcaattttggaatggaaggagctctggtgatgagcgatatctattgggacagagtcatgacaaagtcaatggaagcgccaaacgatgaggataggggactgtaa

SEQ ID NO: 48213 - DNA, 699 bp, Glycine max
  Peptide Sequence Number=SeqID_139898
atgaaggcaacactgctttgtccttgttcttctgctcctctgattctcgacacgcatagcaaccgaacctcggcaacgagacacgcttccaccgttgtttgttgttcgtcgaggaatcaaccctacatcccgaagctcgagccttttagccgaaccaaatttgaaagggccgttaaggaccctcctttgatcgaaaaatccgagagagagatcttagattattgttcaacgcttgaaggagaccaatcctatagctgctggcaggcttattttgagctgaaagatcttgaaaaagagtccccaaaagcagacatagagaggctgattctggagactggtggtgtaaaatccctaataggatgcttgcatgggatttcaatcatgcacaaacttaagaagggtgacatgaatctgagcaaggatgtaaaatcagaagaaggtgagagactgtgtcccatacctgatggattgccaaaatctgctgatgaactgagggaagaggagcaagcaagaatgcctgattcaccatacactaagcttcttagaaccatgggcaggcaccctgcatgttttttgaagaagtataattcaagtatttatgccagtatgtatcacttgagcttaatgataggaatgagggcactaggaaggggaaatgagaagagaaatgggacggagtttataatggagacacgttaa

SEQ ID NO: 48214 - DNA, 846 bp, Glycine max
  Peptide Sequence Number=SeqID_139899
atggagagtgtgaatgatctgatccaagaggccaagctccgcactctctgggtggagttccgttggaaggttccacagcctagactgcagacctatctatctcatttggagaaaaagcagttgtctctgaatgatccacgcctcactagtttgcctccccctgcgaaatggaagaggaaaattgattctcctgctgtggaggctgcaatgagtgatttcattgataagattttgaaggattttgtggttgatttgtggtactcagagattactccagataaggagtttccagaacagatacgggcaataatcatggatgttctagctgaaatatcaggaagggttaaagagataaacctggttgacttgctgacaagggatttagtagatttaataggtgttcacatagaacttttcagaagaaatcaagctactattggtgttgatgttatgaaaacattatcttctgaggagcgggatgacagattaaaattccatctgttgaattctaaggagcttcatccagcactaatatctcctgagagtgagtgcaaggttcttcagcggctaatgagtgctgttttagctacagtactaagacaacgagaagctcagtgtcctgtgaaagaatcccttaagaggaggaataatgctaaagttgttggtccatatggtattcctactgaagtctacaacaaaagctctttaacttctatgagggtttatggaaaggatttgggaaagaaaggtgtttgcatgacttatattcatgctatactagacatgtataatgggataactactagtatgaaaacttctagagataaaactaaggacttcctataa

SEQ ID NO: 48215 - DNA, 447 bp, Glycine max
  Peptide Sequence Number=SeqID_139900
atgtctcatagtaatcataaccaagtttctgatgaaatccctttgctacaagccttgctttggacaggagctacagaaacagtggcaggggaagataaagatacctcagcagtagtgacctcaacattggatgatgcatctgaagaaacagaagatactgttgccggtggagtattaggtaattcagaatttccttgtggcaaaggagaagaattagatgttgataaggttggtgttgtagcttcaggtgaattgacagatgctacagctgtttgtgaagcagtagcagataggcatggcacccgcgcggggcaaggtgtccccgaaccttaccctgttccccgttcccgtccccgctcccgtggtgggggtattttttgccccgtctccattcctcgactccccgtggggaccccgttttatattaaaaaatgtaaaaaattataa

SEQ ID NO: 48216 - DNA, 864 bp, Glycine max
  Peptide Sequence Number=SeqID_139901
atggatgatattgtacgccagtttaaaggggtttcagatggtttaaggcgaaaagttgttggttcatcatccctcatcaatgagggatctgctacatctaataccacatggaatttgtcctggaatgcagatgaaattgacaaaagcattccgaggcaaagtactgcagaaagtgtgtttagctctgataatgaggaaggtgaaaagaacaattttgaccgtgagaatattgatagagcagtagcacaagatagtgggttgcattctgacaatgcattgatctcaaagggcaactcatcacgaataaacaattgtgatgaagagtccagcaacttggaatttgatagaaagcatgatatggtggttgaagctagggttggcaatgatattcctgctacaaatttcattctggttcatggtaatttggaggatccagttggagtgccacctgagtgggccccgcctaatgttagtgtccccattttggatttggttgacaacatatttcagcttaataaaagaggctggataagaaggcaggtctattggatttcaaaacagatattacagttggtgatggaagatgcaattgatgattggcttctgagacagattcattggctccggagagaggaaactgtttcccaagggattcggtgggtccaagatgtcctgtggcccggtggtacattttttttaagagtagggactccccagataattagtgacagtgataaaaaaccttctccaacaatgagcagatctggtggaagcaacatcacgaaatctgagtcaggatcttttgagcaagagctcgaggctgctcgtagagcaagtgacatcaagaaactgctatttggttag

SEQ ID NO: 48217 - DNA, 1302 bp, Glycine max
  Peptide Sequence Number=SeqID_139902
atggcatcaaatagccattcaccatctctcgagatattaggaccagaggatttctcgctctggaccggaccccccttcgcgaacgatcaaccaagcgtcaagctcgagaaagtgaactgcatcaatgcgaagttcagcgacgacggatccaatctcatggtgacgaaatcgaactcgctgattagcgtgtacgattgcagcactgccaaggagattagggtttttgaagtgcccaatgtcgttgctgcggccttgtcacccaaaggaacttacttgcaaaccttccagaagccttcggggccgcaggagaagaatgtaacgctgtggagcatcgagaccggtgctgcggtttaccagcagtcgcagaagaacatgacgaaagccaattggcctgcgattcagtttagttctgatgaagctactggagttgctgctgctgagctttctagtttaccgggatctcatgtagctgcatttgttccagaatccaaggggattcctgctagtgtacagatatttgcttgtggaaatgcgtctcaaagtcaacctgttgctcgacgtagttttttccgatgttcaaccacccaacttaaatggaatcatggctcaactgggcttctagtggtggtgcagtcagacgttgacaaaactaatcagagttactatggagaatcaaaattatgctatctgaccacagatgggatgcatgaaggacttgtgcctcttcgtatgttcttgctgctactaaaagaactgataattggttatataatgtctataagaagggtattttgggattacatagataagaaacaacttggagccactaaggctgaatggtctgtgactagtgaatggtctccggatgggtgttatttcatgacagctacaacagctccaaggcttcaagttgacaatgggatcaagatttttcactacaatgggtcattatacttcaaaaagatgtttgataaattgtaccaggctgattggaaaccagagtcacccagtaagtttggtgatattgctgaattaattaagtctctaaatttggtacaacttgaagataagaaaccatcaggaccaccaaagtcaacccagacttctacaaaagcctcctctaccaaccccccaacacaaaaacctgctgcatatcgtcctccacatgctaagaatgcatctgctattcaggcagagttcttcgtgatggaatcaatgttcttcctaatgcattctaaattgcttttcgactactgcactcgtgcacctgaaaatttgaggcttcaggttttgctttactag

SEQ ID NO: 48218 - DNA, 252 bp, Glycine max
  Peptide Sequence Number=SeqID_139903
atggcatctacaactgctccttttctttggaaacaacaccttcatagatttggagaagctatgccttctccagatcccagaattgaacctttgttggttaaagttagattttcagatgttgcaaagctccaacaagttaaaatcgacaatgctttagtggttgctttggttgaaaggtggagacatgattcatacaaattttatcttcctgatggtgagtgcacaatcaccttggaagatgttactatttaa

SEQ ID NO: 48219 - DNA, 612 bp, Glycine max
  Peptide Sequence Number=SeqID_139904
atggagccagtggggccaacccacattgactccaatttgcattcaatacttcctcaatttgtggcttttgacttctccaaaagagaagaggggatagatgttagaaagatgatggaacataaaaggagcccctgctctgttgaccaaagcagttatacttctattgcctccaaaaggcaaaaggctgatttatcgatcagcactaagtatccactcatgtattttatagacatccaagctttactatttgaaatatttcttgagaaacatgataaggagaggaaggaaaagattggcaaacgaattgttgctcttcagcagcttgtttcaccatatggaaagacagatacatcttctgttctaaaggaggcaatggaatacataggattccttcataaacaagttaagctgcttagtgctccataccttgaaagttcaccagcagcaaagatgcagggtatggagccatgcagcctgaggagtagagggttatgtcttgttcctgtgtcatttactattggagttgctgagaccaatggtgcagatatctgggctcccattaagactactacttctcctaaatttgagaaggatgtctcccaatttcattga

SEQ ID NO: 48220 - DNA, 201 bp, Glycine max
  Peptide Sequence Number=SeqID_139905
atggcattagaagaggggaaggtgaagatcgagaagttcgatggcagagatttcagcttttggaagatgcagatagaggattatctatatcagaaaaagctgtatcagcccttatcaggggttaagccagaagacatgaagcaagaagaatggaacttgctagatcgacaggctcttggcgtgatcagggggatcctctag

SEQ ID NO: 48221 - DNA, 459 bp, Glycine max
  Peptide Sequence Number=SeqID_139906
atgaaggttacagccctcaagcaaaccaaccatgacatgattgcacatgtaggtaaggctcgggctgcagtggaagagttgagaaagtttcttgtggctgtttcattggaagaagtgaacaaaaaactggacaaattctacatggtcctcatcttgagaagcttacattcagactttgatcatgtgcatgatcaagtccttgctggggaccaagttccatcaatggattccctcatcactagacttcttcgcgtgcctcatgtattaaaggatgaaaacccttctgatgttgtggaaacatcagccatggttgcacctcgtgggagaggaggaggccgcaacaataaaggaggctgcagtggaaggggtgaacgtcctcattgcacttactgcaaaaggatgggtcacactcaagagaattgttattcgttgcatggctttcctgacaaggtagcgtag

SEQ ID NO: 48222 - DNA, 444 bp, Glycine max
  Peptide Sequence Number=SeqID_139907
atggattttcaacctccactggaacaacaagcatgcggccgacccttactagcatctagaatgcatgtctggactcttgaactcacacaagccctgcttggtgatcctgaaccactgaggcttccacctcttgcagcaatacattttccttcttgcgattttcatatgacaattttaagaagttacaataacccaagtagatgtaccctctacttgtaccacaaaggatgtatcctccaatgtgttaagacaaaaaattctcaggcggaaggggaaacaaaagatatctcagggaaagggaaaaatcaaaagaattctcaagtggttagtcttttgaattctcttggaaagggagaagggagacacaaaataattcaggcggttagtccctctattcttttggaaaagggagaagagagacacaaaaagaattcaggcgattag

SEQ ID NO: 48223 - DNA, 1146 bp, Glycine max
  Peptide Sequence Number=SeqID_139908
atgactgatccccacctctgtcggtggcagcctatccgcccagccatccaccaccacccacatctgcacttattctaccccccacaggtcccatcccttccatttcaccacccttcgccgttttccctgttggaacccctgccttcgaccatgcccgctcacaacagtcacgagaccaccatggactgccttgaagaggcactgtcccacctcacccagaacatttccaccatgaccgccaagtctctggagatggccgctaagcttgatgtcatccttgactggttatctgctctccaaccaactccatcttctcccaaatcactcgctccaccggacgcacccatgccgaatctgccccccatggtcggaatcaattccggcaccacctactcttgcgtcaaggtgtggcagcaccaccatgtcgaaatcatcgccactgatcagcgtaatagaagctcggcatcttactttgctttcaccgaacgtttgatcggtgacgccgccaagtactacgtcaccatcaaccccatcaacaccatcttcaatgctaagcgtttgtgtggaaggagattttccgctgcctccattcggagtgataggcagttatggctatataaggttttccctggtcctcctgacaaacctatgattgtggtcaattacaagggtgaggacaagaaattcgctgctgaggaaatgtcttccatgaccatttcaatagatgaagcacacatttctcaggccataagtgctgccactgctgccacagaagagcttgcttgccatggcaaagggatttccaacaaccctttgacattgttggagaagaagaatggtgttcctgatctttatccggttgatcttccttgtataattcaggttccagttcatggacaacctaagaatatttatgatcagattaaggatatgatcatggagtatataaagccggaagcaagtattttattgactgttctctctgctagtgttgattttactacttgtgagtccatcgggatgtctcaaagtgttgagaaaactgagctcaggacgttggctgtggtgacaaagactgacaagtcccctgaaagcttgttaaagagacactcaggctggttcaattgctgccagtggccgatatga

SEQ ID NO: 48224 - DNA, 471 bp, Glycine max
  Peptide Sequence Number=SeqID_139909
atggccgacgacattcgtggacatggtcatggatctcacgtaaggaagatggcaagcaaaaaccacaagcatgtgtattattccaggggtattatcaaagaagaaaaatggagttgggatgttgatgagatgtcctacattgacatgaaaaagcatttaattgatgtaccaatgcttgatgatcgactaccaacaaagagatgcaaagcttttactgaaattgaggaggttgaagttgttgtaattttttataggatcaatgaagaggagcatattaatgttggtggggtccttggtgatggtgaggtccatgacgatggtaagatgcttggtgatggtgaggtgcttggtgatgttgaggtccatgttaatggggaggtgcctagtgatgtcaaagtccatgccaatggtgaggtagttgataatggggatagtgaagatcttgattatgaaggtgaaaaagctgcctaa

SEQ ID NO: 48225 - DNA, 1698 bp, Glycine max
  Peptide Sequence Number=SeqID_139910
atgggaaagaaggggagttggttttctgcaatcaaaagagttttcacacaccactccaaagggaaggattcagataataacaaaggcacaaaagagaagaagaaaagtctaggaaaactaaagcatggagaggccaattcattcatccccctcttcagagagccaagtagcattgagaaaatctttggggactttgaaagggagcaacaactactggggttaaggcctgccactcctccggagaggcctaaaacgccaccttatgcccctccaagagctccttctcctaggcctccctctccaagggttccttctccaaggcctccatccccaagggctgcttctccaagggcggcttctccgcgagttacctctcccaaagccacgtcttcccggattgctcatcaccacaaggaggttggccacagaccagaaccaactttgaggcaacagcaagcctcagctactaagatccagtctgtttacagaggttatatggccaggaggagttttagagctctaaagggtctggtgaggcttcaaggagtggtaaaaggacagaatgtgaagaggcagacagtgaatgccatgaaacacatgcagctgttagtgcgagttcaatgtcagattcagtctcgaaggatccagatgttggaaaaccaggcacgatatcaagctgatttcaagaatgataaggatgcagccagtatcttgggcaaactcactgagtgtacaatcacaaatcacatcttttcagcaatagatggtcatgctttccttgtggcatctatcttattagatgtgaagttagtaacttactatgatttcagtcacggaaatgaagagtgggatgatagcttactgaccaaagaggaagtagaggcaagattgcagaggaaggtggaagcaatcatcaaaagagaaagagcaatggcatttgcatattcacatcagctatggaaagccactccaaaatcaactcacaccccagtgacggatacacgatcaggtggattcccttggtggtggaactggttggaaagacaaacaccagcagcaactccacaagaaagacaaagcttgaagaattttcaaatcacacctccaagaccatactcagagcaaaagactagtccaagacctggctccagcactcaaaggcagccgcagcagcagcagcctcattttgcctttgataacatggacactcccacaccaaagtccacaaaatcaaccatagtgacatcttcaaaaccggcgcgaacgcctccatttagaactcctcaggcaaacggctcaggctcaggctctagatatccgagaccaaggggtgtggggtccaattcaccctttgatgtgccattgaaggatgatgacagcctcacaagctgcccaccattttcagtgcctaactacatggctccaaccctttccgccagggccaaagtacgtgctagtagtaatccaagagaaaggcttggtggaactccaactagtactgattcaaagaggagactctcattccctttgtcacaaggaattgggtctttcaagtggtctaaagggttctcaaacaaggatcaaagagtcccagataaatttcagtcacttgaatctataggaaacgtgagtgtggattcaacggtgtctttgcccgcaagggtggtgggaagaaagccttttacaagatttgtgtga

SEQ ID NO: 48226 - DNA, 66 bp, Glycine max
  Peptide Sequence Number=SeqID_139911
atgcggaagcggggagatctgaggctgggcatttgggggagggagaagttgaaacatgaagattaa

SEQ ID NO: 48227 - DNA, 281 bp, Glycine max
  Peptide Sequence Number=SeqID_139912
gcttaaggaaatttgggagctgtggggaggattcaaaatgattgatgtagggtctgggttctacatagtgaagtttgatctgtcacatgatcctgaaaagtatattgctagctctagtgacggtggtgggtactccgatgaaagtggatatgaggatggtggatgcaacacaagggaggtttgtgacctaaacatgcctagtaagagtgcaccaagaaaccctagcacaaaatctagtaatcaaggaaaaggcgcgattcatgtggagacaaatcaatatg

SEQ ID NO: 48228 - DNA, 132 bp, Glycine max
  Peptide Sequence Number=SeqID_139913
atggtgaacaacatccctataggctttgctacaatcgcggtagggcagaacattggtaatttcttgggtacttttctggactatgatgataagcacaactccagcccatggatgtcatacatgaggatttga

SEQ ID NO: 48229 - DNA, 321 bp, Glycine max
  Peptide Sequence Number=SeqID_139914
atgtacgttggtgttgatgttggtgtgcaacctaaggtggacattggcttggaagtaagtgatcatgaggaagtttgcgatgaaacaagggtagatgatggcgtgaaagcaggggttggtgcaagtgtggaagaaagggttggagttagtttaaatacatttgtgaatggtagtgatgaatcattccaagggacatgtttgaaagtctttgacacagaaatggacttggatactgaagatacctttgaagaagtagtggatgatttgaggaatgttgttaattctagaattccatttgatattcttgatgtgatcatatag

SEQ ID NO: 48230 - DNA, 1533 bp, Glycine max
  Peptide Sequence Number=SeqID_139915
atggagaatttacgcatgcatgcagcttatttcttagactgtgggggcaccaaagaggtaacggtagacaatctcacatacattcctgatgaaagttacatcaaggtgggcaaaaccaccaccatcaacaagccagacttgttgccaatactctcaacattgcgatactttcccgacacgtcggctaaaaaatattgttattcattgcccgtcattaaaggcagcaaataccttgtgaagacaatgtactactatggaggttttgatggaaggaataagcagcctccggtgtttgatcaaatcattgaagggacaagatggagtgttgtgaacaccacagaggattatgccaaaggtcttagttcttactttgatattgtggtggtgccatcggggaagactttgagtgtgtgcttggcaaggaatgcacacacgggtggcgcaagccccttcatttcggccttggaggtgaagaggttggatgcttctttttataatcctaccgactttaacaaatatgcccttctaaccgttgccaggcatgcctttggagctgaagatatcattagttttccagatgacaaattaaaccggatgtggcaaccatacaaggaccagaatcttgttgtggaaagccattcaaatgtgacttcttcagacttttggaatcaacctccagtgaaagcattcagttctgcaatgacaactagtcgggggaagacacttgagattcagtggcctcctatgtcccttcccagcacctattactacatttccctctattttcaggacaacagaaatccaagcccttacagctggagaatttttgatgtttctattaatggccacaccttcttttccagcctcaatgccacaactaagggtgtcactgtttatgctgcaaaatggccactctcagggcagaccaaaattacattgacccctggtagtggaatacctgttggacctgtgatcaatgccggggaaatttatcaagttctacctcttggtggtcgaactcatactagagatgtaattgcaatggaagatttggcaagaagcattcagaatcctcctgctgattggcatggtgatccttgcctacctaagggaaattcttggactggagttacatgctctaatggtttccatgcacgagtcacgacactgaatttgacaaatgctggagtgtcagggtcacttcctccaactcttggccgtctaagtgcactagagcatttgtggcttggggaaaacaaactctcaggcactatcccagatttgagtggactgaaggagttagaaacattgcatttggagaagaacaactttgaaggaccacttcctccatcaacaaagaaactcccaaaactgcgtataattgagtcagattttgagaataagtcaccaaacactaatttaaagcaaagcgaagtgaaagtagaacaaagattcatccgtgagaatgagcacaagccattgcaaattcgacaggttttgtacgtgactgaagaggctttaatacaatcatag

SEQ ID NO: 48231 - DNA, 483 bp, Glycine max
  Peptide Sequence Number=SeqID_139916
atgatagatcttatccagcgcaagttgttgcagcccagatacgcacactgctatataaacatgaaggctgcacgagtttctgtaccaagtccgggattgaagagttattttaatttcaatgggcttgagaaagataagcttcttgaacatgaagaatacatggctactcttgggtttgtacacaccaagttgcaagatcaagacttggatgctagtaattttgtgcagttgaggaaggcactcatgcagtatttcagaccatcctcttttgtgagagaacacaccaaaaacaaacctgaagagcatgtttcatcttctctggttcatggtagtcaaatggattctaacatgataaaattttatgacaaaaatccaagagctcagcatgaaagttatgtttctgcactatggaaattgcgtgatcaggttctctctctacacaaacaaatgcctcacaaacactactgtgcaggatttgtttaa

SEQ ID NO: 48232 - DNA, 306 bp, Glycine max
  Peptide Sequence Number=SeqID_139917
atgccccatgggttgtttccttacaaaagtcacgcgctaatgccattgaggcatttcaccgaacacttggtgggcgcgcgtttaggcgtcaatagcaagagaacggggacaatgtggcatagcaccaaaaggagatcaaaatacaccaatgaaaagctagaaagcttagggatggaacacttacttgttggtgatgaacaaaagcgcaaaacggaatcaaaaaacgcgaaaaatgatgacactggggctgcaaattcgtcaatctcgtgggtagggcttttgaaaggggggaaaagaagtttttga

SEQ ID NO: 48233 - DNA, 531 bp, Glycine max
  Peptide Sequence Number=SeqID_139918
atggcgagtcaagaagagtgggtcctgtttgcggatatactagctttgctgatctttggggttgtcctctttcctaacatggacggtttggtggacctaaccgcaattgatgctttccttgcatatcaccatagcaaggagagcccggtggtagctatcttggcggacttatttgatacatttgaccgaaggcagcacaatcaactagtttcctcgatggaaggaaggaaggagggagttcttttctcatgtggggactacccaaatgtttcgttgatagggatgaggggttgtattaactataatcccgcacttgccataagacagctagggtaccccatgaggggagcaccaacggaagagagcctctcgcctttccttgtgagagatttcgaacttaggggcatccgtaatggcatcatcggtggttatcatgaatggctaagagttcatacacgagggttagattggctctccaagttgaaaattatcaacgaggagaacttcgaagccccggaagaggatgaagaa

SEQ ID NO: 48234 - DNA, 423 bp, Glycine max
  Peptide Sequence Number=SeqID_139919
atggtggcacgggttatgctcaagcacggttatgagcccggaatgggtctgggcaaggacggcctcgggaatgccgatgtggtcgacattagaggaaacccgtacaaatatgggttggggtatgaactcgggatgccgggaaggaggaatgcgccatcaagactcaaagcggatagggcatggcccggccatgttagccagtgtttcaccagtgccagaataatgttcgaggaagaggtggcagcaataggagaggaattccctcaagacccaccaaatttcgtgcgaccatgccatcccgattcccaagtggggaactggcgcgtgataagccagtcagaggatcctaacaacgaggagttggagaggttgatcactcaggaagaacgcgaaatgaagcctcaccaagaggaaaccgaactg

SEQ ID NO: 48235 - DNA, 315 bp, Glycine max
  Peptide Sequence Number=SeqID_139920
atgggacatcttagtgatcaaggggttcccatgaaccctaagagaataaaggtcattcctgagtggctcattccaccaacaccactcattgagttggtgaggaaccatgttccttcatgggaagatgcccaggaaatgggttttcagaccttaccttacttcaacataccaaacacccctaatacatatgtttttgttctttttacaagtgttgaggaaaaaagcccaaagtttcaagaacctcgggatttgaggtcaaatccttttcaacggggagggaatgatgcaatcctaccctacaagggcattggatag

SEQ ID NO: 48236 - DNA, 598 bp, Glycine max
  misc_feature (565)..(565): n is a, c, g, or t
  Peptide Sequence Number=SeqID_139921
atggtgactttccaagaggcgcacaccaatgtgagaaccaacccgctcgccattaatcactgtttttcaggagcgattaacgccgttgagtccgataggccgcgcagtgtaaacctttacactaggatgtggcaacccctatccgtatctttgaggccctacaagagggagattcctgtttgctgcattccggtgagctgcatgacatggaaacgtgttctgagagtagaggcgaattgtgttgtgaggcccaaacccttggtgatatacattcaccaagggtccagcttcgaaaagcccggacctagcagcctgttcgccggggaaagaatcgaggtaggattgaaaagaggaaagttcaattacgtttcctccacgagtgcgaatgccaaaagaatcgggacaacgggggcaaaaaggaaggaaggagatgcccatgctgtctcttcaacgcccgcgtgggtcaaacccccgcagccacctcatggtacccatcagtacgcgcaacatcacccaagtttctcggctcacaccgggaacgcctctagttcagcacctgtgcagnctaaggcacccacccagagggaagctccccaaa

SEQ ID NO: 48237 - DNA, 489 bp, Glycine max
  Peptide Sequence Number=SeqID_139922
atgattatgaggggccaagacatttatagtagccaagatgaggctactacttcaccttcctctaatgaaaatgaagaagcaataggggaagaatctagggaagaaatctatccccaagaagaaagacaaccgttaatggttaaggaggagtgtaaggaggtaagtgtctcctccaagagtggtcaaggtgttcccgcagaccctatgagaataaaggtcattcctgattggcccactccaccaagtataagggaaatctggggctgccatgacttaacaaacttttacaaaaggtttgtcccatatttctctatacttgtagcaccactcattgagttggtgaggaacaatgttccctcatgggaagatgtccatgaaaggggtgtcaagggaaggagcccaaaatatcaagaacctcaggatttgaggtcaaatcctttccaaggtggaggggatgatgcaatccaaccccgcaagggtattggatag

SEQ ID NO: 48238 - DNA, 261 bp, Glycine max
  Peptide Sequence Number=SeqID_139923
atggttaggaccagaggattaggtcagcgagtcgctgtgactgcggatcacgtcgatgagccagtcatccctgcgccagatgttcaggatgacccgatagaggcaccagctgctgtagaggacattcctacggacattcctgtggacacaggcgcaaagcctgctgaggacgcgcatgagggattttcgggtggtccaagcgacccatccatgttgaccctgtatgcggatcacgttgcttgcagcgtatggacgggagag

SEQ ID NO: 48239 - DNA, 471 bp, Glycine max
  Peptide Sequence Number=SeqID_139924
atggcgctgctctctgccgccatgttcttcgtgctggcgggcgtctttatgggcgttcagttagagctgaacggcactaagctggtggtcgacaccgctgccgacattcgctggcagtgggtatttatcggcacggcggtcgtcttcctgttccagctgctgcaagctgttcctcgtggcgctgctggtggccgcggtggcgtggccgttcgtggtctcccgcggcacggtggatatcgccaccctgaccatgatctacgtgatactcggtctgggtctgaacgtggtggtggggctttccggcctgctggtgctgggctacggcggcttctacgccatcggtgcctacacgtttgcgctgctgaaccactattacggcctcggcttctggacctgtctgccgctggcggggctggtctctgccggcgccggtttcctgcttggcttcccggtgctgcgcctgcgtggtga

SEQ ID NO: 48240 - DNA, 723 bp, Glycine max
  Peptide Sequence Number=SeqID_139925
atgccggtaggtatttttgtttgcagcggttcattactcgtcggcgcgattgcaggcgcctcactcaaccgatttatcccggatcactttaagaaaacgctaccgcttatttccgggttaatctctatcagtatgggcgtgttcttccttaacaaactcatcaatctgccacccattgcgctggccgttatcatcggcacgattattggcggcctgttgaatattgagaagtggattgagcgggcgggaacacagctgcgaacgcccatcgagcgcatttttccaggccaaaacaacgcaggcgtagaagcggaggattttatgaaccagtttatcgcggtgctgatcctgttctgcgccagcggtaccggtatttttggcgccctaaccgaagggatgaccggcgacccgaccattctgctgaccaagtcgatactcgactttttcactgccgccattttcgcttcgacgctgggctacattatcaccgcgatttttattccccagctgatcatcttcgtgattctgttcttcgccgccacgtttattatgacgttgataagcccatcgatgatcgctgattttactgcctgcggcggtattattatgctggcgaccggttttcggctttgcggtattcgccatttccccaccgccaacatgctgccgtcactgctgctggtgatgccattttccaccgcctggcagcagtttgtcgcctga

SEQ ID NO: 48241 - DNA, 297 bp, Glycine max
  Peptide Sequence Number=SeqID_139926
atgtcctcgccatcgagaggaccctcacctggtactagttacctcgccttgagagatacacgtcctcaccatcagagggctgcacgccctcacctccagaggactacatgtcctcgccttgagagggctacacgccctcaccttggggtactagttaccctcaccgttgagaggactacacgtcctcgccttgagaggactacacgtcctcaccatcagagggctgcacgccctcacctccagaggactacatgtcctcgccttgagagggctacacgccctcaccttgggtactag

SEQ ID NO: 48242 - DNA, 460 bp, Glycine max
  Peptide Sequence Number=SeqID_139927
gcttttcatcttacagatagcaaaaaagaatgtttatacggataaccactcgggtatttccgcccgtcagcgtgactcaaaagtcagtatgatagatcctgtgagcgcggaagatgacataccaaaaaagaatgtttatacggataaccactcgggtatttccgcccgtcagcgtgactcaaaagtcagtatgacagatcttgtgagcgcggaagatgacgcaaatctccgcgtgctttccgtcttacagatagcaaaaaagaatgtttatacggataaccactcgggtatttccgcccgtcagcgtgactcaaaagtcagtatgacagatcttgtgagcgcggaagatgacgtaaatctccgcgtgtcaacgggcttgtcggccgcgattgacgaagggcgcagagacgaccgtgactcaaaagtcagtatgacagatcctatgagcgcggaagatgac

SEQ ID NO: 48243 - DNA, 189 bp, Glycine max
  Peptide Sequence Number=SeqID_139928
gaatccattgatgaagaagatcctaggcctacaagctccaatggagcttgcatcaataacggacaaatgcaagaacgatatgttcattatgatgccatgaagagatgcttatgcgatgaatgcatgctagagataaaatgcgggagtgatttgattcgcactgatctttggagtaaaaacgtgagataa

SEQ ID NO: 48244 - DNA, 456 bp, Glycine max
  Peptide Sequence Number=SeqID_139929
atggccccgaggaagctcgcctcaaagagatctaggaaggataaagcggctgaaggaaccagttccgctcccgagtatgacagtcaccgctttaggagcgctgaacaccagcagcacttcgaggccatcaagggatggtcatttctccgagagcgacgcgtccagcttagggacgatgagtataccgatttccaggaagaaataggtcgccgacggtgggcatcactggttacccccatggccaagtttgatctagacatagtcctcgaattttatgccaatgcttggccaacaggactggagggcgtgcgtgatagagtcctgggctgggggtcagtggatcctgtccttgatgcagatgcttgccagctccgggatccccatcctttagtgcaagggattcggccgccaggagcttttattgcgaagtactggccagaggaggaaccgggttga

SEQ ID NO: 48245 - DNA, 453 bp, Glycine max
  Peptide Sequence Number=SeqID_139930
atgattggtacctcaaagccttacactggggcaatgaggggcaccgtgcatgagcctcaagtgaacataggggccgatcaaaaaggactacacgtcctcgccaacagagggctgcacgccctcaccttaagaggactgtgtgtcctcactttcagaggactgcatgtcctcaccttcagagggctacacgccctcgccattagaggactgcgtgtcctcaccttcagagggctacacgccctcaccatcagaggactgcatgtcctcaccttcagagggttacacgccctcgccatcagaggactgcatgtcctcaccttcgtagggctacacgccctcacctttagaggactacaggtcctcgccaacagagggctgcacgccctcaccttgagaggactacacgtcctcgccaacgtagggctacacgccctcacctttagaggactacac

SEQ ID NO: 48246 - DNA, 552 bp, Glycine max
  Peptide Sequence Number=SeqID_139931
atggcgagggcgtgtagccctctgaaggtgaggacgtgcagtcctctgatggcgagggcgtgtagccctctgaaggtgaggacgtgtggtcctctaaaggtgagggcgtgtagccctacgaaggtgaggacatgcagtcctctgaaggtgaggacgtgtggtcctctaaaggtgagggcgtgtagccctacgaaggtgaggacatgcagtccactgatggcgagggcgtgtagccctctgaaggtacatgaccctttgaaggcgaggacgtgtagtcctctaaaggtgagggtactagtacccaagggatttacacgcaattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtagatatgggagcaagtcagcataggacactggaattggggtga

SEQ ID NO: 48247 - DNA, 567 bp, Glycine max
  Peptide Sequence Number=SeqID_139932
atggtggaagcctctggtaatcgattaccagcctgtgtaatcgattacacagaggaatgggtcactggctgtgtaatcgattaccagagatggaaagccttaaaataccccttttacttgcatgtagtgatcgtgatggcggcgcagctaacacgtgatcgagtagagatggagtgcctagagggagcttgggagaccctcgaaggcaacatgaggtgccgatttcggggcaccattcgattcacggctacttctttggtgcatccagatgaacctgcacgaacgcttcagcgcacggtggagtggatactacccacgcctacaccatatcgtctagtggagcccgtccaagtgatcgaggtaacgtcatccgaagaagaccctgaggaggacctggaggagctacttcctgagcctgctgtggatgcccttgactttctagagggtgatgaggatccacttcttgaggtggattctcccgaggaagtcatgtcggcatctgaggcagactctacggaggatagtggcccgagggagatggcgatcagcggaggctcttcatcctag

SEQ ID NO: 48248 - DNA, 321 bp, Glycine max
  Peptide Sequence Number=SeqID_139933
atgcctctgtggtgggaattcaacccctgggttagggaggacagagttcttcattgtaggcccatggataatttcctccagcactcctccatagtagcctcgaaggtttccaataaaagaaggaaaatatggtggacaatagctgcaaggtcaatatggaagctccgcaatgatatcatctttcataatcaaccttttcacatctctaagttggtggattacaaaaattttctcacttggtcctggctgagggggcgggaaaaggactttaatgttcctttccatcaatggtcctcagctatgtctatggcttttaattag

SEQ ID NO: 48249 - DNA, 145 bp, Glycine max
  Peptide Sequence Number=SeqID_139934
caccactcattgaggtggtgagaaaccatgttccttcatgggaagagcccaagaaatgcccagagtatgaagaaccttgggatttgaggtcaaatcctttccaaggtggagggaatgatgcaatcctaccccgcaagggcattgg

SEQ ID NO: 48250 - DNA, 201 bp, Glycine max
  Peptide Sequence Number=SeqID_139935
atgaatgacgaagaacggttgaaaatcttcgcgaaatcacccacggaaacgttacggaagtgtctcggcttggattttcttcacggaaacaattttcctcacaaaataggggaggagcttgccacccagctcgcccaggcgagccaggttgcttcctccagaagcaaccgccttctggaggaagaatctggaaaggcccaa

SEQ ID NO: 48251 - DNA, 1304 bp, Glycine max
  Peptide Sequence Number=SeqID_139936
atggggacaaatcaaaacggcaaaaggttttatcaagtcaaggttaaaagtctagatgtcactagcctcaaggaattgggacgattgatgggacctctccaaaggcaagccttccgcaaagtgtacgggaagattctagatttgaccgcagcggaggtatttacggaagctgtcgtatccctcgcccaatactatgaccagccgttgaggtgcttcacgtttggggacatccaaatggtaccgactattgaagagtttgaggagatactaggatgccctcttggggggagaaaaccgtatcttttctccggtttttttccctccttgagcaaggttgcagctgtggtcggggattcggcaagagagttggatcgcatgaagcaaactcgcaacggcgtagtgggcctaccacggaactacttggaagacaaggcaagggatatggcgagccaagagaagtggggcccgtttgcggatatactagctttgttgatttttggggttgtcctctttccgaacgtggacggtttggtggacttggccgccattgacgctttcctcgcatatcaccatagcaaggagagtccagtggtggctatcttggcagatttgtttgatacctttgaccggagatgtgagaaaaatagtgcacgaattgtctgttgtttacccgctctctttgtgtggatagtttcacacctattccaacaaggcaccagacacccgtgtccgcttcaaagctatcgctcatgcgccgaaaaaggaagagtcgattggggccaacatttggctggaataggaggcaacgcaatcaattggtttcctcgttggaaggaaggcaaggaaggggttctcttctcatgtggggactaccctaatgttccattgatagggactacgggttgtattaattataatcccgcactcgccataagacagctagggtaccccatgagaggagcgccaaccaaagaaagtctctcgcctttccttatgagggatctaggcgcaaaaagtctcaaggtgatacaaagagtccacaaggcgtggagaagtccgttgaagaaagacaaggagcttagaggcatccgaaatggcgtcatcggtggttatcatggatggctaagagttcacacgcgagggttagattggctctccaaattgaaagttatcaatgaggagaactttgaagctccggaggaagatgaagaagtccaagctctaaagttagagctagggaaggcaagactcgccaaggagaagttcaaatcagccgctacacacatccgaaaagagtgcaccga

SEQ ID NO: 48252 - DNA, 279 bp, Glycine max
  Peptide Sequence Number=SeqID_139937
atgggttctccacctgcctccactcctcctcctcctacttctcctcctcctcatcctcctccttcggaagcatcggcttcgccgtctgccgtgaagcggacacgcaaagcctcacgtctacgatcgttgtccactagaccacctagtgctgagagaccagtggtgcatgttgatcctgctaccgggaaggacgacggtccccacaggaagaaattaagaacatatttggggattgtggcacgcgataaggtggatgtcacttacgaaaactggaagaag

SEQ ID NO: 48253 - DNA, 47 bp, Glycine max
  Peptide Sequence Number=SeqID_139938
atgaggatcaaaaggtcttttaaggttatgatggggccaaggacaag

SEQ ID NO: 48254 - DNA, 507 bp, Glycine max
  Peptide Sequence Number=SeqID_139939
atggtacaattcgctctgagtcaaggtgcaccttttgagggcaccattgttgatgactggaagtttgactattctagtcatgatgctcgccgtatggtatgtaatgaccaagctgatatgaccggtagattgctagccgaatcattaacctttgattgttgcatcatgcactatatcatagttagaattttgcttctctgttcttctaatctggctcaagtctctaaggaggacttgattttgatgtgggctttccttaccggtcgtcagaacgactgggctcactttcttaggtatcgaatgaataaggcattaggggccaatgcacctcttccgtatcctcaattggtcaccctttttctcagtcattttcaaattcctcttgatgatgaaccttttgttcaagtcaagcgatcttttgccattggtgctggtgcagtaacttcatttggttaccgtaaggatcgtgacggacagtggctaaaaaaggacactcaacctccataa

SEQ ID NO: 48255 - DNA, 372 bp, Glycine max
  Peptide Sequence Number=SeqID_139940
atggataagagcttgaaagtatgggaaaatgagtggaaggagaggggacacgaaatttatgcctccaataagggtgtagcaagcaaatgctccgtcgtcgccttcagaggtctacacgtcctcgcctcaagagggctgcatgtccttgtctttagagggctgcacgccctcaccttcataggactgcacgtcctcgccttcagagggctacacaccatcacctttagagggccgcatgtcctcgccctcagagggctacatgccctcaccttcagaggactacatgtcctcgccttcaaaggactacacgtcctcaacttcagagggctatacgccctcgccttaatgttggatcaagtggcctcagaataa

SEQ ID NO: 48256 - DNA, 875 bp, Glycine max
  Peptide Sequence Number=SeqID_139941
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcctatcagtccaccatccctcggttgaggcaattgtgggagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48257 - DNA, 288 bp, Glycine max
  Peptide Sequence Number=SeqID_139942
acttatcaaggtaatccttgtggcgtctacccagacttatcttccttcattggaagtggcgtctacccagacttatcttccttaaccggaagtggcgtctacccagacttatcttccttaaccggaagtggcgtctacccagacttatcttccttcactggaagtggcgtctaccatgacttatcttccttcactggaagtggcgtcatccaaatctctgtaacctgtatcaaacgatccattcctagtcaggttcacatcatctggtatcagagcttcggctcttga

SEQ ID NO: 48258 - DNA, 201 bp, Glycine max
  Peptide Sequence Number=SeqID_139943
atggcaaaggggtgcggaatgaccaaattttgtctccgcatgtcacatgacctcagggtcagtgcggataaccgtaaggtgtctccgcgggttaccaactcttgggtcatggcaacaaaaagcggtgtggtcgacaaaagcgaggcttttgctcctacgtatcctccaatgaggaactcagacctacgtagttctggataa

SEQ ID NO: 48259 - DNA, 219 bp, Glycine max
  Peptide Sequence Number=SeqID_139944
atggtgaatcctgataaaggggcagatccaacactggtgcagatggctcaggctaaggagatggctctggctcaggtggagtgggctctaaggcctctagaatgtcatcctgctgatcttgctgaggctcctgggctgcagaggcctcaccccctcccaaaggagaaggctggactcctggccaggccaccttctgaagaaactcctcgatgctcataa

SEQ ID NO: 48260 - DNA, 585 bp, Glycine max
  misc_feature (12)..(12): n is a, c, g, or t
  Peptide Sequence Number=SeqID_139945
atgttgttccanaacgacaagaaacctgaatgggagaaggctcaagagatcttcgccaacgatattcaaagcctatttgatgcgactgtgaaagttacagctctcaagcaatctaaccatgacatgattacacatatgggtaaagctcgggcagcagtagaagagctgagaaggtttcttgtggctgattcgttggaagaggtgaataggaaactggacaagttctacatggtccttatcttgaggagtctacactcagattttgatcatgtacgtgatcaggtcctagctggagatcaagtcccatcgatggattctctcattactaggcttctccgtgtacctcatgcgttgaaggatgaaaatctcactgatgctgtggaaacatcagccatggtggcacctcgagggagaggaggaggccgtaacagtagaggatgccgcaatggaagaagtggatgtccgcaatgcacatactgtaagaggatgggccacactcaagaaaattgttactctttgcatggcttccctgacaaagtggcacaggtatccaagtcagaaaaacctgagtctaagtttttctga

SEQ ID NO: 48261 - DNA, 219 bp, Glycine max
  Peptide Sequence Number=SeqID_139946
atgaagacccctgacgaagcaatagacttaattgaaagcatggctgctagtgacattgccatttggagagaccgtgcccatattcctaccaggaaaagtctattggagctaacctcacaggacgctctgttggcacaaaacaagttgttgtccaagcaactagagacattaatagaaacactaagttgtaggatgtacaatttgtggtggagctcatga

SEQ ID NO: 48262 - DNA, 215 bp, Glycine max
  Peptide Sequence Number=SeqID_139947
atggtgcggcttaggtcaactaacacaaagaagatacagttcactcaacgattgcctttgggttccgaactccatatggggaaggagcgttgttgtttccgagagttcttcggaaacgttctatactctggtctggagacttgcttgctcactgagcaaggaagccttatccagactcttacttcgtggctcctccgttactctcatcatggcag

SEQ ID NO: 48263 - DNA, 1080 bp, Glycine max
  Peptide Sequence Number=SeqID_139948
cagagatatccacacgaagccgttgtatcactcacccaatactatgaccagcctttgagatgcttcacgtttggagacttccaattagtaccgactatcgaagaatttgaggagattctaggatgtcctcttgggggaaggaaaccgtatcttttctccgggtttcttccttccttgagcaagattgcagttgtggtcagggattcaacgagagaattggatcgtgtaaagcaaactcgaaacggcgtagtggacctaccatggaagtacttagaaggcaaggcaagggatatggcgaatcaagaggaatgggtcccgtttatggacgtattagcattgctaatctttggggttgtcctctttccaaacatggatggtttggtggacctagccgcaattgatgctttccttgcatatcaccatagcaaagagagcccggtggaagctatcttggcggacttatttgacacatttgaccaaaggaggcagaacaatcaactggtttcctcaatggaaggaaaggaaggagtccttttctcatgtggggagtacccaaacattccgttgatagggacgagggattgtattaactacaatcccgcacttgctataagacagttagggtaccctatgaggggagcaccaacggaagaaagcctctctcctttccttgtgagagatttcgaccttaggggcattcgtaatggcatcatcggtggttatcatgaatcgatgaaagttcatacacgagggttagattggctctccaagttaaagattatcgacgaagagaactttgaagctccggaagaggatgaagaagtccgagctctaaaaatagaactcggaaaagcaagacttgccaaagaaaaattcaagttggtcgctacagacgtccagaaagagtgtgccgggttacgagaagaaaatgcagctgccgcaagagcccttgaacaagaaaccaagagtgctcgcaaggaagagcatggccgagacaaattccgtggagctttgtggggcagcaacaatgagctcaagcttcaaagggaagaaagagaccaatcacgagcacatagcatg

SEQ ID NO: 48264 - DNA, 336 bp, Glycine max
  Peptide Sequence Number=SeqID_139949
gtggaagaggagcgggacggtaaaccttcgtatttcgatatcaagcgatatgtcgaaagcaaagagtacccaccagagacctccgacaatgataaaaggacattgaggagattggcagccagtttcttcatgagcgggagcatacttgtcgcaacctacccttcggcgggagggcgacgcgtgactcgcgggatgcgtgttccacgaaaggaatacgcgcggagtcgccaccaacgtttatttgaggaaaacgtcggaaaaactgtaaaagacgcgatctacgaacttttaagtgaaaggttcgggagttgtatttacgcacagggaaggtattag

SEQ ID NO: 48265 - DNA, 887 bp, Glycine max
  Peptide Sequence Number=SeqID_139950
atgaaaagagaaattcatgcctcctatagtagtcataactcttgcaagagcctaagtgaagaacttcgtgactattacgaaggaaggcataggtcacatcttagacctcactcccataggagagaaaaggaaagaaatcctcaagaggctaacattaacctcccaaacttccatgggaaggacaataaagaccaaggtcaaggaatcttaggggtgagaccttctaagcccaaagatgataaggggaagataatagaaaagcaaccccttaaggctagtatgcaagagaagactagctccatgaagtgctttaaatgtcttggaagaggacacattacttctcaatgccccaccaagaaaaccatgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagattaaatccttgtgctttgttggtgcccaaaataggtattattaggcaccaaatccctaaaataggtggtgtgatgaatgctttgggtggtgcaacactcgtttgtaaaattactcatgcacccaacatcttcatgatttgtgtacatagggactcattaggtag

SEQ ID NO: 48266 - DNA, 576 bp, Glycine max
  Peptide Sequence Number=SeqID_139951
atggagagaagtatgatagatgctgccagtggtggagcccttggagacatgactcctgctgaagccagaaatttaattgagaagatggcttcaaactcccagcaatttagtgccagaagtgatgctattgtcattagaggagtgcatgaagtagccacgaatttattgtcattattcgagactaagaagcttgaaggtaaactagattccttggttaaccttgtaacccaactagccatgaataaaaaatgtgcacctgttgccagactctgtggtttatgctcctctgccgaccaccacacagacctttgcccttctgtgcaacaatctgaagcaattgaacagcctgaagcttatgctgcaaacatctacaatagacctcctcaacctcaacagcaaaatcagccacaacagaacaattatgacctctccagcaacaggtacaatcccgggtggaggaatcatcccaaccttagatggtcgaatccttcacaacaacaacaacaacaacaacaaccttattttcaaaatgctgttggcccaagcagaccatacgttcctccaccaatccaatag

SEQ ID NO: 48267 - DNA, 709 bp, Glycine max
  Peptide Sequence Number=SeqID_139952
atggctccgagaaagatttccgcaaagagatctaggaaggacatcgtagttgaagggaccagttctgcccccgagttcgacagccatcgtttcaggagcgctgagcaccagcagcgtttcgaggccatcaaaggatggtcattccaccgagagagacgcgtccagctcagggacgatgagtacaccgacttccaggaagagatagctcgccggtgttggacgttgctagtcacccccatggctaagtttgacccagagatagtcctggaattttacgctaatgcttggcccacggaggagggcgtgcgggacatgcggtcatgggtaaggggtcagtggattccttttgatgcagacgccctcagccagttcctgggagacccactagtgttagaggagggccaggagtgcgagtatagtcagagaaggaaccgggctgatggatttgacgaggaggccattgcccagctgctatgcataccgggtcaggattttgcccggacccctgccgggagacgggtgcggatcatgcgcaccagcatgactaccttgacccagacatggatgacgttgctgctcagcaacatcctgcccagcgatcataattccgacctccctctgtcaaagtgtcagctggtgtatgccatcctgacacggatgaccattcatgtggctcagttgatcgctgacgccatttatttatttgcag

SEQ ID NO: 48268 - DNA, 216 bp, Glycine max
  Peptide Sequence Number=SeqID_139953
atgcttccatttgatttccggtcacaggttgtaccttgtgtggtgaagctcatgagacaggctaatgcattcccactaacgataacactcaagaaattcatttcatggggaatcagcagaggcaagggtacactcaaggaggattttcaggcttccagcaaggtccttataattagcatggacagtggaggacacaccctggcaaccagttcataa

SEQ ID NO: 48269 - DNA, 192 bp, Glycine max
  Peptide Sequence Number=SeqID_139954
ataccaggagggttgaacatttttgttcttcccttccctccttcccctacttatagggaaaagaaggagaagcttgccacccagctcgcccaggcgaattcagctcgcccaggcgaactcagctcgccaaggcgagctaggttgcttcctccagaaggcaccgccttcaggagaacttctaggaaggcctaa

SEQ ID NO: 48270 - DNA, 207 bp, Glycine max
  Peptide Sequence Number=SeqID_139955
atgactaatgcaaattgtccgcgagagtcattgcattcagtctcaaatgggaatctaagattatggaaatctatccactattgctttaagtctgaaggaccctcaaaaatagataatatatgtgcgagagccaaagggcaggaagatgaagacaatctctggacattgtgttccggtaaaagacatattagtttcgaaagcagctaa

SEQ ID NO: 48271 - DNA, 170 bp, Glycine max
  Peptide Sequence Number=SeqID_139956
aatcgagagatctcgctaaaatgactcttgcaactctttttggaaagcttccggaacatgaagtggaacttatgagactaaacaaacatgaagaaaattacaagaaaaagaaaggaattgcacttaaagcctcatcttctattcaagaaaaagtgataaagaggacttga

SEQ ID NO: 48272 - DNA, 423 bp, Glycine max
  Peptide Sequence Number=SeqID_139957
atggcttccaactcccaacagtttagcgccagaaatgatgctatagtcattagaggagtgcataaggtagccacaaactcatttgcatcatctaaaactaagaatcttgaaggtaaactagaggccttgacctttgcccttcagtgcagcaatctggagcaattgaacagcctgaagcttatgctgcaaacatctacaatagacctcctcaacctcagcagcaaaatcaactacaacagaacaattatgacctctccagcaacagatacaattccggatggaggaatcaccctaatctcaaatgatctagccctcaacaagaacaacagcagcctgctccttccttccaaaatgttgctagtccaagtagaccatacgttcctcctccagtgcaacaacaacaacagcaacagcaacatctga

SEQ ID NO: 48273 - DNA, 346 bp, Glycine max
  Peptide Sequence Number=SeqID_139958
caatctctacgcgagctccaaactcgaaggtggaggacacaagaacgaaaacgcaattcgtcgggctccgaaaagattgagaatggagaattgcactaagcaatcactacgcatagctccaaactcgaagaattggacaattgcactaagcaatcactacgcatggctccaaactcgaaggtggaggacacatgaacgaaaacgcaattcatggggctccgaaaagaagggtggaggacacatgaacgaaaacgcaattcatggggctccgaaaagattgagaatggagaattgcactaagcaatcactacgcatggctccaaactcgaaggtggaggacatgtga

SEQ ID NO: 48274 - DNA, 615 bp, Glycine max
  Peptide Sequence Number=SeqID_139959
atgagatgccctctcaaagagtcaacctcttgctttcttgtaaggttaaagtcctttggtacttatacctattggctcgccttcagaggactgcatgtcctcaccttcagagggctacacgccctcgccatcagaggactgcatgtcctcaccttcagagggctacacgccctcgccatcagaggactgcatgtcctcaccatcagaggactacacgccctcacctttagaggatcacacgtcctcaccttcagagggctacacgccctcgccattagagaactgcatgtcctcaccttcagagggctacacgccctcgccatcagaggactgcatgtcctcaccttcgtagggctacacgccctcacctttggaggactacacgtcctcgccaacagagggctgcacgccctcaccttcagaggactacacgtcctcgccttcagaggactacacgtcctcgccttcaaagggtcatgtaccttcacctttgtagggctacacgtcttcaccttcaaaggacttcatgtcctcgcctttagaggactacacattctcaccatcagaggactacatgtcccccattttcaaagggggacatgccctcacctttag

SEQ ID NO: 48275 - DNA, 234 bp, Glycine max
  Peptide Sequence Number=SeqID_139960
atgaacctgcacggacaagtgatcgaggtaacgtcatccgaggaagaccctgaggaggatcctgaggagctacctcctgagcctgctgtggacgctcttgactttctagagggcgatgaggacccacttcttgaggtggattctcccgaggaagccatgtcggcatctgaggcagactctacggaggatagtggcccgggggagatggcgatcagcggaggctcttcatcatag

SEQ ID NO: 48276 - DNA, 153 bp, Glycine max
  Peptide Sequence Number=SeqID_139961
atggcgcagaagaaggcttcaacggcgacgacgaagacgatggatagaaggagaaagggcgcaagagagaggcgaggattagttttcgtgaaaccaatgtcgttttgtgatttcaagaagggttttgagaagattgtcattaaaaagttgtaa

SEQ ID NO: 48277 - DNA, 237 bp, Glycine max
  Peptide Sequence Number=SeqID_139962
atgaattcattgcctagcgcttttcatgtgtcctccaccatcgagtctggagccccgcgaattgattacctagctctgttcgccagttctccattctccacatttattcggagacccatgaattcattgcctagcgctgttcatgtgtccttcaccaacgagtctggagccccgcgaattcattgcctagcgctgttcgccaattctccattctcaatcttattcagagacccatga

SEQ ID NO: 48278 - DNA, 192 bp, Glycine max
  Peptide Sequence Number=SeqID_139963
ggccagggtttcactgcttttgcatgccctactccagatcagtttagggttgaggtcgcatggcccagagattggcccgaggaccagacggaggaggcacctacaggagctcccaaagatgcagaggacgcccgcatggatgaggagatgacagacttgctcagcttcttgggaagaagcggagccacgtga

SEQ ID NO: 48279 - DNA, 292 bp, Glycine max
  Peptide Sequence Number=SeqID_139964
atgaggtctaacagtgttaggggtgaacccatagacaacctcaaaaggggactgcttggtggttctatgaacccccctgttgtaggaaaatctttacatgaggaagatactcatcccaagacttatgagaaaagaagtttagttcctagcttagcccataaggttttccagaaatggctaaggaacttagcatctctatctgacacaatggtcctaggcaaaccatggagtctcacaacttccttgaaaaagagttttgagatgtgggaagcatcatccaccttgtggcatg

SEQ ID NO: 48280 - DNA, 327 bp, Glycine max
  Peptide Sequence Number=SeqID_139965
atgggggagacacatgaaattccccatcacaatctagccgacttcgagccttgcctcggatatgccactgaagggcaagcagttggtggtatacccatgccaaacactttggagggccctcagtttcgcccacaaccacaaccacaacccttgcattttgcagtgggaagagcccctcctgctatggctgaaaagggagagttggatcatatagaagaaaggctcaaggacattgaaggaggcgaagattatgcctttgctaatctagaagagttgttcctagtacccgaacatggtcattcccaagttcaaggtgccaaactttga

SEQ ID NO: 48281 - DNA, 285 bp, Glycine max
  Peptide Sequence Number=SeqID_139966
atggagagaagagtgcatgaagtagccacgaattcatcttcatcagctgaaactaagaagcttgagggtaaactagatgccttggttaacctagtaacccaactggccttgaatcagaaatctgtacctatcgcaagagtttgtggtttatgctcctctgtcgaccaccatacaaacctttgcccttctatgcagcaacctggagcaattgagcagcctgaagcttatgctgcaaacatttacaatagacctcctcaacctcagcagcaaaatcagccacaatag

SEQ ID NO: 48282 - DNA, 719 bp, Glycine max
  Peptide Sequence Number=SeqID_139967
tggctgaggagtccgaaccacaaggactggattggctcccaaatctaaagactgtgagagacgatgaggttaaagcttcgaaagaaagtgatgaggtacaagccctaaaggcagagcttgaaagagcctgggtagtcgaagagaagttcaaggcagcaatagtgagctcaagctccgaagaggtgaaaggaatcaacacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaagggaaagggccaaagcagttggtggacacggcatgactttctcgccttccacgaggaaatccacggacttcgtcagctatctctctatgtggggctggtttcacacctttttctccaagaaggtaggcccgtctatccgctacaaggaaggaagaatcaagattctatcttcatgcgaaggatgtccaaatgttaccttgatgggaacaaggggttgtattaattataatcccgttctcgccataagacagcttggctaccccatgagaggagcgccattagacgaaagcatcacgcctttcatcgcacggggttttagtgaccacaacgcgagggtactccaaggagttcgcaaggcatgggatgcggcgtga

SEQ ID NO: 48283 - DNA, 441 bp, Glycine max
  Peptide Sequence Number=SeqID_139968
tgcttggccttgaagagcaaggtccaaggcttgatagaagccggatggttgacgtttcaagaggacgagcccaacataaagacaaaccatcttgccaatcatggagggggagctgttaatgccatcgaggtgagtaggtacgcccctttgggcggtaggaaggaagaagctaccgacatcggctcactatcagccaaagtaacccacatcaccgagctgagcggcataacccgcagcggttgcgtgttcacacctcctagcctgccaatgcagcccgcaaacgctaaagggaaaacaaaggtgaccgaaggacaaaatgtcaaagtgatccccgcatcggacgaggatgttccgacgaaggaatttgtcgtgggaagagaaggctgcggcaagaaagaggtatcactcgaggaggccagcgagttcctccgcattatctaa

SEQ ID NO: 48284 - DNA, 221 bp, Glycine max
  Peptide Sequence Number=SeqID_139969
atgtcattgcctagcggtgttcatgtgttctcccttatcaagtgcgaagcttctggtgctgggaagcacaagaaaaaaaaagaagaagtagagatgagagtcgacattgcgaaaagggcaggacggacgaaatcagtgtcttatctttgctttcctcttatctccgatgagaggcttgcgtgttccgtgaaattcggtaatgtggcggaagtcgaaaagag

SEQ ID NO: 48285 - DNA, 208 bp, Glycine max
  Peptide Sequence Number=SeqID_139970
atgtcatccacattgtccttgtcggctgcaagatcgacatggaccactggtctctctgccccaagtagtctagttgccaatgatcatagccgtgtggctttgcgtgtctgcttcaaggtagacggagactgtgatggtactgcaagaggaagaggaggaggagaaggaggaggaggaagaggaggcgaggcagtgagtatcatgagct

SEQ ID NO: 48286 - DNA, 606 bp, Glycine max
  Peptide Sequence Number=SeqID_139971
atggcatccttcagccagcttcagttgcagatgcaatctcagggacttgcagttcctcctgagcctctggttggtccctccggtcctcgagtgagcacaaaggggagttgtgttgatccctcaggaaacgatcttgagacgggtgactctgacaggtggggcttgtacatagaagcagatcttgcccgcttggttgccatggggagagtttatgagggatccactgttgttcataacactcctttgttgcctggccaagtaaagatgagtgtggaggaggttacagatgcagatgctctagttcctgtacccactgatgaggtttccttagtggggcaggcacttcacaccttccttgcttggccaacacatctggtcaagtctttatcacagcagcccaatccggaggtcgatgatccgctttatctgatgacattgaccatcccagagcttttcttgaggccttatcaggctatatgggatgccaccgtgttcggggtcgttaatccagatttccccctctacataaagcacgaagacctctccgaaatcgcacacggtggtcaatgtctcagcatatcagtgttacagttatggattctgtaa

SEQ ID NO: 48287 - DNA, 600 bp, Glycine max
  Peptide Sequence Number=SeqID_139972
gatctaacagtctctatccgaggggctaggagagcaagggcaaggccaattgaggctccttccacatctgcagctcctcctccagcacataccttagtagctccttctaccctatcttctacagactttcaacatcttgaagccatgcttcaaagcatacatcaggggcagattgttttattacaaagtttacagctggtagcacctccagactctatcccttctgttgaacaatttaatgaatgggtagcctggcctgagactcagcctccccttcacagggaggatgaaggtctcaccgctcaggatgagtcatctgatacttccactccagagcccctgatcagatggaaaaggatagttgaaacacaagaagttgcagccacttctgagaaatctcttgaggccacttctgagccttcagaacgagtggtagatacaacttcaattcagcaggcagtagacccctccactcttgaggatcaaaatacaccggtcctgtctccgaacacctctcctctagctacccccgtgcttcacttaacagatgaggaggatgttcaaacactagatactcaggacagatcacaggatttttaa

SEQ ID NO: 48288 - DNA, 111 bp, Glycine max
  Peptide Sequence Number=SeqID_139973
atgttgtacttggaatgtgatccaattccagaagttgttgaaaatgaggatgatttagatgatgtacctgttgctggccatgaggaagatgttggtggtggagagagagag

SEQ ID NO: 48289 - DNA, 147 bp, Glycine max
  Peptide Sequence Number=SeqID_139974
atggcaatcaattcatgggactccaaacttgatggtggaggatgcatgaatggcaatcaattcatgggatttgatggtggaggatgcatgaacaacactaggctatcaatttgtgtggctccggactcgatggtggaggatgcatga

SEQ ID NO: 48290 - DNA, 644 bp, Glycine max
  Peptide Sequence Number=SeqID_139975
ttaccctcaccgttgagaggactacacgtcctcgccttgagaggactacacgtcctcgccttgagaggactacacgtcctcaccatcagagggctgcgcgcccttacctccagaggactacatgtcctcgccttgagagggctacacgtcctcaccttggagggctgcacgccctcacctctagaggactacatgtcctcgccttgagagggctacacgccctcaccttgggtactagttaccctcaccgtcagaggactacacgtcctcgccttgagaggactacacgtcctcaccatcagagggctgcacgcccttaccgtcagagggctacacgccctcaccttgagaggactacacgtcctcaccatcagagggctgcacaggggcatgccctcaccttgagaggactacacgtcctcaccatcagagggctgcacgccctcacctctagaggactacatgtcctcgccttgagagtgctacacgccctcaccttgggtactagttatcctcaccaccagagggctgcacgccctcacctccagaggactacacgtcctcgccttcaaagggtcatgtgccttcacctttgtagggctacacgccctcaccttcagaggactacacgtcctcacctttag

SEQ ID NO: 48291 - DNA, 384 bp, Glycine max
  Peptide Sequence Number=SeqID_139976
atgggaacaaatcaaaccggcaagaggttttaccaagtcaaggttaaaagcctagataccaccagcatcaaggaattagggcggttgatggaacctctccaaatgcaagccttccgcaagacttacggaaagatcttagagttgaccacagcagaggtatccatagaagctattgcatcactcacccaatactacgaccagcctttgagatgcttcacgttcggagacttccaattggggaagaaaaccatacctttcctccgggtgtctcccctatttgagcagaattgcaactgtggtcaaggattcagcaagaggtttggaccgcataaaacagactcgaaacggcatagcgggcctaccacggaagtacctagaagataa

SEQ ID NO: 48292 - DNA, 633 bp, Glycine max
  Peptide Sequence Number=SeqID_139977
atgaagaaaaaagatacaggccatcaaagtgtgtcattggagaataagataggagattcaactgtgctgaagatcgaaaattctgctaaagttgtgataaaacaagacatgaaaggaagaatacataaatatgggtttaacaacactaaacgtgagaaggcagagaaggtaagggtggtggatgatgaaactggtgacaaacatcagctggatgaagtcctaaggatgccatgtggcaccttgggtgtcttgtatgtgatgtccacagtacctctgatcatgggttctacacctgcctccactcctcctcctcctcctccttcggatgcatcggcttcgccgtctatcgtgaagcggacacgcaaagcctcatgtggacgtcacctacaagaacatatttgggaggatattcaggcggaatttgatatcctagaggcttctgacagtaggacgaaaaggaagttactgcagaccgtgggggagagatggaggcagtttaaatcagacctgacaaggaaatgggcccttgcagtcgatcaggacggtgtcgaggacactgtctatgagaaatacgacatcaacaaggaaaaatgggcccagttttgccagacacgcagagacccttcttgggag

SEQ ID NO: 48293 - DNA, 138 bp, Glycine max
  Peptide Sequence Number=SeqID_139978
atgttccctcatgggaagatgcccaagaaagggtgtcgagggaagaagcctagagtatcaagaacctctggatttgaggtcaaatcttttcaagggggaggggatgatgcaatcctacctcccaagggtattggatag

SEQ ID NO: 48294 - DNA, 459 bp, Glycine max
  Peptide Sequence Number=SeqID_139979
atgaagaacacaaaaacaaaaacaaaaagagagacaaaagagtatagcgtaactggtcggcgccgaaattggtggctgcggcgtggatcttgtggtcttgctcaaagagcgccgactacgaaatatctgaagcacctcgtttttggagaaaagggaacgaaaaatatgaagcaccttgtttatggttcagcttcttgtggcggcgatcggccaagctcccttgtcgtggagcttggtgtcccagtgatggtttgggaagaaccatcgtcggggttcttggcgaggaggaacgggaccgtggagaggatgtacttgaggaggcactgcctaatgcaatttgccgctgccgtcgttgggtggaagtggtggtgcctgcgactgcaccatttcaaaaaccctagaggagctgaggagtccaagaaggagaatgagagagcaacaatcagagagcgcaaataa

SEQ ID NO: 48295 - DNA, 573 bp, Glycine max
  Peptide Sequence Number=SeqID_139980
atggtgaacaacaagttcaaccacttcattatgaccaaactggccgaagcgggtatcccgactcagatggaagcgttgctgtccgatacggaatgtctggtgaaaaaactggatatggttccggttgagtgcgttattcgtaaccgtgcagcgggctccctggtgaagcgtctgggtattgaagaaggtatcgaactgaatccaccgctgttcgacctgttcctgaaaaacgatgccatgcacgatccgatggtcaatgattcctactgcgaaaccttcggctgggtcaataaagagaacctggcgcgcatgaaagagctgacctacaaagccaacgacgtgctgaaaaagctgtttgacgatgcgggcctgatcctcgtcgacttcaagctggagttcggtctgttcaaaggcgaagtggtgctgggtgatgagttctccccggacggtagccgcctgtgggacaaagaaaccctggataaaatggacaaagaccgtttccgtcagagcctgggtggcctgattgaagcctatgaagcggttgctcaccgtttaggcgttaagctcgactaa

SEQ ID NO: 48296 - DNA, 459 bp, Glycine max
  Peptide Sequence Number=SeqID_139981
atggacgaagatcaatggacgtatgactatacaatgtcacaagaagttcatatggattatgataatgaagaagaatgtggtgtggatcaaccacatgttgattgttcgaatgcgtttaatacctgtcaggtctttggtactcgagataatgttttgcagtgggctcaaacagttgcccatgaaaaaggatttgttgcagtgattatgaggtctgacatagatactggtagcagaggaagaagttcatttgtgttaattgggtgtgaaaggagtggtctgcacaagtgtaggaataatgaatttgttagaagagacacttggagtaagaaatgtggttgtcccttcaggcttcgtgagaaaccagtgcatggaagggaaggttggatggtgaagttgatttgtaggattcacaatcatgaattggccaagtctttagttggacatccatacgttgggtga

SEQ ID NO: 48297 - DNA, 198 bp, Glycine max
  Peptide Sequence Number=SeqID_139982
caccactcattgagttggtgagaaaccatgttccttcatgggaagatgcccaggaaatgggtgttgagggaaggagcccagagtatgaagatcctcgggatttaaggtcaaatcctttccaagggggtgagcttagctattatagggggaatcttcttaaggaagcctctcaaggaggtgagcttagttatgagaggg

SEQ ID NO: 48298 - DNA, 333 bp, Glycine max
  Peptide Sequence Number=SeqID_139983
atggagttgcaaagactaaatcaacatgaagaaaatgataagaagaagaagggaattgctcttaaagcctcaccttcaatccaagaggaaagtgacatagaagattcaattgacttagatgaagatgaagatcttagcctatttgtcaaaagattcaacaaatttattagaataagaggaaatcaaagaagacaaaacttcaaacctaaaagaagaactgaagagtcatctcaaattccaaaattctttgaatgcaatcaacccggacatctgagggctgattgtccaatttttaagagaaagatagagaagtctgaaaaagaagactattag

SEQ ID NO: 48299 - DNA, 1132 bp, Glycine max
  Peptide Sequence Number=SeqID_139984
atgattcctggttcagcccctgttcctgaaaaactggttcccaagagacaacatggagtgaagacttctgaaaaccctagccttgcaacaagtcctagggaagtagacacggagatggataagaaaatccgcagtattgtgagtagcattttgaaagatgcttctgtccctgatgctgataaagatgttccaacatcttccaccccaaatgtttctgtccctgatgctgataaagatgttccaacatcttccaccccaaatgctgaagtcccctcttcatccagcaaagaggaatcaacagaggaagaggatcaagccacagaggaaacccctgcaccaagggcaccagaacctgctccaggtgacctcattgacctagaagaagtagaatctgatgaggaacccattgccaacaagtctggacgaatcaaaactatggcacagaagaagagcacaccaatcactcctaccacatccagatggagcaaggttgcaattccttccaagaaaaggaaagaaatttcctcatctgattctgatgatgatgtcgaactagatgttctcgacatcaagagggccaagaaatcagggaaaaaggtgcctggaaatgtccctgatgcaccattggacaacatttcattccactccattggcaatgttgaaaggtggaaatttgtatatcaacgcagacttgctgttgaaagagaactgggaagagatgccttggattgcaaggagatcatggacctcaccaaggctgctggactgctgaagactgtcaccaagttgggagattgctatgaaagtctagtcagggaattcattgtcaacattccctctgacataacaaacagaaagagtgatgattatcagaaagtgtttgtcagaggaaaatgtgttagattctcccctgctgtaatcaacaaatacctgggcagaccaactgaaggagtggtggatattgctgtttctgagcatcaaattgccaaggaaatcactgccaaacaagtccagcattggccaaagaaagggaagctttctgcagggaagctaagtgtgaagtatgcaatcctgcataggattggcgctgcaaactgggtacccaccaatcatacttccactgttgccacag

SEQ ID NO: 48300 - DNA, 471 bp, Glycine max
  Peptide Sequence Number=SeqID_139985
atgttgctaagtagcaatgtcatctatatctgtgtaagagtggtcatgttggtgcgcatgatccgcactcgtctctttgcagcggcacgggtgaaatcttgccccggtatgcatagtagccgtgtgatagcctccctctctggttgtgctcgcacagttggccctcctccaaaggcggtacctcaaggacagagggcgcgttactctcttaaggtgcggacatgtggagtcacatctgaagatgaggacccctctgaagatgcaggacagtgtagtcctcggaaggtgagggcgtgtagccctctgatggcgaggacgtgtagtcctttgaaggtgagggcgtgtagccctacaaaggtgaaggtacatgaccttttgacggcgaggacgtgtagtcctctcaaattgaaggtacatgaccctttgaaggtgagggtacagcctctaaggggaggacgtgtagtcctctag

SEQ ID NO: 48301 - DNA, 486 bp, Glycine max
  Peptide Sequence Number=SeqID_139986
atggcccgagttatgttggggaacggttacgaacccggaatgggtttaggcaaagacaacaacggcataactagcctgataaatgccaaaggaaatcgtgggaagtatggtttaggctataagcccactcaggcagatataaagagaagcatcgcaggaaggaagagcggtagtcaaagctcgcggttgagacaagaaagtgaaggaagctcgccctgccacataagtagaagctttataagcgcgggtctgggggacgaaggtcaagtggtcgcaatacacgaagatgatgttccgagtacgttggatttggtacgaccatgccctcctgatttccagctgggaaattggcgagtggaggaacgccccgacatttacgcaacgagcataatatccgatgacgagtcccccgaaggtactaatacctgggacccgcctatcaacttcgagcaagaaacgaatcaaacggaagatgaaagggaatga

SEQ ID NO: 48302 - DNA, 106 bp, Glycine max
  Peptide Sequence Number=SeqID_139987
atgccaacgtcatcacgtcgcctcggagactcctcaccagaatcttactccccgtaccctgctgctgtcattctgctcccacgaacaatgttcgtgatcatcacag

SEQ ID NO: 48303 - DNA, 950 bp, Glycine max
  Peptide Sequence Number=SeqID_139988
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggcctgctgcccgtgggcacggacatcgactacgagggcgtgggcaccatgtccaagtccaagaacaacggcatcgatccgcaggagctgatcgagaagtacggcgccgacaccgcacgcctgtacaccatgttcaccgcgccgcccgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48304 - DNA, 501 bp, Glycine max
  Peptide Sequence Number=SeqID_139989
atgagtgaaatagaggaggcacaagagcatatgatggctgacatggaggccatgaaagagaaaatgaccacaatgatggaagccatgatgagtatgagaaggatgatgggggtcaatgcggctacaattgttcccacaagtaccaccacagaagtggacccgacccacccacttggcttcaatcaagttcagaacaaacattccttcccactagatggcttgccttccaactatgcaccacccaatgttgcacacactcttgatgagaatgtcgacaacttcgtacccatacccattgagagccaacaaccccaatctgatcatgcacatgtctctcaacccatgggggagacacataaagcaccccgagaccacaatctagccgatttcgaacctcacctcggatatgccattgagggccaaacagttggtggtgtacccctgccaaacactttggagagccctcagtttcgcccacaaccacaacccttgcattttgtg

SEQ ID NO: 48305 - DNA, 888 bp, Glycine max
  Peptide Sequence Number=SeqID_139990
gagcgctacccggaggtggtgaaacagatcctgacgtcaccgcagtggcagccgatcgacgcggtgaagaataagcgggtctacctgatgccggagtacgccaaggcctgggggtatcccaatgccggaagcgatggcgttggcgttttgccgatatcaatctgcagcagcgggtcgacgcttactatcaacgttattaccgcgccacctgctgccagagcgggcaatgaggctgggctggctggcattgttgacgctgtgctgcgcgctgttttcgctcggcgttggccgctttcaggtgccaataacgcacagcctgatgattttgctggagccgttcaccgggcagcattatgccggcatcgatgctatccaacgccaggtgatcctggttgtgcgcgtgccgcgagtgctgttggcgatgggcgccggcgcagcgctggccctgtgcggcgcggctttgcaaggcgtctttcgcaacccgctggtcgacccgcatatcatcggcgtgtcgtccggcgcggcctttggcggcacgctggctatcctgctcagcctgccattggcggcgctgctgctgtcggcttttgttttcggcatggcggcgctgctgctgattttcactctcaccagcgccattgcgcggcgcaatattctctctttggtactggcgggagtgatcctcagcggcttcttctcagcctgcgtcagcctgatgcaatatctggcggataccgaagagaaactgccgagcatcgtgttttggctgctcggcagctttgccaccgccgatcggcaaaagctgctgatgctgtttgtgcctttgctgttggccggcggcttgctgttggcgctgcgctggcgcatcaatctgctgtcgttgggtga

SEQ ID NO: 48306 - DNA, 276 bp, Glycine max
  Peptide Sequence Number=SeqID_139991
atggcgtttttcctaagctacttggactacaaggctcaaaacgcacaagtgagcaatggtctcaggaacggaaacgtcgcgcacattacagacatcttctcaaagatcccaacgggtacaagttttataataaccagggcacaaaattccacagcacaccacaatgcctatttcaggaaaaaagctctggaggcagcaagaggatcagcttttgcagagatacctaggttttataagctcattattgttagggttttttctgtaatgactagctaa

SEQ ID NO: 48307 - DNA, 429 bp, Glycine max
  Peptide Sequence Number=SeqID_139992
atggctgtggtcctggaagcagggaaaattttttctaagaatactctcttaaggtcatcccagctcgtgatggaccttggagcaagttctgggggtttgcatggtggagagcaatatgaaattccttcaaatgttgtggatcttcacctgcaagccatgaaactttggaagcaagaaggagctgaatcaggttgcagccatttcctagctgctcgaggtgaggaggattgttgcatggaagggcaaatgtctgtatggtggtcagcagaggagcacaaaccacagaacccttgcgacaggagtcatgtctccaagggctacaccactggcagcatctatcatacttctctccatattgctgagtccttcataaaaatattggagaagaagctgctccgaaatctgatggtgagggcaactggcacatag

SEQ ID NO: 48308 - DNA, 420 bp, Glycine max
  Peptide Sequence Number=SeqID_139993
atgaagaacaaacgacgaatgttgaagaacggtcgagaatcttcgcgtaattactcacggaaacgttacggaagcgcctcggcttggattttcttcacggaacaaactagaggaggagcttgccacccagctcgcccaggcgagcaaggttgcttcctccagaagcaacagcctcttggaggaagaatctggatggcccaactttcgaagaagttacgaaaactcacggactgggcaaaaacacctcttttcgatttccgccacattacggaatttcacggatcgctcaccggaggctccgcgcttgataacggaggatacatgaacaacgctaggcaatcgattgatggggctccgaataggacagtggaggatacacgaacagcgctaggaaatcaattcgtggggctccggacttga

SEQ ID NO: 48309 - DNA, 1026 bp, Glycine max
  Peptide Sequence Number=SeqID_139994
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctccaaacacaatgatggcttgtgtagacataaaatcaatgcatactctgtgagtcctgttgcaccagtcaatcaaaaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgttatggccgcgtttgtctcattccacgcctgacactcagttccgg

SEQ ID NO: 48310 - DNA, 231 bp, Glycine max
  Peptide Sequence Number=SeqID_139995
atgtcgcgggggtcagaagaccttggggatgtcaggtggggtgctatgcccaaaaccaagcttgaccaatcccgacccaacccgggcatagtcaatcagcttgaaaacgagataaggaagctaggagggcttctggtaatcgattaccaggctcagaaatgggactggaatgttgaaggggcctctggtaatcgattaccaggctgtgtaatcgattacacagaggaataa

SEQ ID NO: 48311 - DNA, 216 bp, Glycine max
  Peptide Sequence Number=SeqID_139996
atgctaggttacagtgtctgcaaagttggcttagctggcgagcccgctaagcctaagctaatagggtcgctcagctcagcagatgccgcaaggaatttcgcttggcgcaggagaccctggcttagcgcgcggccaatcaatcaaaaaaatttactaagttacctgggcttagcgaatcagcctcgcttagccacagatactgtaccaggcggataa

SEQ ID NO: 48312 - DNA, 441 bp, Glycine max
  Peptide Sequence Number=SeqID_139997
atgccgtatgtggaagccgtagaggagtcgttggaaacaactttccaatcctttgaggtggtaagcaacgcctccgtagattccctcccaaggcagcctcgcctgtctggcgcggcaatgatggtggcccgggtgatgttggggcacgactacgagcccgaaatgggtttgggcaaggataacggtggcagggccgacctagaaaggaagaacaaaggccaaggcccgcggtcagaacaacaagccaaagaggttccaccgtgccacatcagtagaagcttcgtgagtgcaggtttaaagcacgaaggacaagtggccgcaatatgcgatgaagactccctgaggaggtcgaatttgatacagctatgccctctcggcttccagctagggaactggcgggtggaggaatgccctgaagtttacacaagaagcataatgtaa

SEQ ID NO: 48313 - DNA, 696 bp, Glycine max
  Peptide Sequence Number=SeqID_139998
atggagaggagtatgattgatgctgccagtggtggagctctcggtgatatgacccctgctgaagctaggaatttgattgagaagatggcttccaactcccaacaattaagtgcaagaaatgatgctattgttcttagaggagtccatgaggtggccacggattcatcttcatctactgaaaataaaaagcttgaaggaaaacttgatgccttggtcaacctagtaactcagcttgccatgaatcataattctacacctgttccaaaagtctgtggtctgtgttcttctgcagatcaccatatagatctttgtccttctttgcagcaatctagagtcaatgagcaacctgaagcttatgctgcaaacatttataatagacctcctcaacagcaaaaccaacaattgcagaataattatgacctttcaagcaatagatacaatccaggttggaggaatcatctaaatctgagatggacaagtcctccacaacaacaacagcctgtccctcctttccagaatgttgctggtccaagcaagccatatgttcctcctccaatacagcagcagtcacaacaaagacaagcaactgaggctcctcctcaaccttccttagaagagttagtgaggcaaatgaccatccagaatatgcaatttcagcaagagacaagagcctccattcagagtctgacaaattag

SEQ ID NO: 48314 - DNA, 629 bp, Glycine max
  Peptide Sequence Number=SeqID_139999
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgattcacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48315 - DNA, 396 bp, Glycine max
  Peptide Sequence Number=SeqID_140000
gtgcggcttgtacatagaagcagatcctgcccgctggttgccatcgggagagtttatgagggatccactattgttcataacactcctttgttgcttagccaagtaaaggtgagtgtggaggaggttagagatgtagatgctccagttcctgtacccactgatgaggtttccttagtggtgcaggcacttcacaccttccttgcttggccgacacatctggtcaagtctttatcacagcaggattcctttgaggagcaggccacacagggatccttcatcccccatggacgtcaggatgttctcgctgctgctattggacgtccagagcaccctggatgtgtccgtgctgctggagtcggtgtcaccattaagcaatactttggatcggctccatag

SEQ ID NO: 48316 - DNA, 854 bp, Glycine max
  Peptide Sequence Number=SeqID_140001
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatttttggattgcaaagggacgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48317 - DNA, 540 bp, Glycine max
  Peptide Sequence Number=SeqID_140002
atggctgatgtcgtcgtcgcgcggggccaggggttgcacgcccaggctcagctcggcatcgacctggatgggttgcggatcgactttttcgtgctcaaggatgcccaggttggcatcaaagcgcaaaccggtcagcgtcaggatctgcgtgccagtcatctgggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 48318 - DNA, 180 bp, Glycine max
  Peptide Sequence Number=SeqID_140003
gcatctcactgaaacatgtatgcgagcggggaattctgatatctatggattccttgagcctcagtccattcagagcggacattggcagatggtgatcatcctgcccaaggaacacttagttgtctggttttgttcattgcataacaggccagacaactaccttaaggggattattaatag

SEQ ID NO: 48319 - DNA, 192 bp, Glycine max
  Peptide Sequence Number=SeqID_140004
atgcagaagcttcaagaaaaggccaaactctcctccaaaatctgcgcgtgcctttctcgctcagcggatggactgaagcagcgcactttgctggatgaccctttgcttagcgcaaatgcacaacttatcattcttccagattcttcctcacgctcaaccgaggagtgttgcgctcagcggatggttcgctaa

SEQ ID NO: 48320 - DNA, 195 bp, Glycine max
  Peptide Sequence Number=SeqID_140005
atggaagaagaattctctcttcaagagaagaatattacaatgaagatcatacatatggtaatctattacatgttgaaaattcaaattcaaaacctttttcaacagctatttctcaaccctgcttcgggtaatcgattacacttcctggtaatcgattaccagagccttgcatgtcttgaaagcactttgttttaa

SEQ ID NO: 48321 - DNA, 86 bp, Glycine max
  Peptide Sequence Number=SeqID_140006
gcctacttgggccttctagaatgttccaacagaaggcagtgccttctggtggaagcaactcagctcgccagggcgagctgtgttag

SEQ ID NO: 48322 - DNA, 321 bp, Glycine max
  Peptide Sequence Number=SeqID_140007
atgggcagagtgggtgacaatggtggtgtatatcatcaactggacggatctcaacgcttattactggatgcaatgactacacaaatgcaacgtttgttgaaccgtaacaatgaagagctctataggcgaatagccaaatcttccttgtttattcttaaacctctatcccctagagaagaatttaaaatatcttatcctagaagattcctcatggactgcttatccaacatcagacatcaagtgatcaaaatccttcggagttcattgcctaaatcagcaatctgttatccaaatcacaacctcaaatcaaatctgcaataa

SEQ ID NO: 48323 - DNA, 363 bp, Glycine max
  Peptide Sequence Number=SeqID_140008
atggggtgtacccatggacccaaaatctaccctaaggctcataagaaccctagggccttctcttgcatctctggcccaatctacttggagttttctatccaatgcccttgcggggaggatcggagcaactggggcaaaaaggaaggaaggagatacccaaaccaccgcagacctctcatggtaccgatcagtacgcacaacatcacccaagcttctcagctcacgccggggacccgtccaactcggcacccgtacaagctagggtgcctgtgcccatccagagggagacccctcaagctacggctccaaccccaactcgcccggctggcaatgcccactttggggccagttccaacgcggtaa

SEQ ID NO: 48324 - DNA, 366 bp, Glycine max
  Peptide Sequence Number=SeqID_140009
atgaaaatactaaaagaattaaaaatagaaaaacatgcctcctatagtagtcataactcttgcaagagcctaagtgaagaacttcatgactattatgaaggaaggcataggtcgcatcttagacctcactaccataggagagaaaatgaaagaaagcctcaagaggctaacattaacctcccatacttccatgggaaggacgatgtagaggctaacttagattgggaaataagggtagagcaaaaacttaaaagaaagtctactttaaaaccttacgactctcactcttatccaaagaaagatcaaggtctaggcatcttagggcagcaccttctaagcccaaagatgataaggggaagacaatag

SEQ ID NO: 48325 - DNA, 432 bp, Glycine max
  Peptide Sequence Number=SeqID_140010
atggccacgatgatggaggccatgatgagcatgaagaagataatggaagccaatgcggttgcaattgccgctactagggttgttgctaaggtgaacccgatgcccccatctgatctcaatcaaatgaatcatccaacctcagatatggtgggcaaagatttgggaagtacgaacgaccccatgatgtgcaaattcaaaataagcatgccttcctgccatatggcttgcctcccaactatacaccacccaatatggcgtacactcccaatgagaatgtcaataactccactcccacactcgttgagagccgacaaacccaaactaatcatgcacatgtctctcaaaccatggaggagacacatgaaattccccaccgcaatccagccgactccgagccttgccttggatatgccactgaagggcaagcagttg

SEQ ID NO: 48326 - DNA, 552 bp, Glycine max
  Peptide Sequence Number=SeqID_140011
atggaggaggggacacagcttgttttcgagtgttcaaaaatccggtggctacactttgtgactagggcttgttacaaggacatgttacaagaacaaacaggaccgctaataagggcaatttctgctttgagatggatttttctgacactaataagggtagcttttacgttttcttccactaaacaggagcagttttcacttgataaacaattgaaaaggaaaaaaggctacttgctctctgccaggagtctcacagttttttggggagagggagacactcctaggcattcggaggtgactgaaatcgttagtgtgtcctggctaaaaatcctgggcaggatcaaaactgggatgttgtccccaaatacattgtacggggcataccttgtgtttaaagaaagcagtgatggtgcctacgggttcaagaacatgccctttgaggtgttcattggggttatcggagaggttacagattcaagaattatgaacttgctagtaggaagctcagagtccaatacccgaaggagagtgacgatggtggatggatgttga

SEQ ID NO: 48327 - DNA, 430 bp, Glycine max
  Peptide Sequence Number=SeqID_140012
atgtctcctttccttgtgagagatttcggcacgcaaaatttcaaagctatacaaaggatccataaagcgtgggaaaccctgttaagaaaagataaagaacttaggggcattcataatggcattattggtggttatcatgaatggctgaaagttcatacacgaggtttagattggctccccaagttaaaggttgtcagcgaagagagtttcgaagcgccggaagaggacgaagaagtccaagctctcaaaaacgagttaggaaaggcgagacttgccaaggagaagttcaagttagccgctacagacatccggaaagagtgtgccgggttacgtgaagagaatgcaactaccgcaagagcccttgaacaagagaccaagagggctcgcaaggaagagtatggtcgtaacaaatttcgcagagctttgtggg

SEQ ID NO: 48328 - DNA, 246 bp, Glycine max
  Peptide Sequence Number=SeqID_140013
atgacggccaagatcgatcaatatcagccggattacgtggtgctggccaaatatatgcgcgtgctgaccccggccttcgtgcaacattacccgaatcaggtgatcaacattcaccattcgttcctgccggcgtttatcggcgcgcgcccttatcaccaggcctatgagcgcggggtaaaaatcatcggcgccaccgcccactacgttaacgacaatctcgacgaaagcccgatcatcatgcaggac

SEQ ID NO: 48329 - DNA, 432 bp, Glycine max
  Peptide Sequence Number=SeqID_140014
atgccgcgcgcgctcgaaaaccttgccctgcctcttctctttgtcaccgtgaaatcactcttctctttctcctcccgcctgaaaactgccggaaaccgctccctcgacaaccacattgtccttgctcaaacccacagaaccccctacactaccggaaaacccacattctcctcgcttgaacccacagaaccccctacactgttcttggaagtctggctcaaagaaaacccaacatacactgttgctactagggtgctgaaacagtcgtgggtgctcaaagctcaaagctttctctgcgaggtacgtaggtcaacttcgtctatgctaagtttccatgggtgttcatgctttatttatgataataataataataataatacgtcttcagttgcagtattgctgattgaggtacgaggaaagcttaaagtttaa

SEQ ID NO: 48330 - DNA, 428 bp, Glycine max
  Peptide Sequence Number=SeqID_140015
aagatattgagctggtagaggaggaagaaacacagattggtgttgatcgttctagtgcaacctctaataaatttgagatttataaggaggaagcagggaatgcagcacagaagcataaagcaaagagggtggagaatgtcaatgctgatgcaaaagcctttgttgaagcactagaacatatgaagaaaagagatacaaaccaccaaagtgtgtcattggagaataagacaggagattcaactgtgctgaagataggagattcggctaaagttgtgataaaacaagacatgaagggaagaaagcataaatatgggtttaacaacaataaacgtgagaagccagagaaggtaagggtggtggatgatgaagctggcgacaaacatgagctgtatgaagtcctaaggatgccatctaaaacaaaatactga

SEQ ID NO: 48331 - DNA, 303 bp, Glycine max
  Peptide Sequence Number=SeqID_140016
atgacatgcggagacaaaatttggtcattctgcacccctttgccatttagacacagtcgtgtccgatggcacgcagagacaaaatttggtcattctgcacccttttgtcatccagaggcggcgggcccgatgacatgcggagacaaaatttcggtcattccgcacccctttgccattcagacacagtctgtcgatactgcagagacaaaatttggtcattctgcacttttgtcatccagaggcggcggtcccgatggtatcatggacaaaatttggtcattctgcacccctttgccatattag

SEQ ID NO: 48332 - DNA, 213 bp, Glycine max
  Peptide Sequence Number=SeqID_140017
atggaaagggacgcagccctgagcgcaacgcaattaacgggcggtggtggttacgctcacgtctgcaccccggctacacttgcccgtatgttccggctgctgaacaggaggacagctgatgaccatgaagccaagcacctcgaaattaaccctcataaaggaacaataagttggctaccgggcccgccacctcgaggtcgacggtatcgataa

SEQ ID NO: 48333 - DNA, 132 bp, Glycine max
  Peptide Sequence Number=SeqID_140018
atggggaccggtgctgagaggaacgaggataagggctatgtaggagtgcgggtcaggagaccttggggacgtcaggtggggtgctattgcccaaaaccaagcttgaccaatcccgacccaacccgggcatag

SEQ ID NO: 48334 - DNA, 222 bp, Glycine max
  Peptide Sequence Number=SeqID_140019
atgaatcatggtccgagaagaatgagaagaaaagctataaagaaagaagatccaagaaggcgtatattgcttggtatgacaattactcatccgatggttcggagaaggagatcaaccttctatccaaggactatgaaagtgatgagaacatctctcaagaagtttaaagttatcttcctttctcaaaatatgaagcttatcataaatctaaatggttggtga

SEQ ID NO: 48335 - DNA, 252 bp, Glycine max
  Peptide Sequence Number=SeqID_140020
atggcgcctcctctcacctcctttcctttgtcttccgctgcatctccatgcctccacagccccgttcatcttcggctgatagggggtggagttatgatgctggattttgaaatcctcgcacatttcccgcatcattgtgttattcagattggtgccattatcggtaatgatcttcctagggagtccgtaccgacaaatcagctccctctttatgaatctgactaccacgctcctcgtgacattggtgtatga

SEQ ID NO: 48336 - DNA, 947 bp, Glycine max
  Peptide Sequence Number=SeqID_140021
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcagaccgcgatcctcgacgcccattacatggcccgcgcgctggagctggcgcgcaagggtgtgtacaccacccaccccaacccgcgagtgggttgcgtgatcgtccgcgatggcgaggtggtcggtgaaggctggcacgtgcgtgccggcgagccgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48337 - DNA, 306 bp, Glycine max
  Peptide Sequence Number=SeqID_140022
atgaccatgattacgccaagctcgaaattaaccctcactaaagggaacaaaagctgcccgggggatccactagttctagagcggccgccaccgcggtggagctccaattcaccctatagtgagtcatattacaattcaatggccgtcgttttacaacgtcgtgactgggaaaaccctggcgttacccaacttaatcgccttgcatcacatccccctttcgccagctggcgtaatatcgaagaggcccgcaccgatagcccttcccaacaattgcacaccccgaatggcgaatgggacgcgccctga

SEQ ID NO: 48338 - DNA, 914 bp, Glycine max
  Peptide Sequence Number=SeqID_140023
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccacgaatggtaccatgcgatatattgctatcgactcgacttgtttcagatatgcccatcattgacagcagtcccgagtttatatcattcaagttccaatgtcttccgagtgaatttcgtgtcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48339 - DNA, 588 bp, Glycine max
  Peptide Sequence Number=SeqID_140024
atgtcagcggtttcgagtccgcttatctccactcgtgaacttagtcgaaagctatatgatagcacttccatttttccgattcggcagtttgatctatgctatgatttatcattcatggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatatagaggaaaagaaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccgtga

SEQ ID NO: 48340 - DNA, 890 bp, Glycine max
  Peptide Sequence Number=SeqID_140025
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcattcccttgcattccactcggaatgattgattccattccattccattccatttcattccgttgcaatccattccaatctattccattccattccattccactcgagttgatttcattccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48341 - DNA, 573 bp, Glycine max
  Peptide Sequence Number=SeqID_140026
aggactagacgtctcacctttagagggcttcacgccctcacttccaaagggctacatgcccctcgccttcataggactacacctcctcgcttcagagggatacacgcccttgccttcagaggactagacggctccctaaccatcagagggctacacgccctcaccttcagagggctacacgtcctcgcctttcatagggctcactgccctcgccttcagaggactacacatcgtcgcttcagaggactacacgccctcgccttcagaggactgcacgtcctcacctttagagggctacttgccctcaccatcagagggctacacgtcctcataggactacacgtcctcgccttcatagggctgcacgccctcgccctcagaggactacacgtccacgccttcagaggactacgcctcatcgccttcagaggactacacgtcctccccatcagagaactgcacgtcctcgccatcagaggactacacgccctcgcctacagaggactacacgtcctcaccttcatagggctgcacaccctcgccctcaaaggactacacgtcctcgccttctga

SEQ ID NO: 48342 - DNA, 210 bp, Glycine max
  Peptide Sequence Number=SeqID_140027
aaagggaatttacaagttaggaactctacaagcgaggttttggggactggacgtaggcacaagggtgttaaccatataaaacgagtttttcaaaggaagtttagaagcttcaagaaaaagaggcctcagcaattccttattcagaagggaattctatcaatagacctccaatctttaatggagagtatactggaaaacccgaatgcttaa

SEQ ID NO: 48343 - DNA, 141 bp, Glycine max
  Peptide Sequence Number=SeqID_140028
atgactaaagcacgtcaaaaagggtacggaaagaaaataggggaggagcttgccacccagctcgcccaggcgagccaggttgcttcctccaaaagcaaacaccttctggaggaatatcctggaaggcccaagtgggcctag

SEQ ID NO: 48344 - DNA, 420 bp, Glycine max
  Peptide Sequence Number=SeqID_140029
atgttgagtcaacatccaaacattttaaactacactgactctgtgatgaagagagaatctcctctatccctgcattacaaattgtttgaggggacacatgtcccagacattgtctcgacatcaggaaaagctgctgcctcaggtgctgtgtccaaggatgctctgattgctgaactcaaggacacatgcaaggtgctggaagcaaccatcaaagccaccacagagaagaagatggagctggaacggctgatcaataggctctcagaaagtggcattaatgatggagaagcagctgagcaagaagatgaagcagctgaggaagaagtagaagcagccgaggaagaagaggaagctgctgaggaagaggaagatgcagcagaggatactgaatcagatgatgattctgaagccaccccatga

SEQ ID NO: 48345 - DNA, 279 bp, Glycine max
  Peptide Sequence Number=SeqID_140030
atgagaatcctgaaactggccaaaaacaggctaaaggatcaagtggagaaggacgaaggcccaagtggagaaggacaaagcccccgagtggagaaggatgaaggcccaaggcaaggatgggcattctcacccagggtcaaggtttatggtgagttgggattttggctcaaggcttgtagaacggttgggcatgatatatgtcaaggtgttggtttggccagcggttcagggataaagggaatgtcccacattatttccatgacacacatgcaacgatga

SEQ ID NO: 48346 - DNA, 540 bp, Glycine max
  Peptide Sequence Number=SeqID_140031
atgagtcatcattcatctagtgttaatggtgagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaaataagagaggaagaaagaagaaaaataatgaaagaaatgaaaagagaaaaacatccctcctatggtagtcataactcttgcaagagcctaagtgaggaacttcgtgaccattacgaaggaagacataggtcacatcttagacctcactcccatagaaaagaaaaggaaagaaagcctcaagaggctaacattaacctcccatacttccatgggaaggacaatgtagaggctaacttagattgggaaataagggtagagcaacaacttaaaaagaagtctacttcaaaatctttatggctctcactcttatccaaaagaaaagaccaaggtcaaggcatcttagggttgacaccttctaagccccaaagatga

SEQ ID NO: 48347 - DNA, 552 bp, Glycine max
  Peptide Sequence Number=SeqID_140032
atgaccaccctgacccagatgtggatgacattgctgctcagcaatgtcctgcctagtgatcataactccaaccttcctctgtcgaagtgtcagcttgtgtatgccatcctgacacggatgagcgtccatgtggctcagttgattgctgacgccatctatttatttgcaggtatgccacccaccaggcaccctctagacccggataagtctaacagggccctggggtttctagcattgatcacgggcctctgccagtcattcggggttctcatcacacctagtaaggtgatccggccgccgatcacccgggccttcattgagaagtattgcaagcctaggcaagcgcagggtgatgcaccacaggccgcacacacactgccaccacctcatcaggctgatcctgctaggactgaggttgcatggctcggagattggcccgaggcccaggtggaggaggcgtctgcaggagcacccggcgatgcagaggaggcccgcatggatgaggagatgacagacttgctcggtttcttgggaggaagcggtgccgcgtga

SEQ ID NO: 48348 - DNA, 174 bp, Glycine max
  Peptide Sequence Number=SeqID_140033
atgccaaaagatagggggacctgtcttgatttcaggtattgtcatcatcaaaaagggggagattgtagacaaaggatcaagctgaaagctgaatgttttgatgatgccaaaggatcacatgaatcacatgcttctcaaagatttattcaaaacaaagatattcaagatgaatga

SEQ ID NO: 48349 - DNA, 471 bp, Glycine max
  Peptide Sequence Number=SeqID_140034
caccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatccttgccccggacgaacagagcgtccgggtcctggctcgtgcagctggccttggtggcccactcgtcgacccaggcgtcagccatggcagtactcatcgtgattcccctcccctgtgtctcggcgcccccacgacgccgagcgtgtccggacgtgcgcgtctgatcgacgctccggacgtggacccccctggcccgagatga

SEQ ID NO: 48350 - DNA, 201 bp, Glycine max
  Peptide Sequence Number=SeqID_140035
atgattttgagggggagtagtattatactgctgctgctgatgatgattgatgaatcagatcgggctgcacaatgcacaaggcaagataaaatgtcaaatgaagaattgaagctgcaggatccacgatgtcagatacaatgtccaggacatcctgcccgaaaatactggacacataaatctgttatatctttaacagattaa

SEQ ID NO: 48351 - DNA, 451 bp, Glycine max
  Peptide Sequence Number=SeqID_140036
tcgcggatgaccataagatatctctgcatgcgactggctcgctgtccctggatgacaaaggcacaaaattcgtctatgtgcgtttaccacccaacttgctgctcttgaatgataaaggtaaaaatgcgggaccaactggttttcgcatgtcatcgggcccgccacctctggatgacaaaagtatgacagaaattgtctgcgcggaagatgacgtaaatctccacgtgtcaacgtgcttgttggccgtgattgacaaagggtatctccgcatgtcacgtgactccagtgtcagtatgacagaaattgtctgcgcgaaagatgatgtaaatctccgcgtgtcaacaggcttgttggccgcgattgacaaaggtcctgagacgtctcagaaatctaaaggaagcaggcttgcgcgatccgtgaaattccgtactgtggtggaagtcgaaaagag

SEQ ID NO: 48352 - DNA, 93 bp, Glycine max
  Peptide Sequence Number=SeqID_140037
atggaggagatacatggagaagacgataaagaccaagggcggaatggagaaggagaaaaggtgattggagacgccacttcaagcagaaaatga

SEQ ID NO: 48353 - DNA, 696 bp, Glycine max
  Peptide Sequence Number=SeqID_140038
aggactacacgtcctcaccttcagaggactgcaagtcctcactttcagaggactacacgtcctcaccttcagaggactgcatgtcctcactttcagaggactacacgtcctcaccttcagagggcttcacgtcctcgccttcagagggttgcatgccctcaccatcagaggatgtcacgtcctcaccttcagagggctacaccccttcatcttcagaggatgtcacgtcctcaccttcagagggctacaccccctcatcttcagaggactacacgtcctcgccaacagagggctgcacgccctcaccttcagaggattacgtctcctcactttcagaggactacacgtcctcaccttcagaggactgcatgtcctcactttcagaggactacacgtcctcaccttcagaggactgcatgtcctcactttcagaggactacatgtcctcaccttcagagggatacacgccctcggctccgaagactacatgtcctcatcttaagaggactacatgtcctcgccgtcagagggctacacgccctcaccttccgaggactacatgtcctcatcttcagaggactacatgtcctcacctttagagggctacacgccctcggctctgaggactacatgtcctcatcttcagaggactacatgtcctcaccttcagagggctacacgccctcgccttcgtag

SEQ ID NO: 48354 - DNA, 288 bp, Glycine max
  Peptide Sequence Number=SeqID_140039
atgcgagcgggaaattctgttctgtatggattcctcgagccacagtccattcaaaggtctgggcaatcgcagtttgaggctgaaagttacataaagagttcaaaacgtgatgtctaccttggagcctacctgaatgggcccgacaactaccttaaggggataattaacagtgctttaaaaggtcttgatggtccacatcctaaatcaaaggctcctgctaggtggattgtcgtcaagtgtaatcgacaaaagggaagcattgagtttggctattatgtcatgcaatga

SEQ ID NO: 48355 - DNA, 207 bp, Glycine max
  Peptide Sequence Number=SeqID_140040
gtcgactctagaggatcccctgtgcaacatttagtttggaaccctgagcagactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 48356 - DNA, 585 bp, Glycine max
  Peptide Sequence Number=SeqID_140041
atgacacgcggagataccttacggttatccgcacccttttgtcatccagaggcggcgggcccgaagacacgcagagacaaaatttggtcattctacacccttgtgtcatccagaggcggcgggcccgatgacacgcggagataccttacggttatccgcacccttgtgtcatacagaggcggcgggcccgatgacacgcggagtaccttacggttatccgcacccttttgtcatccagaggcggcgggcccgatgacacgcagagacaaattatggttattctgcacccttgtgtcatccagaggcggcgggcccaatgacacgcagaggccaatgtggtcattcctgcaccctttgtcatccagaggtggcgggcccgatgacatgcagagataccaaattacggtcattctgcacccttttgtcaatcgcggcggcaggcccgttgacacgcggagatttacatcatcttccgcacttacaagatttgtcatactgacttgtgatcatgctgacgggcggaaatacccgagtggttatccgtataaacattcttttgctatctgtaagacagaacgggcttga

SEQ ID NO: 48357 - DNA, 141 bp, Glycine max
  Peptide Sequence Number=SeqID_140042
atgggggctgcaaatagcacccaggcccatttgggccctccaaaaagcaatcactacgcaagctccaaactcgaaggtggaggacacatgaacgaaaacgcaattcatgcggctccgaaaaaggttgatgtcataccctaa

SEQ ID NO: 48358 - DNA, 978 bp, Glycine max
  Peptide Sequence Number=SeqID_140043
atgaagcaaactcacaacggcgtagtaggcctgccacggaaatacttggaaggcaaggcaagggatatggcaagccaagagaagtggggcccgtttgcggatatactagctttgttgatttttggggttgtcctgtttccgaacgtggacggtttggtggacttagcttccattgatgctttcctcgcatatcaccacagcaaggagagtctagtggtggctatcttggcaaatttgtttgacacttttgatcggaggtgtgagaaaaatagtgcacggattgtctgttgtttacccgctctctgtgtatggttggtttcacacctattccaacaagacacaagatacccgtgtccgcttcaaagttatcgctcatgcgccgaaaaaggaagagtcgattgggaccaacatttagctgggataggaggcaacgcaatcaattggtttcctcgttggaaggaaggcaaggaaggagttcttttctcgtgtggggactaccctaatgttccattgatagggactaggggttgtattaattataatcccgcactcgccataagacagctagggtaccccatgaggggagcgccaatagaagaaagtctctcgcctttccttgtgagggatctaggcgcgcaaggtctcaaggtgatacaaagagtccacaaggcgtggagaagtccgttgaggaaagacaaggagcttagagtcatccgaaatggcgtcatcggtggtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgcgatgaggaaatcagacctacgtag

SEQ ID NO: 48359 - DNA, 415 bp, Glycine max
  Peptide Sequence Number=SeqID_140044
aaaatctaagccgaggcgcttccgaaacctttccgtaacgttttccgtgaggaatttcgcaaaggtttcaaccgttcttcgacgttcttcattcgttcttcatcgttcttcgatcttcaacgggctgtcgtcccttgggacggacgtgtggggtgctaataccttccccgtgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtcacgcgtcgccctcccgccgaagggtaggttgcgacagttggcgactccactggggactgtttttagagagttaggccatttaatcttgtgcaatgttttaccgtga

SEQ ID NO: 48360 - DNA, 678 bp, Glycine max
  Peptide Sequence Number=SeqID_140045
atgctgaggcggcaggtggtagaccacggcgtcatacttgatgttttcacgcttgccggccagcacgccgcccagcgactcggcgaggcggcggctggcggtattttgctcggccaccgggtagataaggtgctgaggctgaaagcgctcgctgacccagcgcgcgatgccctgcacgatttcgcgcccgtagccctggccgtgcaggctctctttcacccagatgcccagctccggggtgcggctgcgcaggttatgcgcgccgccgacgccgacgaactgccggtcttcgcgccggcgggcgacgaagatcacttcttcgccttcgcgcatcagcggcagccagccttgccagacgttggcgaaatcttccggcgacgcctccggctcaaaggccataaagcgcgtcagagtgggggtgatcgcctggtaaacatcgtcggcgtctgctgcggtaaagggggcaatcaacaaacggtcggtgtccacgcggcactgagaaaggtcattatgattcatcttattttccctcgcttttcaggccagaacggcaaaaaatccgcgctcataaatcagggcggatcgtcgatattacgcgcattggcggcagaagcgacttatttttcgccgcttgggcaagatggaaagatcggggttggtgacaatgtcacgttatga

SEQ ID NO: 48361 - DNA, 440 bp, Glycine max
  Peptide Sequence Number=SeqID_140046
atgccaggccaatcagcatcgaatacactgacgagacttactggctacgaagtgtttccatggcaattccagatgcgtgggcagggaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48362 - DNA, 87 bp, Glycine max
  Peptide Sequence Number=SeqID_140047
atgtgtcctccaccattaagtgcagagcctccggtgactgggaaatgtgaaaaagaaaaaggagagacgggagtcgccatagactaa

SEQ ID NO: 48363 - DNA, 438 bp, Glycine max
  Peptide Sequence Number=SeqID_140048
atggagtcctttggtgaagctgggtgggagtgggaattctcctggagaagaaatctttttgacaatgagttggggagagcttcagcttttatcgaccaggctacagcattaagccctaatgcagctttgaaggattattgggtgtggggagctgatccaaagggaatcttttctactagcactgcctatctttgtattaaaggtgatcagccaattgactacctaaattgtggcttcagtcagctgtgggaaatcaaagtccctcctagagccctatcctttgcttggagactactttgggataggttaccgactaaggaaaacctaattagaaggcaagttgtcattgaaaatgatctttgccccttctgccaaagccaagttgaatctgcctctcatctctttttcacttacaaaaaagttatgccaatgtggtag

SEQ ID NO: 48364 - DNA, 318 bp, Glycine max
  Peptide Sequence Number=SeqID_140049
gtaggagggcgcggcggttgctgcagaacccagggcgcgagcccgggcggagcggtcgtcggtgcagatcttggtggtagtagcaaatattcaaatgagaactttgaaggccgaagaggggaaaggttccaagtgaacggcactgcacatggcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggtga

SEQ ID NO: 48365 - DNA, 433 bp, Glycine max
  Peptide Sequence Number=SeqID_140050
atgacgcaatcagccaaacagttttttgatgaaatgcagggctatgggggcaatgtacgggcgatttaccaggcatataagcattggttaagcgatgtacctacgcaacaactggccgcaaagcgtgccgaagctgaagttttgttccgccgtgtcggcattacattcaatgtctatggcgaggaagatggcgccgagcgcctgattccgtttgatgtgatcccacgcatgatttcggccagcgagtgggcccacctgtccaaaggggccgtgcagcgtgtgcgcgcactgaatatgttcctgcatgacatttatcatgaccaggaaatcatcaaggccggcattgtgccgcacagcattttgagcaatgcgcaataccggccggaaatggtaggcgtgaatgtgcccaaccaggtctacgcccatgtggcag

SEQ ID NO: 48366 - DNA, 393 bp, Glycine max
  Peptide Sequence Number=SeqID_140051
cgtgactcaaatttcagtatgacagatcttgtgagcgcggaagatgacgtaaatctccgcgtgtcaaccggcttgtcggccacgattgacgaagggcgcagaagacgatgtcagtctttgcgtgctatcaggcttttcgtcttacagacagcaaaaaagaatgtttatacggataaccactcgggtatctccgccggtcagcgtgactcaaatgtcagtatgacagatcttgtgagcgcggaagatgacacagcaaaaaagaatgtttatacggaaaaccactcgggtatctccgcccgtcagcgtgactcaaatgtcagtatgacagatcttgtgagcgcggaagatgacgataaatctccgcgtgtcaacgggcttgtcggccgcgattga

SEQ ID NO: 48367 - DNA, 247 bp, Glycine max
  Peptide Sequence Number=SeqID_140052
tcgggaaacctgtcgtgccagctgcattaatgaatccgccaacgcgcggggagaggcggtttgcgtattgtgcgctagcggagtgtatactggcttactatgtcgtctctgatgaggataccggatatattccgcttcctcgctcactgactcgctaccctcggtcgttcgactgcggcaagcggaaatggcttaataacggggcggagatttcctggaagatgccaggaagatacttaacagggaa

SEQ ID NO: 48368 - DNA, 393 bp, Glycine max
  Peptide Sequence Number=SeqID_140053
atgggttctccacctgcctccactcctccccatcctccttctcctccttctcctcctcctcctcctcctcctcctccttcggacgcatcggcttcgccgtcttccatgaagcagacacgcaaagttgcacgtctacgatcattgtccactagaccacctggtgctgagagaccagtggtgcatcttgatcctgctaccgggaaggccgacggtccccacatgaagaaattaagaacatatttggggattgtggcgcgcgataaggtggacatcacctacgagaactggaaagaggtccctactactcagaaggacctgatttgggaggatattcgggcggaatttgatatcccagaggcttctaacagtaggacgaaaaggaagttactatag

SEQ ID NO: 48369 - DNA, 204 bp, Glycine max
  Peptide Sequence Number=SeqID_140054
atgtgggcatgggaacgatgcacgactttggctccaaagaggacgcctcccgtcatagaaaatacttgttcttcatttaactttccttgtggagtggatgtcatacacgcgaacgatgtgcgaacagagctgctgatttttctaagtttcttcgaccaccgcgaatgctttagaggaaggatataccacctttccatcttatga

SEQ ID NO: 48370 - DNA, 172 bp, Glycine max
  Peptide Sequence Number=SeqID_140055
atgactgtttatgtctttagcatgactgactacttgattaaatgtggaggaaagtgggataaatgggccgatactactgggaaggattcctctttggataataggtactgtaactgcgtaataaactcacctgggatccactcgaattcgtcaaagaaagagtggatcccag

SEQ ID NO: 48371 - DNA, 243 bp, Glycine max
  Peptide Sequence Number=SeqID_140056
atgtatcacgatccatcttttgccccaaatttttgcaagatggttacttccacacctcaacttgactcgatgaaccttttcgtaaaagcaagagcttggttcaaccccataacccagggaatggcaattttgatcgccaatacttcatcaacaattcatagggatgcaagactcgggaatatgcatgctatacatggaaaatttgaaggggaaaacgcaagggtcacgcatgagcaaacatga

SEQ ID NO: 48372 - DNA, 501 bp, Glycine max
  Peptide Sequence Number=SeqID_140057
atgggtgaagcagaggaggtgcaagagaagatgaaggccgacatggaggccatgaaagagcaaatggccacaatgatggaggccatgatgagcatgaagaagataatggaagccaatgcggttatagttgccgctactagcgctgtcgctaagggtgaacccgatgctcccatctggcctcaagcaaatgaatcatccaacctcaaatatgagacccatgaaattccccatcacaatctagacgacttcgagccttggctcggatataccactgaagggcaagcagttggtggtatacccctacaaaaccctttggagggccctcagtatcacccacaactgcacctcttgcattccacagcggttaaaaaccctcatgactatggcatgggaaagttggatcatctagaggaaaggctcagggccattgaaggaggtgaagattatgcctttgctaacctagaagagttgttcctaatacccaaacatggtcattcctaa

SEQ ID NO: 48373 - DNA, 588 bp, Glycine max
  Peptide Sequence Number=SeqID_140058
atgtattatcctggtcatcaccaacatcaatcatatgcggaacctaatgtacctcccgtgaatgttcttggatttatgtcccaacatcatccatcacaagcacaatatcaatcaacaagtttttctggtcatgcgtctcaaggatgtcaacaaagttttcaaccactggggttctcatcagtatatacctcaatactcattcaagtcccttctacctcaaatgttttttatggctcctcacaaatgtttgtcatcactttcaacactccaccatctgcatataatcttgcaccatcgagttcttattatcgtccatcattacctactcaaatacgtgacatcagtcacgaagatgaggacgaggatgaggataacaacaataacaacgatgacgatgatgatgatgacaatggtggtcatcatgttcctcaacaacaacggacaattacacgtaagcatcctagaacaagaggaggtagaggccgtagaccaagaggacaacaagcacagacaaatctagtccaacaagatgagagacctagacgtgtatctagaagaactcgttgtgggacatcgtctcattattag

SEQ ID NO: 48374 - DNA, 827 bp, Glycine max
  misc_feature (821)..(821): n is a, c, g, or t
  Peptide Sequence Number=SeqID_140059
atggttagaacacgaggtttaggtcgtgcgttaggagctggtagaggtagaggcattagtgaggatgcgcatgaggctgatgttcctcggcgccgcaggcctactgcttcagcacgtaggcaacgggttcttctgcgtgaggacgtcacagagagacctgaggatgtgcctcagttgcatgaggatgtttctcatgtgtctgatgccaccccagagatgacaggcgccgccgatgctgttcagacagagagagtggctactgatgggagcttggggtcacctgctgcagatgagggattccccagtggactacgcgacccatcgattttgatcgattttgctgagcatgttgcacacaacatctggagtggacaggaacaacccgatctgaagttggtctcccacggtagaaaagtagataaaattgggagaccagcgcctgagatcgaagggttgattgctggcaccggattgagtccactgatcaggtgttctgttatcaccactgatcctggactcatatccgccttcgtcgagaggtggcattgcgagactagcatgttccacctgccagtaggcgagttgacgatcacggtggatgacgtggcgtcactcctacacgttcccatcactggcgcactgcatacattcgagccgctggttacttcagacgcgattggtctactgacagagcttcttgaggtccatcatgaggaggctacatttgagacccgacaggctggtgggcctcatgtccagttggggtggcttcgggacttgtatgagagccagtgcagggccagacgatgggttgtagcagnccacac

SEQ ID NO: 48375 - DNA, 195 bp, Glycine max
  Peptide Sequence Number=SeqID_140060
atgccgttccgagtctgttttatgcggtccaaacctcttgctgaatccttgaccacagttgcaattctactcaaagaggggagacacccggaggaaaggcttgcatttggagaggttccagtcaaccgccctaattccttgatgtccctgaccgtggtatctaggccttttcaaccttgcacttggtgcaaatag

SEQ ID NO: 48376 - DNA, 499 bp, Glycine max
  Peptide Sequence Number=SeqID_140061
atggatgagcgtccacgtggcccaggtatgccacccaccaggcaccctctagacttggataagtctaacaaggccctgggatttctagcattgatcacgggcctctaccaatcgttcggggttcccgtcacccccaataaggtgatccaaccaccgatcacccgggccttcattgagaagtattgcacgcctagggaggcggatggtgatgcacctcaggccgcagacgcaccaccaccacctcatcaggatggatcactaggcatggagcattatctacagcacttggttcgccagcaggcggccaaccaccgagggcaggtgcagatacatgagtgtctctaccggttcagcctcagtcagcagggacagggtttcactccttttgcatgccctactctagagcagtttggggatgaggtcgcatggcccggagattggcccgaggcccaggcaggggaggagcccgcaggatcccccagtgaggcaaaggaggccc

SEQ ID NO: 48377 - DNA, 354 bp, Glycine max
  Peptide Sequence Number=SeqID_140062
atgataaaatcaagagcgatgctaagcattatatttggaatgacctctatttgtggaagttgtgcagtgaccaggttattaggagatgcattcgagaccatgagatcgactcggtcctgcaattttgtcattcttccacaccaggtggccatcttggcatacagaggacagctcgcaaggtgcttgactgcggtttctataagcccaccatcttcaaggatgcatggagaatctatagcacttgtgagccttgtcagagagcaggtggctcactttcatggaggcagcaaatgcctcaacaaccttgttggacaagtggcctcagatatcttaaagaagggggagttgaattaa

SEQ ID NO: 48378 - DNA, 114 bp, Glycine max
  Peptide Sequence Number=SeqID_140063
atggggaaagttgtcatcatcaaaaagggggagattgtggaagcaaagcttcatgatgaatcaacaatgattcaaaggtgttttgatgataacaatgatgacaacaaaagatga

SEQ ID NO: 48379 - DNA, 357 bp, Glycine max
  Peptide Sequence Number=SeqID_140064
atggccaaaatacatcatggaaccgcataccaacaaaacatgttatccaatgaacaactaaacccccacacttattcccaaaacaatttgaccaaagctccaaaattccttaaggattatggtgatatcatggtttttcatttaaggcttggtagtgagcttcaaaacaaagaaagggaaacaaggctcaaaagggctatcaaaggaattaattcaaggaagtccatttggctagaagcttatgagaacaaacttgcctcaatcatttccaaatatgcatgtgaattaggaagcatcaacaagaatctagccaaggctattgtgcaagcaatcaatggggcaaaacacaccaaatga

SEQ ID NO: 48380 - DNA, 492 bp, Glycine max
  Peptide Sequence Number=SeqID_140065
atggagaagacaaaattgtttcaagcaccgacagaaccggaagcaccctttgtttcaaagtttcaaagaggggaggacgggttattcacatttcatttgatggtcagaggcgaattgaaagctaagctgtgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 48381 - DNA, 337 bp, Glycine max
  Peptide Sequence Number=SeqID_140066
gaatttcgtaacgaaggtctatctcaagcaacaagttggattgatcgcgaattacaaagcattgcaattgaatatggcagattgggttatgagtcatatgagaaggactttgtcgatatggctaacacacatgacaacaatcttctctcagaatgtatcaatagttttcgaaggatgtcaactattcccatgacagcatttggtcaaatcaactacgttgacagtggtcatggtatttggcacacttgcggaactacgttcactgataagaatggtatttgtctcatatctgatcgacacgcgagtatcaagtccgttgtcgctaatgaagcacttg

SEQ ID NO: 48382 - DNA, 96 bp, Glycine max
  Peptide Sequence Number=SeqID_140067
atgggatcaagtttagcatatgacaacggaatttggggtgaaccctacagggtggtcttcgtcattggaagtgcggtagacaggctttgtggttga

SEQ ID NO: 48383 - DNA, 144 bp, Glycine max
  Peptide Sequence Number=SeqID_140068
atggcctcctatggtggtgagcttcttctagactcaaaggaatccattgatgaagaagatcctaggcctacaagctccagtggagcttacatcatgtggtatcaagagcattttcatctaggttctatcatttttcattcataa

SEQ ID NO: 48384 - DNA, 612 bp, Glycine max
  Peptide Sequence Number=SeqID_140069
atgacatttttaggagaaactagcagtcagacgattgtcaactcaaggttgggtttcatttttccaaatgaatcgattattcacaatgatagtggggtttacttccaaacttccactccggtgcccattcgagtaccaaacagctgtgattttgcaagcctaaaaaccataatacacaacacccttcagctaaccaacagacaatttttggatgaaattcactaccgccagccattcacccatacaggtaaccaaattcgctttcaatgtatgcaattgagaaatgatgacgatgtcaacacaatgttaatgtgtaatgatcaattttcgtgtgttggtccgattgagttattatgcactgttggaagaacaccagatggagtaataaacttacttgaacgcactacgacccctactcatgacgcgctgttgtattacaacaggagatggaacatgccaccccagaacaaatttgtaggatgcgcgttcacaggaaaaaatccaaagaaatttgaaattcctttaggatgtaccctcgacgaactgaaggatttgataaagcaagttgcacttaaagggattccctctcatggaattcacgattcacaagtg

SEQ ID NO: 48385 - DNA, 221 bp, Glycine max
  Peptide Sequence Number=SeqID_140070
tgggctcagttttccagactcacatagacccttcttgggaggatttgcgcatcaagacacaggccatccagaagcagaatactgccccccacgttttgtctcgtgggggttatgattatttgaagcagaagctcctggatgagaagaccaagaagaaactgcacagtcaggaagtgttgatggcgtcatcgacactctatccccagtcagacgccatgtga

SEQ ID NO: 48386 - DNA, 219 bp, Glycine max
  Peptide Sequence Number=SeqID_140071
atggactcgggaaggttccagattagtataccaggtgacggctgccccaggcctcccaaagtgtttggcaggggtacgccaccaaacgcttgccccttagtagcatatccgaggcaaggctcagagtcggctagagtgtggtctcggggcacttcatgtgtccccccatgggttgagagacatgtacctaaccagattggggttgttggctctcaatga

SEQ ID NO: 48387 - DNA, 255 bp, Glycine max
  Peptide Sequence Number=SeqID_140072
atgcacgaagttgccaccaacgtttatttgaggaaaacgctagaaaaaccaaaaaagacgaagtgggctaagcgcgcatccatcgctaagcgcaacttcagtgcgcttagagcgatagaagaatctggaagggcatcaatatcaaggtcgtgcgctaagcacaagatcagtgtgctaagcacagcagttgtcttcagccagcctcagcgcacgattggcgctaagctcaacgtcacgaattcagagcctatttaa

SEQ ID NO: 48388 - DNA, 546 bp, Glycine max
  Peptide Sequence Number=SeqID_140073
atggccacaaggatggtggccatgatgagcatgaagaagataatggaagccaatacagttgtagttgccgctaccagcgttgttgctaaggtgaacctgatgcccccatctgatctcaaccaaatgaatcatccaacctcagatatggtgggcaaagatttgggaagtatgggcgacttcaagccttgcctcggatatgccactgaagggaaagcagttggtggtatacccctgcaaaacactttggagggccctcagtatcacccacaagcacacctcttgcattccacaacaagtaagaacccttatgctatggcagaattgggaaagttggatcatctagaggaaatgctcagggccattgaaggaggcgaagattacacctttgctaacttagaagagttgttcctagtacccaatatcatcacccctcccaagttcaaggtgccggactttgacaagtacaaggaggctacttgccccaagaaccatctaaagattattgtcagaagatgggggcatacgcaaaagatgaggaactgctga

SEQ ID NO: 48389 - DNA, 237 bp, Glycine max
  Peptide Sequence Number=SeqID_140074
atggccgatgcattagccaccctggcatccatgtttcaacttgccccacacggggatctgccatacatcgaattcatatctcagggcaggccagcgtattgttgtgctatagaggaagagtgggataggaaaccgtggtacttcgatatcaagcaatatgtagagaacaaggagattggctactggtttctttgtaagtggtaccatcctgtacaaacgaaaccacgacatgactga

SEQ ID NO: 48390 - DNA, 319 bp, Glycine max
  Peptide Sequence Number=SeqID_140075
taccatcgagcatccgtcgcgcaagcaatctgacatgtgcggcagatcgcccaacaaagcatggatcgtacagagagacaatgaagcggcatacttaagcgatgtctcatttgcgaagcatgactcaagaaccgtcaagaagagcaaaggaaagttctttggtgaagcagggagtcatgtgcagtttatcctaacaaactgttccccaacaagaagcgtgcatgagaagacaccacaagaagcatggagtggaaggaagcccgggatctctcacctcaaagtgtctgactatgtgcctaacatgcaagaaaatatttga

SEQ ID NO: 48391 - DNA, 674 bp, Glycine max
  Peptide Sequence Number=SeqID_140076
atgacagaggcaaaagcaagaaacttggcaggcaaaggcgaatgggccccgttcatagacattccctcgctgttggtctttggaggagttctatttccaaatgtggatgggttggtggacctggcagcgatcgacgcttttctcgcctatcataaccacaaggaaagcccggttgtcgctatgctagccgacctatatgacaccttcgaccgaagatgtgaaaagaacaatacaaggattaaaggatgggcaaattgggaccaactcttatcgagcaaagaaggagcatctgtcaactggttccctcgatggaaggaaggaagaaccggagttcttatttcatgcggaggatttccaaatgttcccttgatggggacgaggggttgcatcagttacaatcccgttcttgctataagacaacttggctaccctatgagaggggcaccactggaggatgagctcacgcctgtcatttcacgaggcttcaataagaccaacatggagacacttcagaaggtccgcaaggcatgggaggtgtttcaaaataaggacaaggaactcaggggcagtaacaatggcccatcgatggctatcgaagttgaggcactggaggaagacgaagaagtgcagacccttaggatagaactcgagcaagctcaagcaatcaaagaaag

SEQ ID NO: 48392 - DNA, 841 bp, Glycine max
  Peptide Sequence Number=SeqID_140077
atggagagaagtatgacaaatgctgccagtggtggagccttaggagacatgactcctgctgaagccagaaatttaattgagaagatggcttccaactcccagcaatttagtgccaaaagtgatgttattgtcattagaggagtgcatgaagtaaccacaaattcatcttcatcagccgagactaagaaacttgaaggtaaactaaatgccttggttaacctggtaacccaactggccgtgaatcaaaaatctgcacctgtcgacagactctatggtttatgctcctctgcctaccaccacacagacctttgcccttttgtgcaacaatctgaagcaattcaacagcctaaagcttatgctgcaaacatctacaatagacctcctcaacctcagcagcaaaatcagccacaacaaaacaattatgacctctccagcaataggtacaacaccgggtggaggaatcatcccaaccttagatggtcgaatccttcacagcagcaacaacaacaacaacaacaaccttatttcccgaatgttgctggcccaaagaccagagcctccattcagagcttaactaaccagatgggacaattggctacgcagttaaatcaacagcagtcccagaattctgacagattaccttctcaatctttccagaattccaaaaatatgagtgccattgcattgatgtcgggaaagcagtgtcaaggacctcaaccagcaacatcttcctcatctgcaaatgaacctacccaacttcactctactccagaaaaagatgatgacaaaaatttaaagagtaagttacctaacaatttctatgcaggtgaatcttccactg

SEQ ID NO: 48393 - DNA, 453 bp, Glycine max
  Peptide Sequence Number=SeqID_140078
atgataccaggggccagatgtcgtacaggatgtcacgaacatcacgcttcagaacatgcagtttatgtgtgtccgtatgaacagattaaacaagtaataacacaagagaattgtttacccagttcggtgcaacctcacctacatctgggggctaccaagccagggaggaaatccactctcaatagtgttagttcaaggtctaacaacccctgttttacaaccttctttcacctaaccactatccgtgcagagtctctagctgcaaagtttagaagagaaccgagtcatgctcactcctcatgttcaaatgtctggcacactcccattgtagtgacaatttatgtcaaagacagcaccaggatcaactctgacaaggatctttctaaccagctacacaatagagatcaatctctacacactcaggtcaggcaagcacttggcaatgttcagtaa

SEQ ID NO: 48394 - DNA, 282 bp, Glycine max
  Peptide Sequence Number=SeqID_140079
atgcagaagcttcaagaaaaggtccaaactccccttcaaaatctgattttaggcttaaataggtggcttttccgtgcttgcgcgcttagcgcaattctgaaccgcttagtgatcactagtggatttcggcttagcgcgtgcttttcttgctcagcgaatggactgaagcggtgcgcttctctagatgaccctttgcttagggtaaatgcacagctcatccttcttccagattcttcctcgcgctcagtcgaggagtgttgcgctcagcagatggctcgctaa

SEQ ID NO: 48395 - DNA, 422 bp, Glycine max
  Peptide Sequence Number=SeqID_140080
tcgctgttctctttctcctcccgcctgaaatctgccagaaaccgctccctcgacacccacattgtcccacattgttttcaatactgccggaaacccctcgctcgaacctacagaaccccctacactgctcttggaagtgtggctcgaagaaactttacatacactcttggtactagggtgctgaaacactcgtgggtgctcaaagctcaaagctttctccgcgaggtactattgctgattgaggtacgaggaaagcttcaagtttcatgccattttgttagatctcactgccattgtcactgtttgggttcgagactacttggagcaccagtagcgataactagtgataaggatcctgttattgttcataacaagttactgacacttcttgtaattattttgaagtttggggcacttgtttg

SEQ ID NO: 48396 - DNA, 256 bp, Glycine max
  Peptide Sequence Number=SeqID_140081
ggttttcgttctctaccggaaccgcaagccaagttggaagattccgcttcggttgaagggttcctctcggtgtgggttttcaatggagaacaatgatggtttgtggtggctaatggtggctttacaaaccaaatttagagaagatccaacggttaacgaaggctggacaacgtttttaccgcggcagcttcatgtagctttctctagaagcttcattaagaggcttcctccagaagcttcctcgtggcttctttga

SEQ ID NO: 48397 - DNA, 258 bp, Glycine max
  Peptide Sequence Number=SeqID_140082
atggcacagtttgagaattcttttgattcttctcattccctaatacaaaacctgagatctttgtctcaacacattggagggtacatcctttgtggtacaagtagagggtacatctacttgggtttgactgagaacaagagagggtacatctcttgtggatcagttctagtggagggtacatccactaggttcaaagagaacaagggagggtacatcccttgtggatctttgcttgtaaatggatttttacaaggttga

SEQ ID NO: 48398 - DNA, 273 bp, Glycine max
  Peptide Sequence Number=SeqID_140083
atggcttgccacattagttccgaggtaacagctaccccagattacacactttctcctcaattagcaaagcgcataattacttgcacctaccttcaaggccctaccttgtccagatggaacgccccggggcttctccgtgacaagcacacgttgcgttcgagttgtattctcggagaaatggaggttgatgaaccttggctagggttatggctaccattgaattatcaagtagatatgggagcaagtcagcataggacactggaattggggtga

SEQ ID NO: 48399 - DNA, 588 bp, Glycine max
  Peptide Sequence Number=SeqID_140084
atgtggtcatctgcgccctttccggagatgtcagcatcttccggtggagactttttcaagtctcacaagatacgtaggagcaagagccttgcttttgtcggccgccccacaagatctgtcatattgaccctgaggtcatgtgacatgcggagacaaaatttggtcattccgcacccctttgccattcagacacagtcgtgtccgatggtgcgcagagacaaaaattggtcattcggcacccttttgtcatccagaggcggcgggcccgatgacacgcggaagaaaaaaatttggtcattccgcaccccctttgccaattcagacacagtcgttgtccgatggcacgcagaagacaaaaatttggttcattctgcacccttttgtcatccagaggcggcggaccccgatgacacgcggagacaccttacggttatcccgcaccccttttgtcatccagaggcggcgggcccgatgacaagcagaggccaatgtggtcattctgcacccttcgtcaattatcggccgacaagcccgttgacacgcggagaattacatcatctttcgcacttacaggatctgtcatactga

SEQ ID NO: 48400 - DNA, 96 bp, Glycine max
  Peptide Sequence Number=SeqID_140085
atgagtgatatgaataacagcggaatggagaaggaagagagagaggagatgccacttcaaggagaagatgagtctagaagaagctcaccaccatag

SEQ ID NO: 48401 - DNA, 507 bp, Glycine max
  Peptide Sequence Number=SeqID_140086
atggattcttttgaagttaatgttgatgagaatgacaatgggagtattgatgtggatctgcatggaaatgttattcatgaagatgaacctattgagtctaaaatgtcaaaaaagagggctagaaattattcatcacatatgtggaatttttttgagaaacctgttatgcatagtgatggaaaagtgatgagtaaatgcaaatattgtttgaaagattatgtgggtggtgacaataagaatgggacttcaaccttacaacgtcgtatgggaaaatgtgatcatgatcttccattctcttttattgaacgtagaaggtttaaagagttattacaatatttgcatcctgatgtgaagttaccctctaggcgtgttgctaccatgaatgtgaacaatctgtatgaatctcaaaagaaaaaaatgaaatgcatgttgtctaaagtccctagtagaataagcttgacatctgatgtgtggacatcttgtacttctgaggttatatttcattaa

SEQ ID NO: 48402 - DNA, 881 bp, Glycine max
  Peptide Sequence Number=SeqID_140087
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcaattatgggcaagatatacaacaatccaatcgtgttcattgtgttcattgtgctatcgagtatgaatactgcacagagctatccatcattcaaactacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48403 - DNA, 426 bp, Glycine max
  Peptide Sequence Number=SeqID_140088
atggagcctatgaaattctgggagtttgtgtcattggtagtggaaggtcttggatatgaaaggccaagggtaaagatccccacctttgttatcatgcccattgcacatttggtggagtggatatataagctgctaggcccatatgggatgaagctgcctcaactaattccttcaagaataagactcatatcttgcagcaaaacttttgattgctcaaaagcaaaggatcgccttggctatgcccccatcataacaccacaggaaatcaagtatgagatgttactcttaaatggtgatatttcagtgcaccaaggttcttacatctatagcagtgagcatacattaatcgtacttctttcctggtgcttcacccataataatgagattgtaatttttcttgcaagagggtctgcggaggacaattga

SEQ ID NO: 48404 - DNA, 282 bp, Glycine max
  Peptide Sequence Number=SeqID_140089
atgtgggcttatgtactaaagacttccagtaaaattttcgagttgatccaacggttaatgaaccggaacgaaggaattgttactggggtctttaaagttttctgcctttgctctgttttgcttggctgtgatagcttgtgctgtttgaatgttgttttgcttggatgttgtggaagaatgggaggattgatggggacccgagtggtacctggagatatgtcgcgggggtcaggagaccttggggacgtcaggtggggtgctattgcccaaaaccaagcttga

SEQ ID NO: 48405 - DNA, 1070 bp, Glycine max
  Peptide Sequence Number=SeqID_140090
agggttgcacgccctcacctttagaggactacacgtcctcgccttaagagggctacatgccctcgccttcaaagggttgcacgccctcgccttcggagggctatacgccctcgccttcagagggctacacgtcttcgccttcaaaggactggacgtcctcaccttcagagggctacacgccctcacctttagaggactatacgtcctccccttaagaggactacacgtccccgccttgagagggatgcacgccctcaccttcagaggactacacgtcctcaccttcagagggctacacgccctcgccatcagaggcctgcacgtcctcgtcttcaaagggcaacacgtcctcgacttcagagggctgcacgccctctcgcctttagagggctacgttagtttccttttatcagctcctgggccaccccctgatcctggaatagggccaactatgcgagcacaatcagaggaggaggctatcgcgcagctactgtgcataccggggcaagatttcacccagaccgctgtagggaggcggatatggatgacactgctgctcatcaatgtcttgcctagcgaccacaactccgacctccctccgcctaagtgccagttggtgtatgctatcctgacacggatgagcgttcacgtggcccagttgattgatgatgccatttatttgtttgcaagattggcgcctactaggcatcctttagacctagagaagtccaaaagggccctagggttttcggctctgatcagaggcctctgtcagtcctacggagttcctgtcacccccagcaaggtaattcgaccgccgatcacccgagccttcatcgggaagtactgcacgcctaggcaagtgcagggtgacgcacatcaggccacgggcgcatcgccaccacctcggcaggccgatccggctgggccactgggcgtggagcgttatctacaacatttggttcgccagcaggcagccaaccaccgtggacagcaatttggggctgaggtcacatggcctggagactggcccgatgcccaggcaggggaggaccctacaggatcccccg

SEQ ID NO: 48406 - DNA, 831 bp, Glycine max
  Peptide Sequence Number=SeqID_140091
gacgctacgccgctgacgttagggcaggagatctccggttgggtcgcgatgctggaacataatctccgccatattgagcacagcctgccgcatctcgcagagctggcgctgggcggtacggcggttggtaccggcttgaatacgcacccggaatatgcggtgcgggtggcgacggaacaggcgtcgcttagcggactgccgttcgtcaccgcgcccaacaaatttgaagcgctggccaccgtggatgcgctggttcatgctcacggcgcgttgaaggggctggcagcttcgctgatgaaaatcgccaacgatgtgcgctggctggcctccgggccgcgctgcggcatcggtgagatcgccattccggagaacgaaccaggatcctccattatgcccggcaaggtcaacccgacgcagtgcgaagcgttgaccatgctatgctgccaggtgatgggtaacgacgtggcggtgaatatcggcggtgcgtcagggaactttgagcttaacgtctatcggccaatggtcatccacaatttcctgcagtcggtacgcctgctggcggacggcatggagagctttaatgagcactgcgcggtgggtattgagccgaaccgcgagcggatagaccagttgcttaatgagtcgctgatgctggtgaccgcgctcaatacccatatcggctacgataaagcggcggagatcgccaaaaaagcgcaccatgaagggctgacgctgaaagccgcggcactatcgcttggttacctgacggaagcggaattcgatagctgggtgcgcccgcaggatatggttggcagcctcgctactcgctag

SEQ ID NO: 48407 - DNA, 411 bp, Glycine max
  Peptide Sequence Number=SeqID_140092
gtagctgtgtctctggaaaaaccacctccaaagcccaatccagaggtcgatgatccactttatctgatgacattgaccatcccagagcttttcttgaggccttaccaggttacatgggatgccaccgtgttcgaggtctttaatccagatttcccgctctacataaagcacaaagacctctccgaaatcgcacaaggtggtcaatgtctcagcatatcagtgttacagttgtggattctgcatctcactgaaacaagtatgcgagtggggaattctgatatctatggattcctcgagccacagtccattcagaggtctgggcaatcacaatttgagtatgaaagttgcataaagacttggatgcagagttcaaaacgtgatgtctatcttggagcctacctaaatgggtaa

SEQ ID NO: 48408 - DNA, 642 bp, Glycine max
  Peptide Sequence Number=SeqID_140093
atgagaggaaatcaaagaagacaaaacttcaaacctaaaagaagaactgaagagtcatctcaaatcccaaaatgctttgagtgcaatcaacccggacatctgagggctgattgtccaatctttaagagaaagatagagaagtctgaaaagaagactattggagataagaaggcaaagaaggcctatatcacatgggatgacaatgacttagaaacgtctgatgattctgaaaaagaaatggttaatctatgtctaatgggcaaaaattatgaaagcgacgaagaggtaacatcttctaacaaatctatttcttttgatgagttacaagatgcatttgctgaattacatagtgaatcaattaaactagcaaaacttgtctcttcatctaagaaaacaatttcagaattagagaaagaaatttcaaaatttaacaaagaaatagatattcttaaaactgaagtttcaatctctaaatctagtgataaagattatgtttctactatgactaatgaaaaaaacaaatgcacattcatggacaagattctaaaggaagaagtcaaatcaaatgatgaacttccaaaagaatggaaagcttcaaaagatcatccccttgacaacattattggtgatatctcaaaaggg

SEQ ID NO: 48409 - DNA, 212 bp, Glycine max
  Peptide Sequence Number=SeqID_140094
atgaagtcttgcatccgccttcttcgccgggcagcgaagcgcacgccgccttggcgaccgactggcaggtgctcctgcaatgccggatgggcctcgaaatgcgaccgcaggctgcccaagcaggtggtggccgcagccgtggccggccaggcccgggctgtcggtggacggcgtgcagaccagggcgccgctttgctggttcaggcccgaca

SEQ ID NO: 48410 - DNA, 764 bp, Glycine max
  Peptide Sequence Number=SeqID_140095
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccacattgtgtcttgaactttatgacaaagtttactgatctcttggtagctggcatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48411 - DNA, 675 bp, Glycine max
  Peptide Sequence Number=SeqID_140096
atgtcctcccctttcagtgcagtacacgtcctaaccttccgaggactacacatcctcgccttcagaggactgcacgtgctcaccttcagaggactacacaccgtcaccttcagaggagtacacgtcctcacctcaagagggctacatgccgtcaccttcagaggactacacgtcctcgccttcaaagggctacacgtccttgccatcggtggactacacgtgctcaccttcagaggactacacagcctcaccttcagagggctacacgccctcaccttaaatggactacacgtcctcggctttagagggctacaaaccctcgcctttagaggtgtacacgccctcgccttcatagggctacacaccctcaccttcagagtactactcgtccttaccttcaaaggactacacgtcctcgccttcagaggactacacgtccccgccttcagagaactacacgtcctctccttcagcggactacacgtccttagcttcaaaaggctacacgtcctcgccttcacagggctagatgccctcaccttgagagtacttaacgtcctcgcctttttaggactccatgccctcgctttcgtggggctacacgccctccccatcagaggactacacgtcctcacctttagagggctacacgccctcacgttaagtggactacac

SEQ ID NO: 48412 - DNA, 294 bp, Glycine max
  Peptide Sequence Number=SeqID_140097
atgcagtcccgtgaagaagccactgacatcagctcgttgtcggcccaggtaaccaatatcacggggctgagcggtgtgacccgcagcggtcgcgtgtttccaccccccgacctgccaacacaacctgcaaacgttaaggggaaggcaaaggtggtggaagaacaaaatgacaacacgaccctcactccgaacaaggatattccagtgaaaggtcttccagagaaaagggatggctgcggcaagaaggaagtgtctctagaggaagcaagcgagtttcttcgcattattcagtag

SEQ ID NO: 48413 - DNA, 144 bp, Glycine max
  Peptide Sequence Number=SeqID_140098
atggaggatatacatggagaatatgatgaagaacaaggaattaaaatcatggcagtggaatggagaaggaagaaagatgattggagacatcacttcaaggagaagatgagtcaagaagaagctcaccaccataggatgccatag

SEQ ID NO: 48414 - DNA, 237 bp, Glycine max
  Peptide Sequence Number=SeqID_140099
atggctttttccagaggggccctagtgcttaccaacatggatggcgaggagctacctttacccgtgaactctaatgttgtcaaagttcaagataagaatcaagaagaattcaagactcaagaagaaagtctagagacaagaatcaagattcaaggttcaagatctcaagaatcaagatcaagattcaagactcaagattcaagactgaagagaagactcaatcaagataagtattaa

SEQ ID NO: 48415 - DNA, 591 bp, Glycine max
  Peptide Sequence Number=SeqID_140100
atggcctctattcaacacatggtgattgtcaataggaacataaggcctattatctacagaatcaagccagacctcaatagaacttctaaggaaactaccaaggctacaaagaagaacactgaggcttccattaaacatcttgaagttcaggttggacaacttgcaacacaactctctaagcatggaaatggatctttctcagcaaacacgcaagttaacccaaaggaacaatgtaactcaattacaacaagaataaaggagttgaaaaagaaaaaagagaaaaatgatgaagtggtgactaacgaaaaagtggaagagaaagggttaagtaaagaagagaagcaaaaatcaaagaaacaagccactaacaaagggatatccaacaagatcactacacccccatgtacatacacaacatacatcatcacaatgcattttcaacatcatcaacatttcatctcaatgtcattatcaacatcagcactgtctcatctcaatgtcattctcaacatcaacatcatctcatctcaatatcattctcaacatcaacatcatttcatctcaatgacattatcaatgataacaacataa

SEQ ID NO: 48416 - DNA, 363 bp, Glycine max
  Peptide Sequence Number=SeqID_140101
atgacgttatcaacaacaacaacctcattgcgtatcaacatcatcacatatgaatttaaagtcatcaatagcaacatcaatagggtccaacaacaagcaacggcggcttacggcagccactggtggtcttgggtggtgaaaaatgagcgcaaccccctctgcgttagggcaggcttagcgtacccttgggtgctcagcgcaacttcctctctggttggaattgggcttagcgcacctcagagcgctcagcgcaacttcctctcggtaggaattgtgctaagcgcgccattcgcgtttagcaaagaacaaaatttgtgtttttcaaaatcccaacggtcaggctgtggaaacatggcttgttaa

SEQ ID NO: 48417 - DNA, 489 bp, Glycine max
  Peptide Sequence Number=SeqID_140102
atggccgaatcttcgaaaaagcgaaagggatcttcctccaccactaccgctgttggccatcgtcgccacggaccatctggagcacccacaacaccaattcatccttccttgtcatctccgcgatcatctaccttattctcgtcagatgatcaacgtcaaaggtactcctcccaattctgtaatagagtcatcttaaaccctaagtacctagacattgatttcttttatggtgaaacatttgactgctatcaagctgatatgaccgacagattgcttgcggggtcattaacctttgattgtcgcatcatgcactacataattgttcagattttgctaccccattcatctaatcttgctcaagcctctgaggaggatttgattctaatgtgggcttttcttattggtcgtcagatcgactgggctcatttgattaggtaccgaatgcgtaaggcattacggaccaatgcacctctcccttatcctcacctt

SEQ ID NO: 48418 - DNA, 474 bp, Glycine max
  Peptide Sequence Number=SeqID_140103
atgtccctcaaaggggcaacattgacatggtatgaaagactcactctctggtcccttggcagctttgacactcttgtcgaatgctttagttcccagcaagtccgggggcaccaggaagaccatcaaaaagtcgagacattgatagaaggagggaccgaacagaggatagatggtgaacgtcaagctcaacaagagcaagatgatgaacccgcccagcaaattagaggtgtaatcaacaccattaggggtggattttctcatggagggttgtctagccaatcccaaaagcgttatctccatgccatcaaagatattgacgtcaactgcgtcgacatgcagtcaccaagaagcctccctcccataacattcacctacaaagacttcaaaggcatcaacaccattaaccaagataaccccatagtcgtctccattgtcatcgccaatttcatggggtctagggtccttattgactaa

SEQ ID NO: 48419 - DNA, 711 bp, Glycine max
  Peptide Sequence Number=SeqID_140104
atgcttgcaagagcgcggcccattggatcccctggacgatgccgaagtagcggcaacaaggaccaagtcaccgtcatccgtgactaccgctcaaaaatcgaggccgagctctccaacatctacaacggaatcctcaagctcctcgacactcgcctcatcccctctgccacctccaatgactccaaggtcttctacctcaagatgaagggagactaccacaggtacctagccgagttcaagaccggtgccgaccacaaggaagccgctgagagctccgcctacaaagccgctcaggtttgcttttgtttcctttcggttttttcgattttattttttattttcgaagtgcattatttgtttaggatgagaagtagccttgaagcttttgtgagaaggctgttagtggtaagaaaggatttgttcttggaagatgttggcgattctccaaagtccgaaaacgtggaatgcgcgagtaatgtggatgatgaagaatctattgttccgttagggattggattttcggacacagcttttgagaattgtgaagctccctcaccaaactatatactctgcctcttatctgctctgctaacttcaattggaaaacaggcgggaatttcttcagaagctgctactgcggctgctttgaaggttggaaagaggcctgagaatgcaggaaagcttattggggacctggaaggatgggaatga

SEQ ID NO: 48420 - DNA, 132 bp, Glycine max
  Peptide Sequence Number=SeqID_140105
atggagaacaaggtggatttcaatgataacaggtcagtagacccagagagatacactttcaacctaacaggaacagagcctattagtttggaagacaaaaggaaggttggtcaccatgcttcaattacttga

SEQ ID NO: 48421 - DNA, 594 bp, Glycine max
  Peptide Sequence Number=SeqID_140106
atgttttcgccggcggcgtctccgccacccgttgtggtgttgaagaattgtgcagtggtggcatgggaagatagggaggccaccgccatgtcgggtcaggccttcaaatccggcagcagcgacatagtgtcagggtttgcagcggcagaggctttttggatgcaccagcaggttgatgccgtgaacgtcacggtaacattcccgcttaagccagagaatcaatacccctcgatagtctcaaatcccggtaaaagtatcaggcacgtgaaggcaggggcgcaatacaatggggagctgacatgtggcattgagctgttgtgccaacaaatatgcataatcgattgctaccgttacagtggcgcaatcactttttgtcggtataggcgtaggccagagacacacacctttcatttgatgtatggggaggccaccatcacactacaagatgtgtctgtgttgctaggtcttcctgtggatggcaatcctttaattggcagcacaaatattgatgggattgatatgtgtgaacaataccttggagtcaggccaaatgctaatgcattgtctgacggaaacacattgaaattaagctga

SEQ ID NO: 48422 - DNA, 706 bp, Glycine max
  Peptide Sequence Number=SeqID_140107
atggataaagtggacataattggaggcgactactgcagccagtgcttaatgaaaggaatagtcgttatgaaagacggtttcaagaaatgtcatcacaaggtgtcaactttagacgatctggcgtcgtgccttgataagatgactcttttagctgaggaagatgatagaattattgaggcacgtgaaaaagctcctccttcgacccaaggtttagggcgacgtagggaaagtgtggatgcagaagcacatgtcattcctgcgatgccagagcagcaacatggaatgtattacacacctgatcagttcacccaagagtcgtctcaaatgtcccccctgtatccgtacccatatcaaagcgaaacttcatcagatgcatatttcatgggaatgcaacctccgctacaaccaggatatgttacgactgacttatttgggtctccttctcctgcgggaaccccttcatttgcacatggttgtcagatatcaacacctaacgccccaatgggccctccatggagtgtgtcggaaaacattcctaacattactgatttattaggggtagatttaggttccctccaatccatctcattccttaaccgtgttgatcttggccttcctttcatacgtataaaacttggatcaggcacaagtgtccacgactcatcagatggaggaatcgaatcctcgttccccaggggccaccacg

SEQ ID NO: 48423 - DNA, 669 bp, Glycine max
  Peptide Sequence Number=SeqID_140108
atgaaaggaaggaaggaaagaaaaactttgcagatctggttcgtcaaagggattgcgtgttgttgttcgaatcagagttcaacgtctacggggttgacagtgccgatgggtgccccaacagtgatttggttggtgacaattgtgtttgatggtggtgcgtcgaggtcatggtggtttgggtcatgggtagttggtggtgtttctgggtggcgcgctggtggcggggtggtggttttgggtggcttgagcgatgtggggttgattcaggcaagtggtgtggtggtgtttggcggagcaatggttatggatgtgggagggagaaaggctgcgacgagagaaagagaaagagaagtactggaacaagagaccttcttcagtatatggcttcatcgtggtggtgaaggtgtggcgatttggcagcactgtcacattgtgcttcacagggagagcggaaaaggaaagggagggaagagaaaaaaaaaggaaaaagaagaaggggagagggaaaaaggaacatgtagagaggaagagaaaaaagaggaaggggagagaggaagaggaacagttaccaagacaggggaagaaaaagatgaggaagagaattttttttttaaaaaaattaaaatatttcaaagtaggatatgtgtgttctatcaaaaagttatttaa

SEQ ID NO: 48424 - DNA, 321 bp, Glycine max
  Peptide Sequence Number=SeqID_140109
atgacaggtatgctagaagtagtatctaatccttggaggtttaccgtagggaactggttatgtgactcagatctggttagtcctactgggattgaacgggttctaaccaaaaaagaccttctggctgactcatattcagacctagaggcttctattcttgatgagaaagagtttcttctgttgaagatttattccaaagtaatgtttatcttatgctttggctatctttctgggttcatacaaaggagtttgttcaaatatacatgttactgctttcttacaggaagaggaaacatagatgaacagagcgggaaaggatga

SEQ ID NO: 48425 - DNA, 675 bp, Glycine max
  Peptide Sequence Number=SeqID_140110
atggcgagagcttgggtgaagcacgacacgtggtacattgagggtatggtgggttatgagcgcgggaatgttaacattcatgggtatgagcacgcaacagaaggagggaatttgatgaaaactatagtgaaccaaacacgccagatgctagagagtgtgttattggttgagggaaccaaagccttaaagaagatgaagaactcagcttcagagagcggtttgtacataattgagagcgatgaagatgtggagaaggatatgcagaaagacgaaaacgatggaaacgattcggattattcgaatgattccaatggaaacctgtcaatgaggaaacccagcaattacagcatcgcatggcctcaaagttacaggcaatccattgatctatatggtagtgtgccatcaccaaatattgggtttctgggcaccacatcactgtcaagattaagcagttcttttatttcttcatctttgacaagaaggcacactcttgaagtattacaaccagagaaaaaaccactcttgcaacccacagaagaggagcaaccgcgacataccttgcttcctccccaaatatctaggaagtcttccattaagatttccaaggtttctcatgaacctcacattcctggccaatgcacttttggacaagctgtgcttaatggtaagtactga

SEQ ID NO: 48426 - DNA, 315 bp, Glycine max
  Peptide Sequence Number=SeqID_140111
atggtcaagatattcgatgtgacgttggccaaaaatgcatttggacgatttcaggtgaaaggccccctattgcagagttcatatgacacaatcgagatggccgaggtgactgtagatcgtgactgtagaccaagatatcatcgaagaaaatcaatacgaatttacgtatggatggtcagaacagggcgtttgatgagaatcctgaaactggccaaatacatgctaaaggcccaagtggagaaggacgaaggcccaagtggagaaggacaaagcccccgagtggagaaggatgaaggcccaagtggagaaggatga

SEQ ID NO: 48427 - DNA, 942 bp, Glycine max
  Peptide Sequence Number=SeqID_140112
atgattggtgaaggttcagttgaaggaagcaatgaaagcgttgacagtgttaacatgctaaacatagaggtggcatctttgacggcaactactgattcagtgacaacaatggttgcagcaaaggaggaagtaaagcagggtgttgcagatgatctgaactctacacattcaacacccttggaaaatcaagctaaaccttcaaatgggtcagtggagagagaagctgaaccttcaaatggagaagtagagagtgaagctgaaccttcacaaggtgcagtacatagtgaagttgaaccttcaaatgatgcaatggagggtgaagctaaaccttcacaaggtgcagtggagactaaagctgagccttcacaagatgcagtggagagtaaagcttctctttcaaatggtgcattgaaccgtgaagctgaaacagcaagtggtgcaatggagagtgaagcaaaaacttcaagtggtgcagtggagactgaatttaaaccttcacatgatgtagttgaaagtgaagctaaacctccaaatggtgtagctgagactgaaagtgaaccttctgttgatgtgtgtcagacgaaaaaagatgtagtgaatagtaaagctgaaacttcaagtggtgccctgcagagtgaaagagaggcttgtgttatgtctgagatgaaaaacaatgcagtggagagtgaagctcaaccttccgttgatgtaaatcacaagaaaacaatcgcaattaatagcgaagctgaactttcagttaaaggtgggctttttgttgaaagtgaaggtagtaatcaaggagatgaagattcaagacttgcctcagatgctttggatggacagaatgtgggtacaaaggtagtgaaaaacccattctactatttgatcagggttcccagatatgatgatgatgaaaacataaaaacgctcttcaccaagtag

SEQ ID NO: 48428 - DNA, 567 bp, Glycine max
  Peptide Sequence Number=SeqID_140113
atggttggagcattctcacaaaacatcgtgaccctgactggtctccctatgatcttacttagtgagagtgacctgacaaacccattatgtgagggtgtcacagcctccagtagctcatccacatctatcagccaacaacaggtggctgaaatcataggaagccttaaggaagagtggaggaatgaatttgaagaagaaaacaaacaaagtctagagatattgaaacaagagttgaaggacgccatcataattgagatgtcgcaaaagggatcgcagttctcagtacctattgaggcagatatacatgtgttaggtgcacgagtgagcacaaaggggagcaatgttgaaactggtgtgaacccatttggggaagaacatgttgctcatgtcatatcgactatggggttgtatgtccaacatcaacattctacacagttggtggccttgggaaaaatatatgagggaggctctaccatactcggtgtggcttatgtagatgatgacgtaagggtcagtgttgaaaaagttattgacggtgacgctgaagtcccgttgccaacatcctaa

SEQ ID NO: 48429 - DNA, 396 bp, Glycine max
  Peptide Sequence Number=SeqID_140114
atgagggttcggagcgcgccgcgcgcaaggcggtggactccttcgatcggattttccaccacgcgaagcgcaccagcgtcgctgccgcagtcctctggtagtcgctgcgctcggtgctatcctcggcgaaccacgaggaggctgcgtcgtcatggactgattgctggagtcagtggcggcggcggcacccaggcggagtacgcgagggcactagcgtatctgattgcggaccctaacgtgtctatggcggttcttgggagacctcatgcagttttgagtcttctgaggagatggtgggcttttgggctccctcatctcccgcagcgccatgatgaagcagctgaggtgacaacgaatgcgagaatgagagagatagagtggtacactggccaataa

SEQ ID NO: 48430 - DNA, 489 bp, Glycine max
  Peptide Sequence Number=SeqID_140115
atggcttctccacctgcctcgcctcctcctcctcttccttctcctcctcctcctcctcctcctccttcagacacattagcttcaccaccacctggtgctgacagactagtggtccacattgatcatactatcggcaaggccgacgatccccacaggaagaaattaagaacatatttggggattgtggcgcgtgataaggtggacatcacgtacaagaattggaaagaggtccctactactcataaggacttgatttgggaggatattcatgcggaatttgaaatcctagaggcttctgatagtaggacgaaaaggaagttacttcagactgtgggcgagagatggaggcagtttaaatcagacctcacaaggaaatggaaccttgcagccgatcatgacggtgtggatgacactgtctgtgagaaatacggcataagcaaggaaaaatgggcccagtttttccagactcgcagagacccttcttgggag

SEQ ID NO: 48431 - DNA, 519 bp, Glycine max
  Peptide Sequence Number=SeqID_140116
atggggaaccaagaactccttgattgtttatgtgactatgctgcattcaaggctcaacacttgtatggtccacaagggcaccgagggatgagtgccttaatttttgaggaatccacggcaggtgggaagcgccaactttatggttacttggcttctaaagaagatttgtatattttcaacaagtactctagagcaatgtatggaagcttagagttgcaacaagaaacgcatgaccttgttgattcaatggttgaaagacttaggactttaagccgaaagtctgatggccaatttatagttatggatttgagggttgagatgttggataagaagggttgtcaaggaagggatagtgaaaaagagaagagttgcttcaatgcacaagaggttgcagtgtttttgaggaagattggttttgaaaaggatactacaatctatgtgacacaatcaatgtgggatgaaagccttgactctcttaaagatttgttccctaaaacatatacaaaggtgaagcactga

SEQ ID NO: 48432 - DNA, 237 bp, Glycine max
  Peptide Sequence Number=SeqID_140117
atggactgcatgcaaagagcatatccccatgctccgtacattggaacaactaagattaagatcctgaatcaaaacatggaggccttaacagtgaaactgtcggaaaaggaccctagagaaatttctaaggcggttcccattggtgatgtagcaggtggtagatactacaatagattggatcacttttcatggaagtatgctaacacacctccaaaagattcaaaaatctcaacctga

SEQ ID NO: 48433 - DNA, 1045 bp, Glycine max
  Peptide Sequence Number=SeqID_140118
cctcgtcgtggagaccatccccgtctcgctcatgcacctccacctctacgataggtggttggcgtcgctatgctttagcgctggtgcagggtttgaggacccttttctacaagtgcgagccttcgcactggaagggctcctcggtttctatgaatgcgacagagagtcgagtgacgttgtgttcttgttggcaaaaccctcgtctctcgctctggtggctgtcgaagagatggtgtacataaaggcaaccgatgagaagagtgcggagatggtgaccgacgaaggtataggatatgatgtgttcgagtttgtgagcctcaattttgctgttgttttagtgagtctctctactttcgacaattatagagatcagcttaaggaaaactactgcatagtggagaaagggtacaattctttccctaacaggatacccggaactgcatactccaaagcactcttgagggatctattaggccactttctgaactacaaggatgaaaaaggacaaatgctaagcggtgaccaaattgctaataatgtaattggggcagagcaaatggcagtatatgaagctaatgaaggagggaagatgccattgacatggggtcagaccagaaatatgccaattactcataggccaaggagaacgatgaacatcgaagtgaatgaccaggagctagacggtcataacaccattgtcctcaaagcgccaacccatgctggtcgtggtggtggtggagaggatggtggagaggtggtggtggatgtggcggcgggcgttgacaccgatgatggacagagcaagaggttgaagggcgatgatgcgaacgacggcaggtgcaagaaggagtctgatatagacagagattgcgaacgttccgctggccgtcacaagagtgagagggagagaaacagagaaaggaggaatgagattgtcgacaacaaaaataggtggaggcggcaagcgcgagcatgcgtgacttccgtacggagcatccaagtgaagcttccaaggggagtgatgcttacttgggtgcgagactag

SEQ ID NO: 48434 - DNA, 114 bp, Glycine max
  Peptide Sequence Number=SeqID_140119
atgactaaggatttgtaccgttggtttatcacattgggcaagcatgaagatgcgacgtggaagatcatggtttattcattgtcatattcgggacataacaattctaagacataa

SEQ ID NO: 48435 - DNA, 114 bp, Glycine max
  Peptide Sequence Number=SeqID_140120
atggtagctcaccaaagcgagctaagacttactcctgaagtaactggctcgccagaggactttgagtcctatggaagcattaagacagaggactttgagtcctatgaaagataa

SEQ ID NO: 48436 - DNA, 408 bp, Glycine max
  Peptide Sequence Number=SeqID_140121
atggccgtcaaagtttacaaaagaaattttgttaaattagtgagcattctttcaatctcttcttcttctcatacattcaaaggtggagcagttgaagctgcaggtggggagggagctagcaatagcaatggcaactcgaagactgcagcattcaaaggtggagcagttgaagacgctgttgcagcattctttcagtctcttcttcttctcatccacgagaatggtgaaagagctttttctgcaactttgcctgctgcttcttctcgatccctcggatccatgttcaacttcaactcgcttctcgcaaccaccgactctctcaactcagagtgggaagccatggaaaaggaaaatgaagagatggaaaggaaaaagagagaggaagagttgattcatgagaggaaatga

SEQ ID NO: 48437 - DNA, 330 bp, Glycine max
  Peptide Sequence Number=SeqID_140122
atgaggaataaaaagaaaggtagtaaatcgagaaaggaacacataaacttacttgtttgggctacagaatggcgtctcatccctaaaactcgagaaaatggaaagattgataggctctatattcataaagaatacgagattaaatgtcgttctctaaaagaggttaagagatatgagtctcagtggaaaaaagaactaatgacaaacaagggaaagaacaaaaaaatgcatggcactgaaaagcaaatcaaaggttttggtgcagtggatgagctcgtaatacaagaggcattggccattgacagcagtgataagcctggcctaggctag

SEQ ID NO: 48438 - DNA, 568 bp, Glycine max
  Peptide Sequence Number=SeqID_140123
atgggtcctcctccacgcggctcacaccgtccactagcaccgctcgcgccttcagcgaaccgacgcagcgctcgtcgtagctgtagaagcggaggcaaaggacaatgcggtgcacagagagctctgaggcgacgcatcttgacttcgacctccattggggaagagaggagggagagtgcggttaagacagttaacaacaactgccttgctcaaactgagctagatctcttgccgaaatttaaaggcaaattagtcccaaacgacgttgtgtattgctgttgcaacattctttcagtctcttcttcttctcatacattcaaaggtggagtagttgaagctgctggtggggagggagctagctattgcaatggcacctcaaacgctgcagcattcaaaggtggatcagttgaagacactgttgcagcattctttcagtctcttcttcttctcatccaggagaatggcgaaagagctttttctgcaacgtcgcttgctgcttcttctcaatccctcagatccatgttcaacttcaacttgcttctcagaacgacagactcactcaactcag

SEQ ID NO: 48439 - DNA, 327 bp, Glycine max
  Peptide Sequence Number=SeqID_140124
atgggtgaagaactttctggattgggtattaaagagttaggtaatctagaaaatagacaggagatgagtttaaaggatgttcacatgaaaaaggatcaaattgtgattgatgagctcaaagaactacaccaaaagggaagcctctttcatcaacaaaatgtagaacttaatagaaagataaacttcatccgcaaggaaaatgaaaaacttcaaaaggtatacaaaagacattctgtatattttagaatatgcatagtgaaaaatcctagacatagacaagcaaagcaaagggagaggcagctggaagctaagaatgtgatatgctga

SEQ ID NO: 48440 - DNA, 1140 bp, Glycine max
  Peptide Sequence Number=SeqID_140125
atggtggaacacttgaaagttggaagcaaggcgagccgacaggaagctagcttgttttgtgttgcgaacgggttcccagtcagaaccctctctctttgcaagcatcagctgttggttggttggggtatggcttcaacggacgtcagaggcattttgacagctttcaatccttctctcgacttcttcgctatcaccaccggagacggtcgcgtcaagggtcaggtccacaccgagttcgctgatatcacctcaactcattcaactgctactaccttacatcataaatcatccattaacggccatcttgcgctagattatacttgcatcaagtggttctccttcgaagaaaagaggaaaaggaagcatatatcctccttgttggtgcttggaactggtggtggtgatgttttagcacttgatgtcgcttctgctcaattgacttggagacttactgactgtcatcctggaggtgtgagagtcattgcatcttcagcaaatgtgtcaagcatttatactgctggtgtagatgggatggtatgtgtgatagatttcatgacaggaaacctgttggagaaatttaaagcttctacaaagccagtatcctgcatgtctgtttctccaggtattattactactgttttgattactgatttggcaattgcttctctacttaaatcagatgggaacacattagctactgcagcagcacaattgaagatttttaactgttctaatcacaaaaagattcaaaagttctctggtcatcctgggagtctcaccgtcgttgtctgcgacgacgtaataaatttgatggctttcaaagacggacagcaccgtcgtagacataatcttgttctacgacggtcctttggaaacaaccgtcgtagaaagatccacaattcaaacacggctgtcaacagccccgtcgtagaagtaacaacagactacgacgggcatgaggacaccaccgtcgtagaagtaacaacagactacgacgagacggtgttaatactactacggtcacgtaacaacaccgtcgttgagataaacgtgttctacgacggttgtatggcatggaccgtcgtagacttgtattcatactactacggtcttctgttgccgacgaccgtcgtaaaatag

SEQ ID NO: 48441 - DNA, 2082 bp, Glycine max
  Peptide Sequence Number=SeqID_140126
atgacacagggtagttttgttccccatggtcgagatgacatcttgaatatggccattggaaaaccggaacatctaggtcgagttcgtgcagcgggatctggtatgacccttactcaattttatggtagggcaacacgtacgtcgagtagttcctcagcaacactaatgcagcaacagtgggttgacattattggaaacataaaggaacaagtaaggaatgaatatgaagaacaacacaagaggagtttggaggaatttaagaaggagttgtccagtcagatcttcattcagttgagtcagatgggatcacaatactctccccttattgaggtggatttacaggcattggctgcacgtcttagcactaaaggaagtaatgtagaaactgctgatgttgacccatcaggcgacaaaaatgtgagcttaaaacccactatggggttatatgtgcaacgacaacatactacagtgttggtggccttggggaaaatatgtgaggggggatctgccattcacaatgtcactgatgctgatgatgttgtaagggtgagtgttgacaaagttatagaaggtgacgccaaagtgcccttcccgacatcagagattcaatatgagtctgatactagtccaaagaaacttcctgaaacaaatgaaagggggacgaatgattttgaccatgatccgttgcatcaactgattaagagcctatatttcatgtacgacacacctgttgagttgaagtgggatggcagcaaatttgagctttcaaatgttgatgcttcattcttcttgacattctctgatgtaaatgaaatagtagctggatacaaatgtttgaacatatctatactacagttatggatgtttatcaatttttatgtatattttatcaaagcagatttttggatgagtggagctcaactttgggtcatgcttccgtgtatggattccttgagccacaatcgatacacaatgcaaaggatcaacgtgttgaatgtgagcattacttacaagcatgactcaaggaatcgcaacgagaggggccattggcaactggtagtactgtgtcctgcgaccaatgttgttgcatggttttgttcgttacatgttgatcatgctattattataagcagtgcaatgaagtcaacaaacacaactgcggatggtacaaataatccagcaactcctaagtggattgaagtcaagagccatgttcaaagcggagggtatgagtgtggctactacgtgatgcattggatgtggaacatcgtcagtgggggtttaaagaatgattggagcatgtggtttcttgatggaacgacgttagacaacgaaacaattacaacgattcgccagaaatgggcagcatatttccttaaagttcaaagcaatcaatgtacaaaatggaacgatatcaagcaagggaagacccttagatttagagtgaatgatggggaggacagctacacaactcttccaagaatagacccttctgtgacccaaaggatcccgacacagcatggccgaatagctggccctaggcaaacgactccaaaatcagtgattcaccaaatttgttatatcatcctcttttctgtgttatatgatgtaggaggtgtcatatctttgagctgtgacaatgaagctacccgtggttttggtcctttattgcctggcaatcttaaagttgattttggtgatgtagaagcacttgaaagaatttttaaagaaaaaggagaacacatagctgtgtttattttagaacctatccaaggtgaagctggggtgatatttcctccagatggttatttaaaagttgttagagatattggctccaaatataatgtcttgatgattgctgatgaaattcaaactgggttagcaagaacagggaagatgctggcttatattgctcatgtctacagcaaatttattggccctcttccggggagtcctgatgagtttgtcgcctctattaacaagtgctttccacacattgttgacaccattatactcctgaacactaatttgatgttccaagaaaagatgaaaaggtccagaaaatcactggcctctgcttag

SEQ ID NO: 48442 - DNA, 3549 bp, Glycine max
  Peptide Sequence Number=SeqID_140127
atggatgccaaggtgaagcaaatgattaagcttattgaagaagatgcagattcctttgccaggagagcagaaatgtattataaaaaacgcccagagcttatgaaaatggttgaagagttttactgggcatatcgggcattggctgagagatatgatcatgcaactggagtgatccgccacgcccataagaccatggctgaagcatttcctaatcaatttcctatgatgctgacagatgatttacctgtcgtttctcctacggagactgagccacatactccagaaatgcgacacccttcacgtgcatttcttgatccagatgaaccacaaaaggatgcttctgctcatttccatgctatcaaaagaaatggtggttatactggtgaacccgattctcctttgaacaaaatcggtttgaaacaactcaatgatctctacatctctggagaacaagaaaatattccaaataatgagcaaaacagtggaagcaacaacactttgtctgagtctgaacgcgtgacaaaagcggagacagaaattttggccttgaagaaagccattgccaaattagaagatgaaaaggaagctggcttgcttcagtatcagcagagtttggagaaaatgtctaatcttgagttagaagtgtccactgcacaagagaattctcgaaaactcgatgagcgagcaagtaaagctgaagctgaagttcaagccttgaaggaagcccaaatcaaattacaggctgaaagtgaagctagtcttcttcagtaccaggaatgcttggagaaaatatctaatttggagaaaaatatttcttctttgcaaaaggaagcaggagaacttaatgaacgagctactaaagctgaaactgagactgagtccctaaagcaggaacttgctagagtagaagctgaaaaggaagctacccttgttcaatataaccagtgcttggagacaatatcaaaactggaggagagaataaaagaagctgaggagaatgcaagaaggattaaggagcatgctaatatagcagaaaaagaaatcgaagctttggaattacaagttactaaacttaatgaagaaaaggaagatgctgctctccactatcagcaatgcatagttcagaacagaaatgtcttctcttggcgacatcaaatcacactctgcagtcagaattacaatctttggcacaaaaagtggggtctcaaagtgaagaacttaatgagaagcagcaggaattgggtagactttggggttgcatacaagaggagagactgcgattcattgaggctgaaactgcttttcaaactcttcagcagttgcattctcagtctcaggaagagcttagatctcttgcttctgaaacttaacagtaaagtggaaataatggggaatgtggaatctcataagcaggctttagaggatgaagtacacagggatgagattttgaatttgagggagacaatagagaaagttgaacaggaggtagagcttcgaattgatgaaagaaatgctcttcaacaagaaatttactgtcttaaagaggagcttaatgatgtgaataaaaaacatgaagccatgatagaggaagtccggtcaactgacttagacccacagtgctttggatcatctgtgaaaaaattgcaagatgagaacttaaagctgaaggaaacatgtgaggctgacaaaggagagaaagaagctcttttggtaaaattggaaaccatggagaaacttctggagaaaaatactgttttacagaattccctttcagacttgaatgctgaggtggatagcgtcagaggaaaggtaaatgtgttggaagaaacatgccaatctctactagtggagaaatcaaatcttgctgctgagaaggccaccttgttttctcagtacaatccacaactgaaaaggttaagggtgaagtccaaggtattagaagacacatgccgatcacttgaccatgagaagtccagtatctgtcaagagaaagaaaccttagtttcacagttgaacataactcatcaaacactgaaagatcttgagaaactgcacagtgaattggaattgaagcatttggaagtaaaaggagaaagggagtctgcacttcaaaaggtagaagagctactagtttccctatattctgagagggaagagaattccaaagttttgaaattgaatgaagatgaattggctgagaaggaattacaaattcttattctacaagaagatgcaaattgcaagaaaaaggaatatgaggaggaactggacagagctatacatgctcaacttgaaattttcatcatgcagaaatgtattgatgatttggagaaaaagaacctctcccttctagttgagtgtcagagacttttggaggcttccaaaatgtctgacaaaatgatatctaaattggagactgaaaatgttcaaaaacagactcttgacaataacagtgggcatttcggtgaggatatgcttgaagaaggacaaatgctcctgaaccacatatatggaaaacttcaggagaggcagaaatcttttgacacaattttcaatggaagccaacaaatggccattgagaattcaattctgattacattcctagagcagttgaaactaaaggtgaaaaatcttgttacacaaagagacacccttgatgaggagttcaatatccagtctaagcagttcttggcattgcaaacagaggtccaaaagatattgcagaagaatcaggagttggagttgacaataagcaaaggagaagagagaatggaagaggatagttgcaagatattggaagagaagaagtccttgacaagaagatttctagatctgggtgaagagaaaagtaacttggaagaagaaatatgcgtcatgatccatgaggcaatagctcaatctaatctttccctgatttacgagaatattatctttgaaaaactcacggaacttaaagagctaggtgaagatcttgataaacattgttcagcaaataatgaccttgatgagagattaagaattagggatgaaagggagatgttgcatctaaaggaaaatgagcttttggaagcagttgagatgtttcatgttttacatactgagaaaacagaattgcaaagaatggtggaagatctgaagattaaatgtgatgaagctagggtgatgcttgaagaacaggctaatcaaattttgaaattgtcctcagacaaggatcatcaaaatgaagagctcatatgcctgtctgaagtgaatcagaagttggagtctaaaatggggtacctacgtcaagagcttggagaaactaaactgagggaaaagaagctaggtgatgaaattcgacaaatcaaagctcatatttcagagctaaatttgcatgctgaagcacaggccatggagtacaagcagaaaattgacaagacttctcagactataagccatccgatgcatgaactccaaatgcaagaaagtgaagatgaagatgaggttgaagatgaatattatcacgatgaagatgatggttctgaaatgagtactgatgatgaaagctag

SEQ ID NO: 48443 - DNA, 213 bp, Glycine max
  Peptide Sequence Number=SeqID_140128
cccgtgaggaatagaaagaaaggtagtaaatcgagaaaggaacacataaacttacctgtttgggctacagaatggcgtctcatccctaaaactcgagaaaatggaaagattgatagggttggacttggaggcttgggttttggtgcagtggatgagctcgtgatacaagaggcattggcaattgacagcagtgataagcctgtcctaggctag

SEQ ID NO: 48444 - DNA, 284 bp, Glycine max
  Peptide Sequence Number=SeqID_140129
cattctttcagtctcttcttcttctcatacattcaaaggtggagtagttgaagccgctggtggggagggagctagaaattgcaatggcaactcgaaggctgcagcattcaaaggtggatcagttgaagacgcggttacagcattctttcagtctcttcttcttctcatccaggagaatggcgaaagagatttttctgcaacttcgcttgctgcttcttctcaatccctcggatccatgttcaactttaactcgcttcttgcaaccaccgactcactcaattcag

SEQ ID NO: 48445 - DNA, 399 bp, Glycine max
  Peptide Sequence Number=SeqID_140130
atggcatttggtggacttgtagctcgcccagtcgagctagagctcgcccaggcggacgagactgagacagattaccactgcgtccacgacgagcttgcggcagacttcgaaggtcacgatggaggttgtggtagattgcaaaggtcatggcagggtctgattgcaacggaatggagaagaagaagagttgagaggagacgccacttcaaggagaagatgagtctagaagaagctcaccaccataggaagcaatggataagagcttggaggttgacaaagaggcattgcttccaagagaaacctcctcaagcttttggaatggtttcattaatggccgaaggcacagctagaagccattgcaaggagtttcaaggagaaaagttcaacttggataagtga

SEQ ID NO: 48446 - DNA, 351 bp, Glycine max
  Peptide Sequence Number=SeqID_140131
atggcaaaggaaaacgaagagatggaaaggaaaaagagagaggaagagttgattcatgagagggaatgggaggagagaatgaactgcaagaggctggaatggaagaagagggttgacgaggctggaatggtttttatcctaacttatcataatttttcaattcagtctgaagacttgccacatgagtttgcttacatggacaaagacttgccacatagacatatgactaacagtggaaattggattttaacagcagagacttatttgcataacggatgtaaagatagggactattttttacatttcaaaaagatagggactaatttccaaaatggccgggtacaaagatag

SEQ ID NO: 48447 - DNA, 423 bp, Glycine max
  Peptide Sequence Number=SeqID_140132
atgtcgaggtacaagactatatacacaaaggggagttgtgttgatccctcaggaaacgatcctgagacgggtgactctgataggtgcggcttgtacatagaagcagatcttgcccgcctggttgccatggggagagtttatgagggatccactattgttcataacactcctttgttgcctggccaagtaaaggtgagtgtggaggaggttacagatgcagatactccagttcctgtatccactgatggggtttccttagtggggcaggcacttcacaccttccttgcttggctgacacatctggtagttgtgtctccggcaaaaccacctccaaagcccgatccggaggtcgatgatccgctttatctaatgacattgaccatcccagagcttttattgaggccttatcaggcatctcactga

SEQ ID NO: 48448 - DNA, 369 bp, Glycine max
  Peptide Sequence Number=SeqID_140133
atggatgtgctagatggagcagcctctgcagttgggtccagtgttggaatggttggtactggtgttgctactggtgctggacttgtggggattggaattggtgcgggagctggacttgtggggactgaaattggtgctggagccagtcttgttggcagtggcatcggtgccggagttggttttgtcagcagtggtcttggtgttgttggtagtggactgagcagagcaagaatgttcatggaaaggacaatcactggccaaggagatcttatctcctctgttatgttgagtacctctagcagagagctgataaggagagatcctaaccaccctgattacggaataaatattagcataagatacggataa

SEQ ID NO: 48449 - DNA, 690 bp, Glycine max
  Peptide Sequence Number=SeqID_140134
atgcatggtaaagggacacaatctgaaattgtaaaatatgaaacagcgggaaccttaactaaaaacaccagcatcaagagggagagaggattgtccaattccatagctaaggaagtgccctgccacaagcaccagctgcggaataggattttgatctctaaatataaagggtggagaggattggatcaggggcctcaaaaacattatttctctacctggtgggctgacctaaagtctattaatgaacatcagagtatgattgatgcctctaatcaattctgctggaagatgggtaggggtgaccaaattctgttctgggaagatgcttgggctgaggatgggatccccctcaaagaccagtttccagatttataccgaatttcctctcaaagaaaccatatagtggcttatatgggatccttctccgaaagtaaagatacatgcatttgttggagttgggacaacataatgctcaacatcaagttccaaacccacataacaaccattctgaatataatggtgaaacaagtgttttggttttgggtgttgttgtgctcctcctcgttactcagcttctccccatcctacgctcccgttgacaccgacatggccggtctcccttctagccctccgatccttataagcaacggctctgattcacccattacctgttcaccgtctttcccatga

SEQ ID NO: 48450 - DNA, 273 bp, Glycine max
  Peptide Sequence Number=SeqID_140135
atgttcctcatattcaacactagtgctttgaaaggacttgatgatactccacaactgaaatccaaggctgctgctaggtggattgttgttaagtgtaatagacaaaaaggaatcactgaatgtggctactacgtgatgcactggatgtccacgataatcttaggatctttcatgaataattgggagacgtattttaatgaagttagatccattggaagcagagagattcaaggcgcttcgcttccagtgggcacagtattatctaaaagttag

SEQ ID NO: 48451 - DNA, 258 bp, Glycine max
  Peptide Sequence Number=SeqID_140136
atggaggttgtggcagactgtgaaggtcacggcaggcaagcactcgctaagcgtgacactcagtggctaagcgtaaggaagaatccagaagaagatgagctgtcaagttcactgagcacaccgctccaggtcgtcaagcacaccgcttcagcttattcgctaagcgagagaagcgcgctaagccaaaatccacttatgcgcgctaagccattcagttttgcgctaagtgcgcgagcacgggccaacccacctatttaa

SEQ ID NO: 48452 - DNA, 441 bp, Glycine max
  Peptide Sequence Number=SeqID_140137
atggaaggtttgcaacttcaacagtggctcatgtttgcaacttcaacagtggctcatggtgatcattcagtcttgatatgctttttgcccaacctagttgaggatagttgtatggatgataaatcttcaaatgccaatggggttaccactggcagtcctgttccttacttgagcacccctcctagacccccaatttttacgtcgccggttcgtccagctgttgttctatttcgtacgtcgcttgcatcacctcagccacttgcattttctttcacctcttctttgccaacatcatcatcgctgctgcaattttcaaatggatcgtttgagtcgaacaccaagtttctgatagagacttgccacatgggctacaggatgaagaaggagaaggttgaagaagctggtgtcttgctaagcgaagcatatgcgcttagtgagtaa

SEQ ID NO: 48453 - DNA, 179 bp, Glycine max
  Peptide Sequence Number=SeqID_140138
atggatccaaaaaagctttccgcgaatagatctaggagagacgccacggctgaagggaccagtgccgcccctgagtttgatagccactgtttccggagcgccgagcaccagcagtgcttcgaggccatcaaaggatggttgttccacagagagagacgcgtcttcctcagggacgagga

SEQ ID NO: 48454 - DNA, 402 bp, Glycine max
  Peptide Sequence Number=SeqID_140139
atggaagagacgaacctggaaagtgataaatctacttgccgcaaaacacaactagctagggtccaaacccaacctatgaatcgagggaggaacgaggccgatgttacctttgtgcaacgacctttgggttcccagaaaggcaccaaatgccacgtggagctcaggggggagattcacgttcagagcccaccaaacctgtctcagaaaaacgacgatctcagactcgttaaccgttggatcgttgtgaaatttgagtaccacgaatcgcataaagacagtataagtggaggtttcaatctcttcttcgtctctttgacgtttgagaattctatcggagcagtcggaggaataactgaaggaatctcaggggaactgctagagatgctgctatcgctgtcataa

SEQ ID NO: 48455 - DNA, 318 bp, Glycine max
  Peptide Sequence Number=SeqID_140140
atgacatggtcatgggaacaccacccggtgtcccctccgcagtcgaatcttcagtcggaagcaacatctaggaatacaaggaaatcaacacgtctacagaggttcactgcgaaatttgatatccttgaagcactgaatgcaaagaaaaaggtgatgtccaccgtcgccagtagatggaggcaatttaaatcaaacctcgccactaaatttgtctatggtgactctaaaggacaacatgaccatgatcattccgtaaaatattccctacataaagaaacttgggaggaatttgtcgcaagccgcaaaactcctaactag

SEQ ID NO: 48456 - DNA, 832 bp, Glycine max
  Peptide Sequence Number=SeqID_140141
agttattaacggtgacgctgaagttcaatttccgacatcagagattaaggatgtcaggcaggcccttcacacattccttgcatggccaacaacacttgtaaaattggcctctaatgagcatgagggcactagtccaagtaaagtcactgaagctgttcaactgatgaatgatgttgttgtagatgacctgttgcgcgagttgattaagaccctagttgacatttatgaaaagcctgtacagttggtgtgggatgtaactaaatttggaattccaaatgcagttgcatcgttgttcataacctgtgctgatgtgattgaaataatatcaggcgtacagtgtttgaacatagctatactacaattgtggaccatgtatatggacgattggagtaaaaacttgggtcttggatcgatgtatggattccttgagccgcaggctatactgaattcaaaggatagacgtcgacaatgtgaagaatacattgaaaaatggcttaaggaatcgaaccgagatgtctatctaggcgcttatttgaatcatgcatttaagagattgaaaaccagtactgaggggaaatttcataccagtacactgcggtggattgaagtgaagatgtatatccttcaggttgaaactggttcaaatgatccttcagtgcctcagtttggtgttttcaacaagttgattggatgggattttctttgtcttttggtttcttggctggtttggtatagcatgaacgatcggatctacgagctgggttctttgtcgccatttgtgttggtgtttgcgggacacgtggctctttactgcaagatcaggaagccttag

SEQ ID NO: 48457 - DNA, 1788 bp, Glycine max
  Peptide Sequence Number=SeqID_140142
atgggatcaagtcaaacgccttcgcataaaaagaggttctatcaagtcaaggtcaagagcctaggaatcaccagtctaaaagagttagggcagttgacgggtcagctccagcggcaagcttttcgcaaagcttacggtaaaatctgggacctagccatggcagaagtctccacagaggccattgcctccctcgcccagagaccatacctcttctcagggttctatccctcattagctagaatttctaagatagtccaaatctcggcgcaggaattagaccacagaaagcaagtcgaaaatggggtggttggaataccgagaaaatgtttggaggcaaaagcaagaatcttggcaggtagaggcgaatgggccccgttcatagaaattctcacactgttgatcttcggaggagtcctctttccaaatgtggatgggttggtggacctagcagcgatcgacgcttttctcgcctatcatgaccacaaggaaagctcggttgtcgctatgctagccgacctatatgacaccttcgaccgaagatgtgagaagagcagttcgaggattgtttgctgtactccgactctttatgtatggttggtttcacacctttttcgccaagaggagcgtctgtcagctggttccctcgatggaaagaaggaggaaccggggggttgcatcagttacaatctcgttcttgctataaggcaacttggctaccctatgagaggggcaccactagaggaagagctcacgcctgtcatttcacaaggtttcaataagaccaacgtggaggtacttcagaaggtccgcaaggcatgggaggtggtgcaaaagaaggacaaagaactcaggggcagtaacaatgggcccatcggtggctaccgtaagtggttgaaagcccacgtgcaaggtttggattggctcccgagtttgagaactgctaaaagggaggaagttgaggcaccggaggaagacgaagaggagaatgccgaactgagagatataaatatagctaccaccaaagccttggaacaagaaaccaagagggctcgtagggaagagcacggccggaacaagttccgaggggctctgtggggcaaattagagaccaacatgctagccatcgtcagcaggtaccaagaagatctaaatctagccacgacccacgagcatagagtggcggacgagtatgcccgagtgtatgcggaaaaggaggctagaggaagggtgatcgactcgttacatcaagaggcaacaatgtggatggaccggtttgctcttaccttgaacaggagtcaagaacttccccgattgctagccaaggccaaagcgatggcggacacctactccgcccctgaggagatccacggacttctcagctattccgacatgtcggctttgaaagagcaaatgacttccatgatggaggccatgttaggaatgaggcaactcatggagaaaaacgtggccatcgctgccgctgttaaatggtgcgattgtaacagacatttgttattggctgcttgcacaatagagactaaaggcccgattttcacagcaatgttcacccctctagctcttataatcacagcaatattctcagcacttttgtggaaagaaacactttacttgggaagtgttggtggcactgttttactagtggttggactctacagtgtcctttgggggaagagcaaggagagtgtaaaggagggtgtaaaaggagaaaacctagaagttgaacaaacaaaagaggaaaccagattggagtgcattgtaaagcattga

SEQ ID NO: 48458 - DNA, 252 bp, Glycine max
  Peptide Sequence Number=SeqID_140143
atggcttggtggattgtttggaacaattctgtttttaaacaggaagttcctattcctaaatttgaatatagcgtctacctctctgtctgcgtaactctgatggctcgtccaggtggttcctgcaacaatcatggaggtgatcctacagatccatcgcaagatccttcaagcccgtattatgttcatgcaggagatggaccttcatctgtagcagtcactcctgtgctaaatggctctaattaccatgcatga

SEQ ID NO: 48459 - DNA, 222 bp, Glycine max
  Peptide Sequence Number=SeqID_140144
atggaagatttggcaagaagcattcagaatccacctgttgattggcatggtgatccttgcctacctaagggaaattcttggactggggttacatgctctaatggtttccatgcacaagtcatgacactgaatttgacaaatgccgaggtgtcagggtcacttcctccaactcttggccatctaagtggactggagcatctgtatggaatgttgcccttttag

SEQ ID NO: 48460 - DNA, 477 bp, Glycine max
  Peptide Sequence Number=SeqID_140145
atggcagctcacccaggtgagctgagacttactcctgaagtaactggctcgcccaggagagttagttccttcagcctaaagtcttttggtggcccaggcaagccagaggctagcctgggcgagctagggtctaggaaactcaaggaaaagcctgggcaagctagcctgaagtcttttgaacaatctttcgttttgtgcgatctttgtatagactgtggctcaaggaatccatacacattgaccaccgtgagctatctcagaaagatcttcatgctttatgtacaatgtggagttatcattatatcattatacaccccaaacacgctagcatcccgcgacacttgcaacgacttcaggaaaagcttcggaatgatcaatgtcattaggtaccgcatatcgatgtcaggatccaacatatctacaggtttcactggtccctcagctacctacttatcctacacagttaataaacattaa

SEQ ID NO: 48461 - DNA, 291 bp, Glycine max
  Peptide Sequence Number=SeqID_140146
atggtgactcgtggtggccagcggtggtcgttggtggtggagaagaaggtgttaggatttgggtgggtgtttggagaggaggagagtgaaaaaatcgtgtttttcacgttgaagaacattaagattcctttttctgaggcattggagcagatgccaacatattttaaattcatgaaggatttgcttaaaaaaaagaaaagaattatggatgatgaaatagtggagcctgagccacaacaaggacatcaagttcaaaagatgataaagaagtgctcctgggaggcaacctga

SEQ ID NO: 48462 - DNA, 483 bp, Glycine max
  Peptide Sequence Number=SeqID_140147
atggggtttccagcattgatcacgggtctctgccagtcattcggggttcccgtcacacctagtaaggtgattcgaccgccgatcacccgggccttcattgagaagtattgcacgcctagacaggcgcagggtgatgcaccacaggccgcagacgcgccgccaccacctcatcaggctgacgcagctgggtcatttgatacggatcgtcagcagagccagggcttcgctccttttgcgtgccctactccagatcagttcaacgctgaggttgcatggcccatagattggcttgaggcccaggtaggggaggtgcccgcagaggctcctggtgatgcagaggaggcccgcatggatgaggagatgacagatttactcgggactaacgtttgttttgttttttcgattgtcttttgttttgtgcatacgttttgtttggactgttgcgttagtgtttacttcgttattatcgataatgtttgttga

SEQ ID NO: 48463 - DNA, 177 bp, Glycine max
  Peptide Sequence Number=SeqID_140148
atggcacgtaacgtgtttgctccgtgcccctatttaagggacctacaagggagagaactaactagtggagtcgccaactgtcgcaacctacccttcggcgagagggcgacgcgtgactcgcgggatgcgtgttccacgaaaggaatacgcgcggagtcgccaccaacgtttatttga

SEQ ID NO: 48464 - DNA, 354 bp, Glycine max
  Peptide Sequence Number=SeqID_140149
atgccgtgggagtcgtccccttcgacacttcaccaaaaaattgaagttcgcgatgggtggactttagtgatagtgtcgggtgaaagaggatatgttggtgagctgcccctcctccacaccatacgtagaagcagcggaagaatcattggaaaacggttttcccaatccttcaaggtggtgagctgcgcttctgtggaaccaagtccgttgctaccttctctctccaacgcggccataatggtggcacgggttatgatcaagaacggatttgagcccggaatgggtctaggcaaggacggcctcaggaatgctgacggtgaggaggaatgtgccgtcaagacttcgggcggatag

SEQ ID NO: 48465 - DNA, 384 bp, Glycine max
  Peptide Sequence Number=SeqID_140150
atggtgaaagttggaacctcttacgtgccgatcaacgtctcattttcgccaaaagttggcccagggcttcccggtatttattcggcgcaaagtgcgtcgggtgatgctgccaacttactgattagtcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 48466 - DNA, 825 bp, Glycine max
  Peptide Sequence Number=SeqID_140151
atgcgtactgattgcttagtccaattcgccattctcaacctttttccgagccccatgaattgcgttttcgttcatgtgtcctccaccttcgagtttggagctatgcgtagtgattgcttagtgcaattctccattctcaacctttttcggagccccatgaattgcgttttcgttcatgtgccctccaccttcgagtttggagctatgcgtagtgattgcttagtgcaattctccattctcaaacttttttggagccccatgaattgcgttttcgttcatgtgtcctccaccttcgagtttggagctatgcgtagtgattgcttagtacaattctccattctcaacctttttcggagccccatgaattgcgttttcgttcatgtgtcctccaccttcgagtttggagctatgcgtagtgattgcttagtgcaattctccattctcaacctttttcagagccccatgaattgcgttttcgttcatgtgtcctccaccttcgagtttggagctatgcgtagtgattgcttagtgcaattctccattctcaacctttttcggagccccatgaattgcgttttcgttcatgcgtcctccaccttcgagtttggagccatgcgtagtgattgcttagtgcaattctccattctcaaccctttttcggagcccatgaattgtgttttcgttcatgcatcctccaccttcgagtttggagccatgcgtagtgattgcttagtgcaattctccattctcaaccctttttcggagccccatgaattgcgttttcgttcatgtgccctccatcttcgagtttggagccatgtgtag

SEQ ID NO: 48467 - DNA, 218 bp, Glycine max
  Peptide Sequence Number=SeqID_140152
gggaggagcttgccacccagctcgcccaggcgagccaggttgcttcctccagaagcaaccgccttctggaggaagaatctggaaggcccaagtgggcctgcgctaggcaatcaattcatgggtctccgaacaagatttcgagggtggaggataggcgaacagcgctaggcaatcaattcgcggggctccagactcgttggtggaggatgcatgaatga

SEQ ID NO: 48468 - DNA, 603 bp, Glycine max
  Peptide Sequence Number=SeqID_140153
ggttatcaaaccgtggtcgccgccgatggcgcaccgctttccggcgggcagaaacagcgcatctcacttgctcgggccttcttctgcgaccccaaattcgtggtgctggacgaaccgaactcaaacctcgacacccagggtgagcaggccctggccaaggcgctgctgcacgccaaaagacagggcatcaccactgtcacaatcacccagcggcccgcgcttctgcaatgcgtcgacaagatcatggtgctgaaagacgggtcggtcgccatgttcggcgaaaggatggacgtgctgaaagcgctctccggcaatggccgccaggccagccagaaaaagaacgccattgccgaagtcaaaccacagggtcagctggaatggtacagcgaggtaccgcgctcaatccgcctgcacatctcgatcggtcttgccgtgctgctcgcctccttcggcgggttcggctactgggctggcaccgcgccgctctcctccaccatcatcgcccagggcagcttcgttgccaccggcaataacaaggtcgtgcagcatctggaaggtggcatcatcaaggagatgatggtcagcgaaggcgacacggtcaag

SEQ ID NO: 48469 - DNA, 258 bp, Glycine max
  Peptide Sequence Number=SeqID_140154
atggtggggtacacaccttcaagttttacagatttggtcttcgccagcaaaaggatcaaagtggttctgaaaagaggaaaattcaatcatcctgcttggacgactgagaaaactagggcaaatgaagagggtgagaatgaaggagaaacccatgctatgactgccattcctacatggccaaacttcccaccagcccaacaatattgttactcagccaataacaacccttctccttacccaccacccagttatccataa

SEQ ID NO: 48470 - DNA, 198 bp, Glycine max
  Peptide Sequence Number=SeqID_140155
tcttccaaagtaacccatgaaagcgatcaagggcttcactcaatgattcatgagggtgttggtggaaggatgagatttccacctttccctcaatggtcttggactctaagaaatatttcttcaagaacttctccaccacctcgtctcatgcactcctactatcttcaccgtgttgcaaatgtcgatgtatgtggccag

SEQ ID NO: 48471 - DNA, 258 bp, Glycine max
  Peptide Sequence Number=SeqID_140156
atgactaaagcacgtcaaaagggggtacggaaagtaaatgaaacgagaataaaagaaaatagaggaggagcttgccacccagctcgcccaggcgagccaggttgcttcctccagaagcaaccgcctttctggaggaacatcctggaaggcccaactttcagaatattacggaaactcacggattgcgtaacaatacttccttttgatttccggcatgttacagaatttcacggattgcgtaacaatgcttccttttga

SEQ ID NO: 48472 - DNA, 198 bp, Glycine max
  Peptide Sequence Number=SeqID_140157
atgtcttttctgatggcagtgatcctagatgcaatggaagaatttctccaagaacaccctcttaaggtcatcccagctgaaaatagacctgggagcaaggtgcgtgttccaagaaaggaatccacgcggagtcgccaccaatgtttatttgaggaaaacattggaaaaaccggaaaagacgtaatctacaaactctaa

SEQ ID NO: 48473 - DNA, 159 bp, Glycine max
  Peptide Sequence Number=SeqID_140158
atgtcagtgaaaaacctcgtcaggcgcctaggagtacatgacaagacaaaccacacactagcatgtcaagtcactctcactaggcttaaaggagcactcaaactaggtgacccccaaggcctacactctgaagagtccatcagggcctctccctcctga

SEQ ID NO: 48474 - DNA, 723 bp, Glycine max
  Peptide Sequence Number=SeqID_140159
aaagacttcaaagcagaaagggaaaaacccccattaagaggtctggacctcatcaaggctgctggactactgaagacagtcatcaagttgggagactgttatgaaagtctagtcagggaattcattgtcaacattccctctgaaataacaaacagaaaaagtgatgattatcagaaagtgtttgtcagaggaaagtgtgttagattctcccctgctgtaatcaacaaatacctgggcagaccaactgaaggagtggtggatattgacgtttctgagcatcagattgccaaggaaatcactgccaaacgagtccagctttggccaaagaaagggaagctttctgcagggaagctaagtgtgaagtatgcaattctgcacaggattggcgctgcaaactgggtacccaccaatcatacttccactgttgccacaggtttggacattgtatcgacatcagggaaagctgctgcttcaggtgctgtgtccaaggatgctttgattgctgaactcaaggacacatgcaaggtgctggaagcaaccatcaaagccaccacagagaagaaaatgaagctggaacggctgatcaaaaggctctcagaaagtggcattggtgatgaagaagcagctgaagaagaagaagaagcagctgaggaaaaggaagaggaagatgcagcagaggatacagattcagatggtgatgatgattctgaagctaccccatga

SEQ ID NO: 48475 - DNA, 1023 bp, Glycine max
  Peptide Sequence Number=SeqID_140160
atgtcctctcgggggaagaaaaccatatctttcctccgggtgtctcccctctttgagcagaattgcaactgtggtcaaggattcagcaagaggtttggaccgcataaaacagactcggaatggcatagcgggcctaccacggagcttttggctgagataggtggtagaacaatcaattggttcccccgatggaaggaaggaaaggagggagtcattttctcatgtggagggtacccaaacattctgctgataggaacgaggggttgtattaactacaatcccgtgctcgctataagacaactagggtaccccatgaggggagcaccgacggaagaaagcatgtctcctttccttgtgagggatttcggcgcacaaaatttcaaggctatacaagcaatccataaggcatgggaaaccccgttaaggaaagatcaagaacttaggggcattcgtaatggcatcattggtgggtaccatgaatggctgaaagttcatatacgaggtttagattggctcaccaagttaaaagtcgtcagcgaagagagttttgaagcaccggaagaggacgaagaagtccaagctctcaaaagcgagttaggaaaggcgaaacttgccaaagagaagttcaggttggccgctacacacatccggaaggagtgtgccggattacgggaagagaatgcaactaccacacgagcccttgaacaagagaccaagagggctcgcaaggaagagtatggccggaacaaatttcgcggagctctgtggggtagcaacaatgaactcaagctgcgaagggaagagagggaccaatcgcgagcacatagcatggttttgaaagaggagttagttgcctgttcaaggtccaaaagaagcttgtctcagcgtttatgcgagatggagaccaacatgctagctatcatcgccaagtaccaagaagagttaggtctagccacggcccacgagcataggatcgcggacgagtatgcccaagtatacgcggaaaaagaagctagaggaagg

SEQ ID NO: 48476 - DNA, 327 bp, Glycine max
  Peptide Sequence Number=SeqID_140161
gggaaaattgtctttaggactggctcggttcaagtcccggtagtctacacacattcgaaccttgccgtcttttttcgggactgggacaatgttggccacccactccggggttatcaagccttggcggataggcgcggtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggctcgggagttgtatttacgcacggggaaagtattag

SEQ ID NO: 48477 - DNA, 616 bp, Glycine max
  Peptide Sequence Number=SeqID_140162
gaaatggacccttgcagccgatcaggacagtgtcgaggacactgtctgtgacaaatacgacatcagcaaggaaaagtgggcccagttttgccagactcgcagagacccttcttgggaggatgtgcgcatcaaggcacagaccatccagaagcagaatactgccccccacgttttgtctcgtgggggttatgattatttggagcagaagctcctggctaagaagaccaagaagaagctgcaggaagctgcacagtcaggaagcgttgatggcgtcatcgaccctccatctccggtcagacgccacgtgaagtggaagatggcctgcacgaagaagacaggggagatgacgactgaggccgcaaaggaaatcgctgagaagattaatgccatgtaccactgtgtgttttctgtgcaagattcgtttgaggagcaggccacacagggatcattcgtcccccatggacgtcaggatgttctggccgctgctattgggcgtccagagcaccctggacgtgtctgtgctgctggagccggtgtcaccatcaagcaatactttggatcggctccacggacgtcccgcaacacttcctccctgccttctaacaaattacagtag

SEQ ID NO: 48478 - DNA, 733 bp, Glycine max
  Peptide Sequence Number=SeqID_140163
gtccggaaggacaaggcggccgaaggaactagttccgctccagagtacgacagtcaccactttaggagcgctgtacaccagcagcgcttcgaagccatcaagggatggtcgtttctccgggagcgacgcggcgccggcggtgggcaccactggttactcctatggccaagtttgatcccagaaatagtccttgagttttatgccaatgcttggccaacagaggagggcgtgcgtgacatgagatcctgggttaggggtcagtggatcccgttcgaagccgacgctatcagccagcttcctgggatatccgatggtgttggaaagagggccaggaatgcgagtatggccagaggaggaaccgggaggcgagtgcaaatcatgcgcaccaatatgaccaccctgacccagatatggatgacgttgctcctcagcaacatcctgcccaccgatcataattccgacctccccatgcctaagtgtcagctggtgtacgccatcctgacacggatgagcatccatgtggctcagttaatcgctgatgccatctatatttttgcaggtatggcgcccactaggcaccctttggacccagataagtccaacagggccctgggattccccgcactgatcacaggactctgccagtcgttcggagtccccgtcgcacctaccaaggtgattcggccgcctatcacccgggcttttattgagaagtactgtacccagagacagg

SEQ ID NO: 48479 - DNA, 591 bp, Glycine max
  Peptide Sequence Number=SeqID_140164
atggcttctaggaaaagaaaggcaccctctacacctacccaagccagatttgatagatctagattcacttcccaagaggcttgggagagatacactgacattgtggtgcctcgcaagctactaccagagaggaatgtggtagtttattacatagagtttgacgagttcaaggaggaactcgagagaagacattgggatgagaagctgactgatttttctgacagcagtatagacatcgccattgtgaatgaattttatgccaacctctatgaccccgaggataaattacctaagcagttgagggtgagaggtcatttagtgaagtttgatgaggataccttgaacacattcttgaagacccctatagtgctggaagagggggagaacttgtgtacatattccatatttgcacttttaaggcctgatcctcaggagttagctgctaagctttgtatcccaggaaggggatttgagcttaatgctgataggcagcctttgaagattctgaggaagaacatgaccactctagctcagacattgagcgttctttctttttctaacctcattactacctacctcccacacatctga

SEQ ID NO: 48480 - DNA, 402 bp, Glycine max
  Peptide Sequence Number=SeqID_140165
ggccttccggtcactttcaacagggacaccaggatgatttttgcgaagtttggcttccgggatcacagcttattggcgcaataccgtgcgcctcggggggccgaccagcttttgttcccttgtagtgaggtgttaatttcgagtgctctggcgtatcatggtttctatcagctgtccttcctgttcagtatgacgggaattgttatccgcctaactcaccacacccgccgcgttaattgcgcttgcgctacagggctgcccgctttgccaggcgctaaagggcggatgtgctgcatactggcgattactatgttgggtacactgatgccagggtgttcccagtcagaatgcgttcgtggcaggagaaaaaaggctgcaccggtgcgtcagcagaatatgtag

SEQ ID NO: 48481 - DNA, 306 bp, Glycine max
  Peptide Sequence Number=SeqID_140166
atggggagagatcaaaataactattgtactgttcttgtatgcaaagaagatcttctgcaggacttagaggcagtaccaattctagaggaagaacctcaatcttctgaggcatcttctagttttcctattgtagaacattctcatttagatcctattgatgactacatcatggctgaagagctaagaagagttactctagaagattattcaagttctaatgtgccacaatttttcaccagcattgcacaaccagaagttcaagcacaaaccattacttatccaccatcattgattcagttgatttag

SEQ ID NO: 48482 - DNA, 126 bp, Glycine max
  Peptide Sequence Number=SeqID_140167
ctggacgcatgatggcttgtcggtcactgacctagtactttgcttacctttggctttggacttggtcgcctatgggtcggccatgtgtcgtagcaacgctcttaccttttttatggatgagctgag

SEQ ID NO: 48483 - DNA, 285 bp, Glycine max
  Peptide Sequence Number=SeqID_140168
atgatagtggcccgggtgatgctggggcacggctacgagcccagaatgggtttgggcaagaacaacggtggcaggaccagcttgcgagccaaagaggccccaccgtgccacgtcagtaggagcttcataagtgcgggtttaagaggcaaaggtcaagtcatcgcgatatgcgatgatgactccccgaggagatcagatttggtatggtcatgccctctcggtttccaactaggaaattggcgggtggaggaacgcccagacgtttacgcgacaagcataatgtaa

SEQ ID NO: 48484 - DNA, 369 bp, Glycine max
  Peptide Sequence Number=SeqID_140169
atggtcatcattgtcaatgcggaagcttgtggttacgtgagcatgaactactaccaatatatagatgttgtttacacaaatgagcacatcttaaaagcttactccgcacaatggtggcctcttgggaatggagcggttattcctccttctgatgacgcatggacacttatccctgacccaactacaattcgtgcgaaaggtcgtgcaaaatcaacaaggataaggaacgagatggagtggctcgaaccatctgagcaccgacaaaattgtagtagatgtggagcagaagggcacaataggcgtcgatgtccaatgcaatctgaccgtggagtaattcatttaattgatttatgtatgttagatgagtga

SEQ ID NO: 48485 - DNA, 246 bp, Glycine max
  Peptide Sequence Number=SeqID_140170
atggcaattcaggctgatgaaggtagagctgaagagaaggtggagggatataaacaacagttggcagctgagtcagcactggaaccagtttttgattttgttgaacttgaggaagttgtggaagatgaagatgaccaacaagagaaagagacaccaataaaagatagtcaagaagttgttgtgggtaaagctctcatagacttgggagctagtatcaatttaatgcctctctccatgtgccagtga

SEQ ID NO: 48486 - DNA, 371 bp, Glycine max
  Peptide Sequence Number=SeqID_140171
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtcttgatatattatgcgcctgaatctgacctccgtgtgaaaacttatgaccatttgaatttctcgagagcttctgttgttcaatttcgagcgtctcgatatcttatgcgcctgaatgagacctccgtgtga

SEQ ID NO: 48487 - DNA, 609 bp, Glycine max
  Peptide Sequence Number=SeqID_140172
ttgttagatgcttcagcaggaggaaagataaagctgaagacccttgaggaggcaactgagttgattgaaaatatgtttgttagtgatcatgctattctacgtgatagagtgcatcaacccaccaagaagagcttattggagttatcatcacaagatgctgtgttggcacaaaataagttgctttctaagcaacttgagatcttaacagaaacaaccagtaagttgccaactaaattgtctactggtcaaccttcgcagtcttctgttttgcagcaaggtccctacaatcagcaaggacaatggagatcacaccctggtaatcaattcaataaggaccagggtggaacttccaataggccacctcaacaagggcctaatattttccagaggactaccaaactggaagaaaccctggctcaattcatgcaagtgaccatgtccaaccataagagtattgagtcagccctgaaaaaccttgagattcaggtgggtcaactagccaagcagttagctgaggagtcatccaacagctttggggcaaatactgagaagaatcctaaagaaaatgcaagttgttgtaacaagaagcaggaaacttgtggcggctga

SEQ ID NO: 48488 - DNA, 418 bp, Glycine max
  Peptide Sequence Number=SeqID_140173
cctgaaaccgctcaacatcattcaccaaaacgctgatcccgtcagcatcctcggcgacatccggaaacttgaatacaatgttctgggccgaagggatgaacggagccccgattacagggaggatacttccaagctccgcaccgttgagcagagcagctgctgtttgaaggatgctgtcgaagccccatcttgcgatgccgttgatgaacaggccgaccaggagaccttggtacatgagactgggtctggtttggatggttgtcccggggaggaagaggagactgaggatgtagtggtggattcggaggttcatgtttggtacaacgagaagggcgacaatgccgcagaccatgatgccgtatatagacagcattttggggagtctgccctcgttgcggaaggcgagggcttgggttaa

SEQ ID NO: 48489 - DNA, 426 bp, Glycine max
  Peptide Sequence Number=SeqID_140174
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattccagctcgctag

SEQ ID NO: 48490 - DNA, 879 bp, Glycine max
  Peptide Sequence Number=SeqID_140175
atgaaggttggatcttctcaggtacaaaagaccaatgtgaggattgttgctgcaaccaatgtaaatatgatgaaggcgatccaggacggacggttccgcgaagatttattttatcgtttgaataccgtgcagatcgatatgccgcctttgagagatagaaaaggagatattcatctgcttttcagaaagtttgcaatcgattttgctgaaaaatacagaatgcctgagttggttttagagccaagtgcagttcattatatagaaaattatagctttcccgggaatgtacgtcagttaagaaacttagttgagcagatgaccgtggtggaaagagaaagaaatataagcgttgaaaaactggcggagtacataccgaccgaaagccatttgccaatggttgttaatacgcctaatgctcagaaacagagtgacttcggaaacgaaagagagattatgtataaaatcctgtttgatatgaggaatgatatcaatgatctgagatctctgacttctgaattaataaaaaacagaggagcaggcgatctaagttcccaggaaaaaactttgatcaacagactttacacttcggattcacagcagaatactaatgctaattccctactttattttgaagataatcatcctgtagtccagactccaactattatttcgactcccgatgatagttatgaagatattcaggatatagagattgaagaaaataagccggaatcactttcgcttcaaaataatgaaaaagatttgattattaaagcattagagaagcataagggacgtaggaataaagcagctgatgagttgggcatttcacaaagaacactatacagaaagataaaacaatataatctagaagactaa

SEQ ID NO: 48491 - DNA, 111 bp, Glycine max
  Peptide Sequence Number=SeqID_140176
atgtggacaaccacgggggagaagcttgccgcccagctcgcccaggcgagcaaggttgcttcctccagaagcaacagccttctggaggaatcttctgaagggcccaagtga

SEQ ID NO: 48492 - DNA, 201 bp, Glycine max
  Peptide Sequence Number=SeqID_140177
aaatttccaggatgtcacaaggaggacccagaggagctacctcttgagcctgctgtggatgctcttgactttctagagggtgatgaggacccactccctgaggtggattctcccgaggacgtcatgtcggcatctgaggcagactctatggaggagagcggccctagagagatggcgactagtggaggctcttcattatag

SEQ ID NO: 48493 - DNA, 258 bp, Glycine max
  Peptide Sequence Number=SeqID_140178
atgttgatgtgtaatcgattacaccttgatgggtacatcctttgtggtacaagtagagggtacatctacttgggttgttatactgagaacaagagagggtatatctcttgtggatcagttcaagtggagggtacatccacttggttgttcaaagagaacaagggagggtacatccctcgtggatctttggcttgtaaaggattttacaaggttgaaagaaatctcaagaaccattggtttcttggggactggatgtag

SEQ ID NO: 48494 - DNA, 396 bp, Glycine max
  Peptide Sequence Number=SeqID_140179
atggcggcgcagctaatccgtgatcgagtagggatggagtgcctagagggagtttgggagaccctcgaaggcaacacgaggtgccgatttcggggcaccattcgattcacggccacttctttggtgcatccagatgaacctgcacggacgcttcagcgcacggtgaagtggatactacccacgcctacaccatatcgcctagtggagcctgttcaagaggacctggaggagctacctcctgagcctgctgtggatgcccttgactttctggagggtgatgaggatccacttctcgaggtggattctcccgaggaagtcatgtcggcatctgaggcagactctacggaggatagtggcccgagggagatggcgatcagcggaggctcttcatcctag

SEQ ID NO: 48495 - DNA, 57 bp, Glycine max
  Peptide Sequence Number=SeqID_140180
gtaaatgccacaaagatgtcttcttcaccagctcatttgagaggtgatgcaatgtag

SEQ ID NO: 48496 - DNA, 240 bp, Glycine max
  Peptide Sequence Number=SeqID_140181
gaagcaacctggctcgctttgggcgagctgagctcgcctgggcgagctgagctcgcctgggcgagctgggcggcaaccaccctcccctattttgctataaataggggaggaagtgaagaagaaaaggccgaggcgcttccgaaacgtttccgtaacgttttccgtgaggaatttcgcaaaggtttcaaccgttcttcgacgttcttcattcgttcttcatcgttcttcgatcttcaacgg

SEQ ID NO: 48497 - DNA, 765 bp, Glycine max
  Peptide Sequence Number=SeqID_140182
atggcaatttgtggccatatcggatttctagacctatttttgacattaacgtgtaatctagcttggcctgaaatacaaaaaaaggttaggaaatccaatctcacacctcatgactgccctgatgttgtctcaaggatatttaagatgaagttaaatcaattgatgaatgatctcaaacgtggacatgtctttggtcctattctgggatttatttacactattgagtggcaaaaaagaggattgcctcatgctcatattttgatatttttgcaacttgcaaacaagtatccaaatccagaagacattgataaaattatttctgcagagataccaaataagtacacagatccagaattgtatcaaattatctccaagcatatgattcacggtccatgtggactcccaaatagaagtgcaccatgtatggctgatgggaagtgtattagattttttcctaagaaattcaacgaagctacaattgtagaccgagatggatttccagtatataggagaacaaatgacgggcgtacggttcagaagcatggtattgaacttgataatcgctttgttgtaccatacagtccacaattgctactcaaatacaggacacacctgaatgttgaatggtgcaatcagagcacatccatcaaatacctgtttaagtacatcaacaaaggttctgatcgaattacaacatctattgttaatgtgcagaaccaaaatggcagacaacatcaagttgacgatgaattaaacagtatctga

SEQ ID NO: 48498 - DNA, 240 bp, Glycine max
  Peptide Sequence Number=SeqID_140183
atgtttcaggaagtttgccatgggattgctgagaggttggagcaccatctgaacctaggggtggtcacgccaggctcatcgacacatgaggtaatcgaagaatgcctcatgatggccaggagtgtcacacaggaccagctagtatatgttaagtctcgacgcaggaggcgcacggatcaggcgtactttatttacatattttatattgatattcgatgtatatacagatattgtacttga

SEQ ID NO: 48499 - DNA, 423 bp, Glycine max
  Peptide Sequence Number=SeqID_140184
atggtcattgatgctgttgtgtggaaggaagtagttagtttggacatgggtggagtctgtaagtttgatgaaaatcttgatgggtatagcatgatgcagacttataggggaatgcttcttgatttagctaggaacttgaggaatcacttaggagttggtggactgactgtagaagacagaatgttggtttaccttatcacctacattctcacttcgaggttaagcaatcatgctcaagaaacaaatgatgttgtggaatttaccaaagtgtttagtgggattaccgaaaggcatctcaagaagcttagaatgaggtttattgatcatgaatggataatggctggagagccggtagctagaaactttgaccaaatggaagaagatgctaaagttgaagctccacaagagcctgcacatcaatga

SEQ ID NO: 48500 - DNA, 774 bp, Glycine max
  Peptide Sequence Number=SeqID_140185
atgggtcatcttcaatggcaagccttccgcaaagcctatggtaagatatgggacttggctatgatagaagtctccatagaggcgattgcatcccttacccaatattatgatcaacccctgaggaagccatatcttttctttgggttctatccttccatggctagaattgccaaggcaaagcccatggcaagtcaaggcgaatgggctcctttcattgacatcttggcactttcgatcttcggagttgtcctctttccgaacgtggaagggttagtggacctagcggcgattgatgctttcctcgcctttcaccatagcaaggaaagctcggtcctcactattttggccaacacgggaggtatgtttgtccactcatgcgccaaaaaagacaaggcgaattgggaccaactcttggctagcatggaaggagcatccgttaattggttcccttgctggaaggaaggaaggaccaggattctaatttcatgcgaaggattttcaaatgttcccttgatggggacgattttagtgaccccaacgcgagggtactttgaggaatttgcaaggcatgggatgcattgcaaaggaaggacaaaaagcttagaggaagcagcaattgaatcatcggtggctatcgtagagcttgagaaagcccaagcagtcaaggaaaagttcaagtcaacagtcatcaaagttcgaaaggaatatgatgaactaaaagacatcaacatggccaccgcggaagccttggagcaagaaaccaagagggcctga

SEQ ID NO: 48501 - DNA, 315 bp, Glycine max
  Peptide Sequence Number=SeqID_140186
atgggtcagattctacaggaccaaaccttgtgggagagtggcagtaagggtgacttatctgtcaacttttccactattacacccaaaaaaccaaactctgctttacgtaaagttgccagagtacgcttaacctctggatttgaaattactgcttatatacccggtattggccataatttacaagaacattctgtagtcttagtaagaggggggagggttaaagatttacccggtgtgagatatcacattgttcgaggaaccctagatgctgtcggagtaaaggatcgtcaacaagggcgttctagtgcgttgtag

SEQ ID NO: 48502 - DNA, 408 bp, Glycine max
  Peptide Sequence Number=SeqID_140187
atggcaatgatggtggcccgggtgatgttggggtacggctacgagcccggaatgggtttaggcaagaacaatggcggcagaaccagcctggtaagcactagaggaaaccacgggaagttggggttaggctataaacccacgcaagcggacataaggaaaagtatcgcggaaaggaagaacagaggccaaggttcgcggtggggacaacaagccgaaggggccccgccctgccacatcagtagaacctttataagttcggttctaagacacgaaggccaagtcgttgtgatatgtgaggatgactccccgagtaggtcggatttggtacgaccatgtcctcctggtttccgactaggaaattggcgagtggaggagcgcccggacgtttacgcgacaagcataatgtaa

SEQ ID NO: 48503 - DNA, 462 bp, Glycine max
  Peptide Sequence Number=SeqID_140188
atgtttggaatgaggaatcagacagaaaattacatatcagacgagttgtccccatctatcaaggacaagaagaaataccaaagaaaattattcatctgcttcgacaatctagaattgttgggagttagatcacaggaaggtgaacttcaaggcagtgtggtcaaattaagttggctggttcaccatttttcacaaataaatattcatgacggtaacgtagaacaactacagaggtttacccgtgcatggatcctcatattcataagaggtgttctatttgttgacaaaagtagcaataaagtttccctaaggtacctccaatttttacatgacttgaacagtgcagcacgtatgcatggagacctgtcgtgcttgcttatttatatagagatgcccagcgccaccgattacaaaattaaatcaattggaggtatgtgcatcttaatccaaatgtgggcatag

SEQ ID NO: 48504 - DNA, 282 bp, Glycine max
  Peptide Sequence Number=SeqID_140189
atgtcctccaccaccggacaacgtcgtatgactcctgcagaacgagaacaatatcggaatgaaaattgtcaatattgtgataaaatgggccatatagcaaagatatgttggtgggtgtccaagaaaccaactcaatttgatgatatacctcaagcacttgcaacccttaccttagacaacacaattgctgaaacagaatggacctctaacaccggggcctctaatcacatgataggaatgagaaacagggaaaccgattatcaccgggaggcgcaagggtga

SEQ ID NO: 48505 - DNA, 708 bp, Glycine max
  Peptide Sequence Number=SeqID_140190
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggtgataacaacaaagggaagattctaggcattggtaatggggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48506 - DNA, 201 bp, Glycine max
  Peptide Sequence Number=SeqID_140191
atggctcctgatgggcggggtcgaatgccttctgctgtgggttatcaacccactcttagtactgaaatgggttctttacaagaaagaatcacttctaccaaagaggggtccataacttctattcaagcagtttatgtacccgcagacgatttaaccgatcctgcgcctgctacgacatttgcacatttagatgctactact

SEQ ID NO: 48507 - DNA, 237 bp, Glycine max
  Peptide Sequence Number=SeqID_140192
atggatgttcatgctttgttgaaaaaagggaaatggctccgaagaaactctccacgaagaggtctagaagagacgccacaacagaagggtccagtgccgcccctgagtttgatagtcatcatttccggagcaccgagcactagcagcgcttcgaggccatcagaggatggtcgttccacagagagaggcgtgtccagctcagggaggatgagtatacggactttcaggaggagatag

SEQ ID NO: 48508 - DNA, 546 bp, Glycine max
  Peptide Sequence Number=SeqID_140193
atgccggatggggacgtcgggttcaccttaggaacagtgctggtagcggcaactgccaccgcattggcttccattatcttcttcatgctcatcatggcctccatcattgcagccatttgctctttcatagcctccatgtcggccttcaccttctcttgcacctcctctgctttacccattactctagctctagcacaggttcgtagccgaagcaatgatgtaacacaatccaccttttgccccaacttttgcaagatggttacttccatacttcaacttgactcgatgaatcttttcataaaagcacgagcttggttcaaccccataacccagggaatggcaattttgatcgccaatacttcaacaacatttcatagggatgaaagactcgagaatacgcatgctatgcatggaaaatgtaattatgagattgagatgctcgaagagacatcctttcttaatgaaccacgcattagaaatgggtttatgatcccaacatggttggctcatggggaaaacgcaagggtcacgcatgagcaaacatga

SEQ ID NO: 48509 - DNA, 297 bp, Glycine max
  Peptide Sequence Number=SeqID_140194
atgtcctcgccttcagagggctacacgccatcgccttttgagggctggatgccctcgccatcagaggactacatgtcctcgccttcagagggatacatgccctcgccttcagaggactacacatcttcgacttcagagggctgcacgccctcgcctgcagagggctacacgccctcacctttagagggctgcacgccctcgcctttagagggctgcacgccctcgccttcagagggttgcacaccctcaccttcatttgctatccataaagactcaaagcccgatagcatgcagtga

SEQ ID NO: 48510 - DNA, 285 bp, Glycine max
  Peptide Sequence Number=SeqID_140195
atgtgggcatgggaacactgcacgactttggctccaaagaggactcctcttgttatagaaaataaaccacttggacacaggtggctgcgacgtggaaaccagcatattgacaatgatgatctcatagtttttcgtcgcaaattggatatcatgaaacgacatgagtttctgtgggagtcttacacaacaactgttatgtcggtgttgcctcccatttggcaagcccgaaggtgggatcgaccatgtggcacatcctcacgccatcacgcacaccataatgaatga

SEQ ID NO: 48511 - DNA, 678 bp, Glycine max
  Peptide Sequence Number=SeqID_140196
atggacctgaccgtcagccttggcgacaaggtgaagatgaccggcttcggcctgaagggtgcgctgaccggcaagatgcaggtctgggccaagcctggccgcgaaatgaccgccaatggcgggctggaagtcagtggccgctacaaggcgtacggtcaggacctgaccatcacccgtggcaacctcacctggaactacaacgcggtgtccgacccgcgcatcaacatccgtgccgagcgccggatcgcagccgcgtgcggacgtgtggtccgagccggcgatgtcgcagtccgaagcactggcctacctggtgctgggccgcagcctgactggtgccagcagcgaccagacccagcaggtcaacgcggcttccgcggcgctctcggccggcagcggcctgctggcttcgcagctgggcgccaagctgggcctggacgacgccggtgtgagccagtcgcgcgcgctgggcggctcggtgatcggtgtcggcaagtacatctcgcccaagctgtacgtcggctacggcgtgtcgctggtcggtgccggttcggtgatcacgctgaagtacctgctgcgtcgcggcttcgacgtggaagtggaatcgagcacggtggaaaaccgtgggtcgatcaactggcggcgggagatcgaattcctgcagcccgggggatccactag

SEQ ID NO: 48512 - DNA, 231 bp, Glycine max
  Peptide Sequence Number=SeqID_140197
atgcagttatctagccctgttatatcaagttctaaggaaacacgagcatccgctaagcgcaacattcctgggctaagtgcgaggaagaatctagaagaagatgagttgtacaggtttgctaagggcaccgcttcatctctctatgcgcatcgcttcagttcatccgctaagcgagaaaggcgcgcaaagccaaaaatcacttgttggatcaagtggcctcgaaataattaa

SEQ ID NO: 48513 - DNA, 474 bp, Glycine max
  Peptide Sequence Number=SeqID_140198
atggcgcgaaactttacggattacgcaaccatcccttctttgacttttggaatgttacggaactttgcggattgcgcaacaatgcttcctttcgactataaaaatgactcttcccaaattgtccaaatggacaattcaagattcaatacaacatttaatccaaacaatccggttctagacaaagacactaaacatcaaaattcagttaggaaatgcttttacagccatagccacatgaaaattcagttaaagaggttttcttgtgaagagatagttgctattcttcatttgatgttggacaacaataatgagtttgacctaggcctcaatgcacttgattatgagatctgggttggtaatgttagcattggaggagcagaacttgccaattctgcaaagctcgtgaaaagtgggataacagacattgatgttccaattaccttgaggcctaaggattttggctctgcactttga

SEQ ID NO: 48514 - DNA, 260 bp, Glycine max
  Peptide Sequence Number=SeqID_140199
gggggcggagcctatggaaaaactggctttgccgcggctctcattccctgttaagatttcccagagatcttccaaagatcgaattccgccccgttggggataagccactttccgctcgccgcatgacgaccgagcgtaggagctcaggacaattcgcggaatatgagtccgtatcacatattctgctggcccgtgcgcctttttctctgccacatgaagcacttcactggaacaccctcatcagtgtacccaacatgtaa

SEQ ID NO: 48515 - DNA, 547 bp, Glycine max
  Peptide Sequence Number=SeqID_140200
atgggtcagctccagcggcaagctttttgcaaaacttacggtaaaatctgggacttagccatggtagaagtctccacagaggccattgcctccctcacccagtattatgatcagccattgaggtgcttcacctttggggacttccagctatcacccatggtggaagaatttgaagagatcctaggatgtcctctagggggaaggataccatacctcttctcagggttctatccctcattagctagaatttctaagatagtccaaatctcggcacaggaattagaccacaggaagcaagtcgaaaatggggtggttggaataccgagaaaatgtttggaggcaaaagcaagaatcttgggaggtaaaggtgaatgggccctgttcatagacattctcgcactgttgatctttagaggagtcctctttccaaatgtggatgggttggtggacctagcagcgattgacgcttttcttgcctatcatgaccacaaggaaagcccggtcgttgctatgctagccgacctctatgacacctttgaccgaagat

SEQ ID NO: 48516 - DNA, 183 bp, Glycine max
  Peptide Sequence Number=SeqID_140201
atgactgaagcacgtcaaaagggggtacggaaagtaaatgaaaacgagaataaaagggaggagcttgccacccagctcgcccaggcgagccaggttgcttcctccagaagcaaccgccttctggaggaagaatctggaaggcccatgtgggcctggttgctatttacaccctttttttactaa

SEQ ID NO: 48517 - DNA, 162 bp, Glycine max
  Peptide Sequence Number=SeqID_140202
tcgggaaacctgacgtgccagctgcattaatgaatcggccaacgcgcggggagaggcggtatgcgtatcgggcgctagcgcagtgtatactggcttactatgtaggcactgatgagagtgtcagtgcagtgcatcatgtggtaggagaaaaaggctgcaccg

SEQ ID NO: 48518 - DNA, 288 bp, Glycine max
  Peptide Sequence Number=SeqID_140203
atgaaggacattgtgaaggaggctccaaaatcgatgatccatagtgatgcaagctccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaggggagagggagagaagagcacgaaattttgtgctctaaataa

SEQ ID NO: 48519 - DNA, 183 bp, Glycine max
  Peptide Sequence Number=SeqID_140204
atggtgaaagttggaacctcttacgtgccgatcaacgttctcttttcgccaaaagttggcccagggcttcccgctgtccctcctgttcagctactgaacggggtggtgttatccgtcacaattcgcacacaagcataccgagccggaagcatcagcgcggcaagtgtagcctggggtgcatga

SEQ ID NO: 48520 - DNA, 273 bp, Glycine max
  Peptide Sequence Number=SeqID_140205
atgatgatttcctttcacctctttcggagcttgagctcactagttctgccatataaagcccctcaaaactttgctttgatttgggagccaatccagtccttgtgttcggactctcagccacttatgatagccgccgatgatcccattactgcttcccctaagctctctgtcctttcttcatgccgcatcccatgccttgcgaactccttggagtaccctcgcgttgtggtcactgaaacctcgtgcgatgaaaggcgtgatgctttcgtctga

SEQ ID NO: 48521 - DNA, 361 bp, Glycine max
  Peptide Sequence Number=SeqID_140206
cacactgtctccatttctaagcccggtaatcgattaccagaggtctccacaacatactgtctccatttctaagcctggtaatcgattacacatccttggtaatcgattaccagaggctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtatttctcaatttgggatgagaaaatcagacctacgtag

SEQ ID NO: 48522 - DNA, 240 bp, Glycine max
  Peptide Sequence Number=SeqID_140207
atgtatcctctcttgttctcagttacaacaacccaagtagatgtaccctctacttgtaccacaaaggatgtaccctccaatgtgttaagacaaagttctcaagcggttagtcctctgaaactttgtaaaggggaaacaaaggaattctcagacgggagaagagagagacaaaaagaattcaagcggttagtcattgtcgaattctttttggcaaaggaagaagagaatgaaaagatataa

SEQ ID NO: 48523 - DNA, 399 bp, Glycine max
  Peptide Sequence Number=SeqID_140208
atgtcaccacacgttatgcaggatggtggaagcagtcaatattgtatcattatcatgattttgcaaagaatattactcggtgaaacagcagtctatgcaatgatgctggtgtttccacctgaattttctccattgaaaactattttatttggaaatccttcccaagacaccgttgaactactgatggaggctttggaggaagattataaagatggaaatgagataaatgaatcaaggcagtttattggaggagtattggatcttgaaaagagaatcaatagactaggtatgtatttttataatatctttcgacatcaacctatgcttcgacatgggaagaaaggaaggggcacagttacaaagaatctggtgattttctgcattcaaggcccttggtaa

SEQ ID NO: 48524 - DNA, 270 bp, Glycine max
  Peptide Sequence Number=SeqID_140209
tggcttctgtttctatcagctgtccctcctgttcagatactgacggggtggtgcgtaacggcaaaagcaccgccggacatcagcgctggcaagtgtagcggtctcgcgcgtgtcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgg

SEQ ID NO: 48525 - DNA, 492 bp, Glycine max
  Peptide Sequence Number=SeqID_140210
atgcatgaacgacaaccaattcatggggctccgtataaaagtggagaatggagaattgcgctaggcaatcacttcgcgtggctccagactcattggtggaggatgcatgaacgacaatcaattaatggggctccgaataaaagtggagaatggagaattgcactaggcaatcacttcgcgtggctccagactcattggtggaggatgcatgaacgacaatcaattcatggggctccgaataaaagtggaggatggagaattgcgctaggcaatcacttcgcatggctccagactcattggtggaggatgcatgaacgacaatcaattcgtggggctccgaataaaagtggagaatggagaattgcgctaggcaatcacttcgcgtgggtccagactcattggtggaggatgcacgaacgacaatcaattcatggggctccgaacaagatttgctggaaggatcgaatggtccaccgggttttttccacctaa

SEQ ID NO: 48526 - DNA, 418 bp, Glycine max
  Peptide Sequence Number=SeqID_140211
aacaaaagttgaaaggaaagatattgagctggttgatgaggaagaagcaaagattggtgttgatcgttctagtgcaacctctaataaatgtgagatttataaggaggaagcgcgaaatgcaacacagaagcataaaccaaagagggtggagagtgtcaatgctgatgtagaagcctttgctgaagcactagaacatacgaagaaaagagatacaggccatcaaagtgtgtcatttgagaataagacaggagattcaactgtgctgaagataggaaattcggctaaagtcgtgataaaacaagacatgaagggaagaaagcataaatatgggtttaacaataataaacgagagaagatagagaagaaaagggtggtggatgatgaaacggcgacaaacatgagctatatgaagtcctaa

SEQ ID NO: 48527 - DNA, 258 bp, Glycine max
  Peptide Sequence Number=SeqID_140212
atgcctattatggaatatgaaaaatcatattttggaataggtatagaccaaggagcactaccagctacaaatcccatgaggacacggtggtgttgggtgcacaatggtgttcggggtgtgattgtgttggggcgtagtggttatggaggcttcatggctgggattttttgggagaggcaaggacacaggatgtctggtgaggggtattcttgttttttgggagatgtaggaagaaaaaaaatgtggtgcaagaagtaa

SEQ ID NO: 48528 - DNA, 573 bp, Glycine max
  Peptide Sequence Number=SeqID_140213
atggacagcataagattcaccgcacctttcagggttcagaaggtaacatttcacataaaaaaacgttttctacttaactgcatttccattttttttcaactgcctcgccttactttctttgcctgcagaaccttttccaagttcctttcacctatcacaagcaatggctgcgcaactacccctaatacattttattccactacgattgcgagatacatttcattaggaagggcacacaacctcaacgaaagcgtgattctacgtttggtcgccagtgacaaaaacaccactttcaccatttatattgacggatctgcacaccaccactctagcctaaaacccatcatttatagaaggagatacatctttactgttgatatcacagatgatatgctacagcagaacctacctttaaaacttcctgcagcagcttccaaatttgttgtatggctccaaaaaaagtattaccatccaccacggactttcaaaatccacgaaatggccactcaccatccaccatgtgtgatatcctggaaatttctacccggaatttttggaaacgatgcattctga

SEQ ID NO: 48529 - DNA, 153 bp, Glycine max
  Peptide Sequence Number=SeqID_140214
atgacgggagatgcatcaaaattcacacatatctctctcaagaaaagcggacatgtgacttatggcgacaacaataaaggtagaattcttggagttggaaaaatagtaaagatgatgatccatggttatggcataggaggattgctcatataa

SEQ ID NO: 48530 - DNA, 204 bp, Glycine max
  Peptide Sequence Number=SeqID_140215
atgaatgcttatggtgacaagcaatcagacttgggaatcattgacaagaaactcaaaagattagctgagcaagctatgcaagcccaaacaaccaaatggaacaactatgatggtggcaagaataagaagggaaagggaaaatggaagaacaataagtggaaggggtcaggtgagggccccagcagttctggaaatcataactag

SEQ ID NO: 48531 - DNA, 168 bp, Glycine max
  Peptide Sequence Number=SeqID_140216
atgttaaaacaacaacaatcaagcctgatgcaatcctaccccgcaagggcattggatagaagactccaagtagatcgggccaaagatccaagggaaggccctagggttctcatgagccttaggctaagttctagcttctcatctcaaggagatgagcttagctattag

SEQ ID NO: 48532 - DNA, 324 bp, Glycine max
  Peptide Sequence Number=SeqID_140217
atgagtcttcattcttcatctagtgttaatggtgagggttctactcctaaggaccccttgtataagatattagatgagttgagatcccttaagttgtggaaagaagaacaagagagaaaagaaaaagataatgttgaggcctacttagatggggagatcaaggttgaacaactctttgcttgccatcatattagcgaagagagaaaagttccattggctacccttagctttcaagggtatgctctctattggtggacttcccttgttagggaacgaaggattcatggggatccttatgtagaagcaaggcttcatgatgaatga

SEQ ID NO: 48533 - DNA, 225 bp, Glycine max
  Peptide Sequence Number=SeqID_140218
atgagcctcagcctacagggccagggttctacttcttttccgtgtcctacttcggaccagttcagggcagaggtcgcatggcctggagattggcctgaggccttggcaggagaggcacctgcagaggcaccagcagaggctcccgacgaggcagatgaggcccgcgaggacgaggagatgaccgatttacttgatttcttaggagggagcggagccacggactaa

SEQ ID NO: 48534 - DNA, 231 bp, Glycine max
  Peptide Sequence Number=SeqID_140219
atggctgaagtcacctcacatacaacagacaagggacttgatggtttattggaggaagatgaaaatggagcaaaggatagctgggagaaggctgaaaatgaagtgacaagtttaaagaagcaagtccaggcactgactctcagaaattcaacacttgaagatagagtcacccatctagacggtgcacttaagaagtgtgttaggcagctaagacaaacaaggtgtttataa

SEQ ID NO: 48535 - DNA, 582 bp, Glycine max
  Peptide Sequence Number=SeqID_140220
atgcctgggactgctatgcacacaatgtccttagccggaagatccttccggaaaggaatgagagaaattgagtggaggaattggcataaggagctcactaacttctcagagggaagcattgatgttgctattgttaaagaattttatgctaacctctatgaccctgaagacaaatcgcctaagcaggtgagggtgcaagggcacctaattaaatttgatgttgatgccctcaacaccttcttgaagacaccagtggtcatagaggaaggggagagcttgtctgcctactcctggttagctaatctgaggcctgttcctcaagagcttgcaactcgtctatgtatccctgggaaaggatttgagctgaatgcagatgagttgcctctgaagatcttgaggaagaatctgactactctggcccagacctggagtgttctatctttctctaacttagccctgacatcccacacttctgacattactctagataggtctaagttgatatacgggctcatcatgaagatggatatgaacttagggtccctcatctcaggtccagatctctcttatagcacaacatga

SEQ ID NO: 48536 - DNA, 546 bp, Glycine max
  Peptide Sequence Number=SeqID_140221
atggtagcaggcttctttgctggaaaattccttctcggattggtgtttgcgctggggttggtgttgccgacgggacgagattgtgcgggaaacgagttttatgggggaggcctttgtggccatgtgggagctgaagttacagcatgggtgtctccctctttcttcttggctccacccactctgaacctcctattgctttgcggaagtgacataatcaaaatttccccttctcaagcctacctcaattctctcgcccgcaaacaccaaatctatgaaactagagggcatataacccaccatcatctcatagtagaacactggcagcatgtctactatcatggttatcatttctctctccatcatggggggtgctacttgggccgccaaatccctccacctctgggcatactctttgaaggactcatgttccttcttgcacatgttttgctactgggttctataaggagccatgtcggtgttgtactgatactgcctgatgaaagcaaccatcaagtccttccaagaacagatctgagaagcttctaa

SEQ ID NO: 48537 - DNA, 369 bp, Glycine max
  Peptide Sequence Number=SeqID_140222
atgagtcatcattcatctagtgttagaggtgatggtactagtcataaggatcctctatctagaatcttagatgagttgagctccctcaagttatggaaagaaaaacttgaaagaaaagaaaaaggaaaagagagggtagaaataaatcaagatgagagagaacaaataagagaggaagaaagaagaaaaataatgaaagaaatgaaaagagaaaaacatggctcctacagtagtcatgactcttgcaagagtttaagtgaagaacttagcgactattatagagggtgccatagttcacatactaaacatcattcccaaagaagagaaaaggatagaaggcctcaagaggttaacattagcctcccataa

SEQ ID NO: 48538 - DNA, 252 bp, Glycine max
  Peptide Sequence Number=SeqID_140223
atggtggacatgggaaagaagatactgcagatgggcatagaagaccagaagatcaactttgatttgttccatgaagacaaagatccacctcgccaaaatgtctgtctgatagtgcatgtgatggaggaaaagagacctaagatgaagctaagcacacatcgctgtgctaagcccaacatcttcactgtaagttgcaccttaagcagtgggcttagcgtggatgatgctctaagcgccacttcctctctgtga

SEQ ID NO: 48539 - DNA, 333 bp, Glycine max
  Peptide Sequence Number=SeqID_140224
atgttgtgtagacttataggcagagatagacatgatgaccatgatccagctgatgttcccgagaggcgtaggcctactgcctcagcccgtaggcaacgggttcatcagatgactgcggatgcacgtgatatggctgaggatgttgctgacatggctgaggatgtccctgatctggctgaggaggcacctgagatgcgtgcggacgtacaaggtgctgatggtgttgaggggtcagatgctgatgatgttgagggattccctggtgggccacgtgacccgtcagtgctgacatcatttgcggaccatgttgcacacgttgcttggagtggacag

SEQ ID NO: 48540 - DNA, 150 bp, Glycine max
  Peptide Sequence Number=SeqID_140225
atgaagaaacaacaatgcaagaaaagatgcggcggaaggcaaaggagaagaggagaggggaggcaccatccactagggaataagccaaggaagaaggagcttcaacaccaagaattgccttggataagaagcttgaagaggatgctttaa

SEQ ID NO: 48541 - DNA, 270 bp, Glycine max
  Peptide Sequence Number=SeqID_140226
atggggttgcaaatagcaactaggcccacttgggccttccaggatgttcctccagaaggtggttgcttctggaggaagcaacctagctcgcctgggcgagctgggtggcaaaaatccaagccgaggcgtttccgtaacgcttccgagacgtttccgtgggtgatttcgcaaagattttccgtcgttcttcattcgttcttcgtcgttcttcggtcttcaaccggtaagttcccaaaatcgaacatttcaattcattctatgtcaccttag

SEQ ID NO: 48542 - DNA, 315 bp, Glycine max
  Peptide Sequence Number=SeqID_140227
atggctaccaaaggttggagctttgttggagcttcaatggtggaggaagaagaagaggatggcaactccctcgcgtttctctgcacccgtcggggcccgtttttcaaaaaaatttccaggatgtcacaatactcccaccctttaaggaatttcgtccccgaaattaactactctatgaacaaacttgggtacaattctctcgccctatcctctaactcccaggttgaatcacccttgtcgggtccccactgcactttcaccaacgcgatctcctttcctctcagcgacttcattcttcgatcagtaatcttctga

SEQ ID NO: 48543 - DNA, 510 bp, Glycine max
  Peptide Sequence Number=SeqID_140228
atggctgaagtagatgtggtgcaagagcggatgaaggccaacgtggaggccatgaaagaacagatggccacaatgatcgaggccatgatgagcatgaagaagataatggaggtcaatacgactgcagttgccactgtcagcgctgtttctagggtggacccgattcccccatctggcctcaacctaataaatcatccaacctcagatacgggcagccctcattttgtgcaagtccagaacaagtatgttttcccgccatatggtttgccttcgaacaatactccacccaatgagaatgtcaactccactcctatactcattgagagccaacaacctcaaactgatcatgcatatgtctctcaacccatggggaagacacatgaaatatcccattgcaatctaggcgacttcgagcctcgccttgaatatgccattgaagggcaagcagttgacgatatatgtgacatcctggaatttctacccggaattttgcatgcaacttataattaa

SEQ ID NO: 48544 - DNA, 183 bp, Glycine max
  Peptide Sequence Number=SeqID_140229
atggctggacgtggtagggatcataaccatgatgtcctcgactgcatcacagctatgctggaaactctagtgcaggaacgtgatgtggagccgacagagtatcggggactcatggctttccgtaagaaccacccgccgaagttcagtggggactatgatcagagggtgctaggttgtggttag

SEQ ID NO: 48545 - DNA, 302 bp, Glycine max
  Peptide Sequence Number=SeqID_140230
agcacaaggtggatttcaaggataataggtcagtagacccagagaaatacactttcaggctaacaggaaggaagcctattagtttggaagagaaaaggaagcttggtgaagggtatattccactgctgcaaacctctataccagagaaaatggagacacttacatcacattttcgtgttagagtaggaggattgaaagttaattttgggatacatggcttggtcaccatgcttcaattacttgaaacactattggaactttatgtcagtagccccaagctattcatcattatgacgaaatga

SEQ ID NO: 48546 - DNA, 282 bp, Glycine max
  Peptide Sequence Number=SeqID_140231
atggccaagtttgatccggacatagttctcgagttttatgccaatgtttggcccacggaggaggacgtgtgggacatgtggtcgtgggtgaggggccagtggattccttttgatgcagatgccctcaaccagttcctgggatacccgctagtgttggaggaggggcaggagtgcgagtacagtcagagaaggaaccgggccgatggatttgatgaggaggccattgcccagctgctatgcatactaggtcaggattttgccctgaccgctgccgggaaacgg

SEQ ID NO: 48547 - DNA, 222 bp, Glycine max
  Peptide Sequence Number=SeqID_140232
atgatgacaaaggtgatgaacaaaaagctcaaagatcaaagaacaactcaagttgaatcaaagaacatctcaagtgaatcaagaacaagtcaagagttcaagaaaagaatcaagaagaaattcaagactcaagaagataagcctagaatcaagattcaaggttcaagatctcaagaatcaagatcaagattcaagaatgaagaaaagacccaatcaagataa

SEQ ID NO: 48548 - DNA, 627 bp, Glycine max
  Peptide Sequence Number=SeqID_140233
atgacccaagagatggtagcccgcggagacaccttacggttatccgcacctcgtcattcagtgaccccaagtgtgattgatgagcaaaggccagtgtggtcatttgcaccctttccggagatgtcagcatcttccggtggagactttttcaagtctcacaagttatccagaactacgagcaagagccttgcttttgtcggctgccccacaatttctgtcatactgaccctgaggtcatgcgacatgcggagacaaaatttggtcattccgcacccctttgccattcagacacagtcgtgtctgatggcacgcagagacaaaatttggtcattctgcaccctttgccatcaagaggcggcgggcccgatgacatgcggagacaaaatttggtcattccgcacccctttgccattcagacacagtcgtgtccgatggcacgcagagacaaaatttggtcattctgcacccttttgtcatccaaaggcggcgggcccgatgacatgcggagacaaaatttggtcattccgcaccccttttccattcagacacagtcgtgtccgatggcacgcagagacaaaatttggtcattctgcaccctttgtcatccagaggcggcgggcccgatga

SEQ ID NO: 48549 - DNA, 345 bp, Glycine max
  Peptide Sequence Number=SeqID_140234
atgacaccttcgaccgaagatgtgaagaaagcaatgcaaggattgtttgctgtactccagctctctatgtggggctggtttcacacctttttctccaagaaggtaggcccgtctatccgctacaaggaaggaagaatcaagattctatcttcatgcgaaggatgtccaaatgttcccttgatgggaacaagggtgaccacaacgcgagggtactccaaggagttcgcaaggcatgggatgcggcgtgaagaaaggatagagagcttaggggaagcagtaatgggatcatcggcggctatcactgtgagagatgatgaggttaaagcttcggaagaaagtgatgag

SEQ ID NO: 48550 - DNA, 228 bp, Glycine max
  Peptide Sequence Number=SeqID_140235
atggacatccttgtccctcatcctctcacaaacgcatgtttgcttattcaactttcaccggaatgtgggtgcaagccattggtctatttgctcaagcgacctgcgctcctgagtgttgacttccaagactgttcaatcagagattactcgtcttgcacaaagtttgtcttcttagagaagcgagttgtcaagaataggatgttggacaaatggcctcagttaccttaa

SEQ ID NO: 48551 - DNA, 375 bp, Glycine max
  Peptide Sequence Number=SeqID_140236
atgggacatatttcagagagatttgtccacatcccaaaaaggagcagaatagtggagggtatgaatgaccaaactggacatccgagggccacaggaattgtctttacccttaatggtactgaagattcgaaatccaaggatctaatccaagttgtgacatctttacaagaagatgctcaagtgtacatgatcttgtctaacctagcgacaaagacaaaggtttccatgggtgacctccctgttgtcaaagagtttcctgaagtgtttcttgtggatatatctagtctgccacccgggagagagatagagttttccatagacctagtacatggtgctggacccacatccataacccttataggatgtttcctatag

SEQ ID NO: 48552 - DNA, 435 bp, Glycine max
  Peptide Sequence Number=SeqID_140237
atgccaatctccccctgcagatgtaccggttgggatcgcgcccacaagatgcccagtgggcctgaagaagtccaacagggccctggggtttccagctctggttacgggcctctgtcagacctacagggtgctcgttcccccagcgaggaatcgcacccacaaagacacccagtggacccaaagaagtccaacagggccctggggtttccagctctgggatcgcgcctgcaggacacccagtggacccgaagaagtccaataagggtcttggagttgtcaagctctaattacgggtctctgtcagttctacggagtacctgtccacctccagcaagggcatcagacccccctactaatcgagctttcatcaagaagtactgcgcccccaggcaggcgcagggcgaaacaccacagcaacattgggatggccggtag

SEQ ID NO: 48553 - DNA, 377 bp, Glycine max
  Peptide Sequence Number=SeqID_140238
atgggatcaagtcaaaagccttcgcttaaaaagaggttctatcaagtcaaaatcaagagcttagaggtcactagtttaggagagttggggcaattaatgggtcaacttcaacggtattatgaccagcccctaaggtgcttcacatttgaggacttccagctagtgccgactgtgaaagagttggaaagaaaatcctggggatgccaactgggaggaaggaagccatatcttttctttgggttctatcccctccacgacaagagttgccaagttgtcctctttccgaatatggaagggttagtggacctagcagcgattgatgctttcctcgcctttcatcatggcaaggaaagcccggtcgtcgccattttggccat

SEQ ID NO: 48554 - DNA, 477 bp, Glycine max
  Peptide Sequence Number=SeqID_140239
atgggcttctacattgtttgtggtgacagtacacagctggtggcagggggaaaggtctttggagtaggtggcacgatacacattgttgcttatggagatgatgtagtaagggtgtgtgttgacactgtatatgatggtgaagccattgtcccgttacccactttagagattcagtatgtcagggacgccgtgaactcattcattggatggcccagacatttagtgaaacctttatcttataagccagttgaacatagtagtgatgcaaagcttgtaggtgaatccgatccattgggagagttgatgaagatattgttttatgtgtaccagaatccagtggaagtgtcgtgggaggcgaaccaatttggacttcctgatattggggcaaaattttacatcacacatgcagatctagcggaaataatatcaggtgacaagtgtttaaacatagcgatactacaattgtggaccatgtaa

SEQ ID NO: 48555 - DNA, 333 bp, Glycine max
  Peptide Sequence Number=SeqID_140240
atggggtgcctatactttacagtgatgttgttgatggccctgcaatctatacacattctccacgtaccatcctttttgggcaccaacaacactagcacagcacatgggcttaggctctcttggacccagcccttctccaacaaattctttaacctgagactctatctcattagtctcttgagggttagtcctataggaggtaatccagggggtatctctttgggaaatatatcaccaaattcatgtaagagttcttggaactttgggggtaaggtctcaaatgtaggaattgtggcaatgctaagggatgtttcccttgataagagaaggtag

SEQ ID NO: 48556 - DNA, 255 bp, Glycine max
  Peptide Sequence Number=SeqID_140241
atgttgagtcaacatcccaatatcttaaacaacattgactctgtgatgaagagagaatctcctctatccctgcattacaaactgtttgaggggacacatgtcccagacattgtctcgacatcagggaaagctgctgcttcaggtgctgtgtccaaggatgccttgattgctgaactcaaggacacatgcaagctgatagaagatgctgcagtgaactgcagtaggagcatgaagacagggggagcagaaagctga

SEQ ID NO: 48557 - DNA, 549 bp, Glycine max
  Peptide Sequence Number=SeqID_140242
atggaggccatgaaggaccaaatgacctccatgatggaggccatgttaagcatgagacgaatgatggagaacaatgtggccgcagttgctgccaccagcaccgcagctaaggcagacccgattcacccatctagcataaaccaaacaagtcatccagtcccggacatggtaggtcagggaggagaggtgttaggcagcacaagcggtccgcatatggtgcagaataagaattctttcccaccgtacgacttacctcccaactatgcaccacccaatcccaatgcagcgggagctcctcaacaccgcccgttacaacctctgcactttttgatggggagactacccctggccatggaagaaagagagaagttggatctcatagaagaaaggatgagggccattgaggggatcgatgattatccatttgccgacatggcggagctatgcttagtgcctgatgtcatcatccctcccaaattcaaagtaccagacttcgacaagtacaagaggaccacctaccccaagaaccgcctaaaaatgtattattga

SEQ ID NO: 48558 - DNA, 1270 bp, Glycine max
  Peptide Sequence Number=SeqID_140243
gtcgactctagaggatcccactcaaatcggaaaaagattctatcaagtcaagattaagggcctagatgtcaccagccttaaggagttgggacggttgatgggacccctccagatgcaagccttccgcaaggcgtacggaaagattttacatttaaccatagaggaggtattcacggaagccgttgtatccctcacccaatactatgaccagccattgagatgcttcatgtttggagacttccaaatagtaccgactgttgaagaatttgaggagattctaggatgtcctcttgggggaagaaaaccgtatcttttctccgggtttcttccctccttgagcaagattgcagtcgtggtcagggattcggcgagagagttggatcgtgtaaagcaaactcgaaacgacgtagtgggcctaccgcgaaagtacttggaaggcaaggcaagggatatggcgaatcaagaggagtgggtcctgtttgcggatgtactagctttgctaatctttggggttgtcctctttccaaacgtggacggtttcgtggacctagccgcgattgatgctttccttgcgtatcaccatagcaaggagagcccggtggtagctatcttggcgaatttatttgatacatttgaccgaagagtagattgggaccaatacttggctgggataagaggcagaacaatcaaatggtttcctcgatggaaggaaggaaaggagggagttctcttctcatgtggggactacccaaacattccgttgatagggacgaggggttgtattaactacaatcctgcacttgctataagacagttagggtaccccatgaggggagcaccgacggaagagagcctctcgcctttccttgcgagagatttcagtgcgcaaagtttcaagattgtacaaagagtccacaaggcgtgggaaagcccgttaaggaaagataaagaacttaggggcatccgtaatggcatcatcggtggttatcatgaattgttaagagttcatacacgagggttagattggctctccaagttgaaaattatcaatgaggagaacttcgaagctccggaagaggatgaagaagtccaagctctaaaaacagagctaggaaaggcaagactcgccaaagaaaaattcaagttagtcgctacagacatccggaaaaagtgtgccaagttacaagaagaaaatgcagctaccgcaagagcccttgaacaagaaaccaagagggctcgcaaggaagagcatggccgagataaattctga

SEQ ID NO: 48559 - DNA, 270 bp, Glycine max
  Peptide Sequence Number=SeqID_140244
atggccatagccaggtgggcactcaagcatcccgttcatggcattgtgatactacggaggatgttcctaaatgaaaaactctacacggttccggaatttcaacaaacactattgacaacaacgaaggatcccacggtcatgtggctccgcatgccaccggactcttgggtcacggtaacaaaaagtggggtggtcgacaaaagcagggcttttgctcctacgtatcctcaatttgtgatgaggaactcagacctacgtagttcttgctaa

SEQ ID NO: 48560 - DNA, 633 bp, Glycine max
  Peptide Sequence Number=SeqID_140245
atgggtgaagtagagaaggtgcaagagcagatgaaggtcgacatggaggccatgaaagagcaaatggccacaatgatggaggccataataagcatgaaaaagataagggaagtcgatatggttgcagttgccgctaccaacgctgttgctaaggtgaacccgatgcccccatttggcctcaagcaaatgaatcatccaacctcaaatatggtaggcaaagatttgggaagtacggatgacaccatgatgtgcaaattcaaaacaagcacgccttcccgccatatggcttgcctcccaaactatacaccacccaatgtggcgtacattcccaatgaggatgccaatacctccacacccatactcattaagatccaacaacctcaatctgatcatgcacatgtctctcgacccatggaggagacacatggaatgccccaccacaatctagccgacttcgagccttgcctcggatatgccactgaagagaaagcagttggtggtatacccctgcaaaacactttggagggccctcagtgtcacccacaaccacaaccctcacattccacagcggttaaaaaccctcatgctatggcagaaatgggaaaggggaaaggctcagggccattgaaagag

SEQ ID NO: 48561 - DNA, 489 bp, Glycine max
  Peptide Sequence Number=SeqID_140246
atgagcataagagaagaagagattgtagaggttgacactcaagaggagagccctgtgaatgagcatgatttagaagaagaagatgaagagaaagcgcaacaacgggaacaatgcttacaaacacacactcaacaagaagataatttccaacttaacacatgttctcatcaactaaatatcaaagaagaaaggcatgaagaccatgagagttcattcattctaggacaaccctatttgccatttgctagttgtgttttagacatgggtaaagaatgcctagtcaatgaagatggaggaaaaatgctagcttgtattgatgatctgggggatctagacgatgaatctattggtcatatgatgtttgaagaattggaaaacaatagaccaaaagaaaatcccaaagtagaattaaagacccttccagtatttttggaggacactgagaccaaacctgttataattagcatctccttgcagaagataaaataa

SEQ ID NO: 48562 - DNA, 505 bp, Glycine max
  Peptide Sequence Number=SeqID_140247
atggttctagtgactgttcccttcctagggaggattgcatcacttagggaggaggaaagaacaagtatggctaggttccttagtgggcttaatatggaagtgagggacaagcaacaacttaaaataaagtcttcttcaaaatcttatgactttcactcttatccaaggaaagaccaagcccaaggaattttgggacctacaccttcaaaacccaaggaagataagggtaagaccatagagaaacccacccctaagactagttcccaagcaaggactaacaatattgaatgcttcaaatgtcttaggggaggtcacattgtctctcaatgccccacaaaggaaaccatgatgatgaggggtaaagatatttatagtagtcaagaggagactacctcttctccttcctctaggggaagtgaagataaagaaaggggtgaagagtctagtgagaaagtctactctcatgtaaaaggtgacctcctaatggttagaaggctctttggag

SEQ ID NO: 48563 - DNA, 318 bp, Glycine max
  Peptide Sequence Number=SeqID_140248
atgttagctatcatcaccaagtatcaagaagaactaaacctagccacagcccatgagcatagggtggcggatgagtatgcccaagtgtacgcagagaaggaggctagaggaatggtgatcgactcgttacaccaagaggcaaccatgtggatggaccgatttgcttttaccttgaacgggagtcaagaacttccccgattactagccaaggccaaagcaatggcgaacatctactctgcccccgaggaaatccatggacttctcagctattgtcagcatatgatagacttaatggcccatataattaggaaccgctag

SEQ ID NO: 48564 - DNA, 333 bp, Glycine max
  Peptide Sequence Number=SeqID_140249
tgaagaaatctacccccaagaagaaggacaacctttaatgcttaaggaggagtgtaaggagacacttgttagcactgccacacctcttgggcttgaggttattcctcaagtaaaggagttgttggatgagggtttggttcttaagagcttaaatccttgtgctttgttggtgcccaaaataggggttcccacagaccctaagagaataaagatcattcctgattggcccactccaccaacaccattcattgagttggtgaggaaccatgttccctcatgggaagatgtgtcgagggaaggagcccagagtatgaagaacctcaggaatttgag

SEQ ID NO: 48565 - DNA, 195 bp, Glycine max
  Peptide Sequence Number=SeqID_140250
atgaatgttttgagtggtgcaaccctcttttgtaaaatcactcgtacacctaacatcttcatggtgtgtgtacatagggacccattaggtgttgggggaaggatcccagagtatgaagaacctcgggatttgaggtcaaatcctttccaaggtggaggggatgatgcaatcctaccccccaagggtattggatag

SEQ ID NO: 48566 - DNA, 165 bp, Glycine max
  Peptide Sequence Number=SeqID_140251
atggctcaacctccaatcttaaggacttatcagatgaatacgagacttgttgggtcaaaaaccatggtagtgatactgactcctcttccgggcccgaaggaagtaacatgtctccatcccatgaaacaatattcaaacgggattgtgtcttatgtccgtgtttag

SEQ ID NO: 48567 - DNA, 567 bp, Glycine max
  Peptide Sequence Number=SeqID_140252
atgccaaaggtgaagcgttttataaatccacaaaaatcagcacctcaaccacaatgtccctcaccaagtgattccacacaagctcctgaagtcccaactggtaatgtccctctttctcatgaatcaacatctgaagttccagcaatgaatcctgaaatttcttccccaccaagtgattccacacaagctcctgaagtcccaactggtaatgtccctctctctcatgtatcaacatctgaagttccacaagaagatgaaacaactagacgtcatgttgggcgtgagtctacacactgttggactgttgaggcaatagactctgaagaaacgatcaagaagattaaggtgaaagttaggggagtcaatagcttacctagggagttacgcatcattgtgaattttgatgaccaaggccaagcaattggtgaagcacaagccttgcttgcaggatttcttggaacactagcagctgattgcaaattatttcctatggattatgatagatggtctggaccttcaggcgtacctaaagcttattttgatgattgctttgaaacaattttaaag

SEQ ID NO: 48568 - DNA, 207 bp, Glycine max
  Peptide Sequence Number=SeqID_140253
atgaggcagtttaaatcagacctcatgaggaaatgggcccttgcaggcgatcaggacgatgtggacgacactgtctgtgagaaatacgacataagcaaggaaaaatgggtccagttttgccagactcgcaaagacccttcttgggagatgtgcggaaaaaggcacaggccatccaaaaatagaacactgcccccggggatcctctag

SEQ ID NO: 48569 - DNA, 612 bp, Glycine max
  Peptide Sequence Number=SeqID_140254
atgacggcatctcttagaggtctgcgcaaatgcgcagagggacacgtgcagccatttttcgcgctgatggtcggattgctcatgctgcccacggcggaggcggtgacatcacagtcctttaaggttagcgccaccattgtaccgggctgcgcggtggccaccggcagcggaggccttctcggtacgctggattttggcagccataacggtgtcgagagcgcgccggtaagcaccagctttgtaccaaacggcgcattgtccattgcctgtacgcctggcgtggcgctgagcatgagcataaatggcggtcaaaattacgcctcccttcgacgtatgaaacggaccaatggcccggaaatggtggggtaccggctctacagcagcagttcgctggctgccaacagcgaaataggcgtcaaccaggcgataccggtgacctataccaatagcaataatatcgcgctgccgctttttggcgtggcgctactgaccgggtttagcccggcaggaacctattccgatcagctcaccgtgaccttgtcatggccaggtacaggcggtcgccaccatactgttatggcctatcgatccggggcttggggcagacgctaa

SEQ ID NO: 48570 - DNA, 177 bp, Glycine max
  Peptide Sequence Number=SeqID_140255
atgaagcctcacaaaagaagaaacgaaagtcgtaaacttaggtgttggcgaagaaaagaaagagtcttgctgtggaactaccaagacatcttcgcttggtcataccaagatatgcctggtttgaaccctgacaatgtgcaacatcgtttacctctactgatttactctaattgttaa

SEQ ID NO: 48571 - DNA, 624 bp, Glycine max
  Peptide Sequence Number=SeqID_140256
atgtctcctttccttgtgagggatttcggcgcacaaaattccaagactatacaaagaatccataaggcatgggaaaccccgttaaggaaagatcaagagcttagaggcattcgtaatggcatcattggtgggtaccacgaatggctgaaagttcatatacgagcgaagagaattttgaagcaccggaagaaggacaaagaagtccaagctctcaaaaagcgagttaggaaaggcaaaaactcgccaaggagaagttcaaagttggctgctacacacgttcggaaggagtgtgccgggttacgggaagagaatacaattaccgcaagagcccttgaacaagagaccaagagggctcgcaaggaagagtatggccggaacaaatttcgcggagctctatggggtagcaatagtgaactcaagttgcgaagggaagaaagggaccagtcgcgagcacatagcatggttctgaaagaggagttgattgcttgttcaaggtccaaaagaagcttgtctcagcgtttatgcgagacagagaccaacatgttagctatcatcgccaagtacgaagaagagttaggtctagccacggcccacgagcatagaatcgcggatgagtacgctcaa

SEQ ID NO: 48572 - DNA, 339 bp, Glycine max
  Peptide Sequence Number=SeqID_140257
atggagaggtcacaccctggcaatcagttcaacaaagaccaaggtggaccttcgaataggccaatccaacaaaggcctaacatctttcagaggactactaagctggaggagactttgattcggtttatgcaggtaataatgtcaaatcataaaagcactgagtcaacactgaagaaccttgagatccaggtgggacaactggccaagcagatagctgacaagtcattcaacagttttgtggcaaatacagaaaagaatcccaaggaggaatgcaaagctgtgatgacatggagtaagaggtttgtggaggctgaggatgaggagtgtgttatgcactag

SEQ ID NO: 48573 - DNA, 99 bp, Glycine max
  Peptide Sequence Number=SeqID_140258
atgttttccaagaaggagggaatgatgagaatcctgaaactggccaaatacaggctagaggcccaagtggagaaggacgaaggcccagatacactataa

SEQ ID NO: 48574 - DNA, 222 bp, Glycine max
  Peptide Sequence Number=SeqID_140259
atgactaaagttctttccgagttacggggtcttcgttcttatgttggtgaacgtttcgactcactggatactcgttttgccggaatggatattcgcctcacacaacttgaagaagatgacttatattgtcatcatcaaaaagggggagattgtagaaaaaatgattcaagaatacaagccacaacatcaagattgttagacaagtggcctcagatatcttaa

SEQ ID NO: 48575 - DNA, 99 bp, Glycine max
  Peptide Sequence Number=SeqID_140260
atggagaattgcactaagcaatcactacgcagtgactccaaacttgtgggtggtggatgcatgaacgaaaacgcaattcatggggctccaaaaagaggg

SEQ ID NO: 48576 - DNA, 819 bp, Glycine max
  Peptide Sequence Number=SeqID_140261
atgaagaacgtcgaagaacggtcgaaaaccttcgcgaaattcctcacggaaaacgttacagaaacgtttcggaagcgcctcggcttagattttcttcacggaaacaatttttccaagcaaattcgaaagagagagaagtgccaaaggggccgaacccttttcttcttcacttcctcccctatttatagcaaaataggggaggtggttgccgcccagctcgcccaggcgagctcagctcgcccaggcgagccaggttgcttcctccagaagcaacagccttctggaggaatattctggagggcccaagtgggcctgggcaatgttaacaaattttggcctggccatgataagatagctgattggtggagtgtggggattttactatatgaaatgttgacaagaaaggatgccactaatcaacaatcactggtaattgtgtactttggtggtaatgattctatgcatcgacatctatctggccttagcccacatgtacctctccaagaatacattgaaaatatgaagaagattgttatccatctcaagttatctattaaggccactagaaggactaatgaagcttgtcaaacatactcagaagcgtgtttggagctatgctacgagatgaagccattgatctctagtctgcactccggcaaaggcatgattgctccattggagcttgtaggcctaggatcttctttatcaatggattcctttgcttcttggaagatgaatggcagcggaatggagaaggaagagagagaggagacgccactaaaaggagaagatgagtctagaagaagctcaccatcatag

SEQ ID NO: 48577 - DNA, 381 bp, Glycine max
  Peptide Sequence Number=SeqID_140262
atggtcatctgcgccctttccggagatgtcatcattttccgatggagacttttcaagtctcacaagttccagaaactacgtagaggcggcgggcccgatgacaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcacccctttgctaggcagacacagttgtgtccgatggcaagcagagatcaagtttggtcattctgcacccaagatacgcggagataccttacggttatctgcacccctttgctag

SEQ ID NO: 48578 - DNA, 75 bp, Glycine max
  Peptide Sequence Number=SeqID_140263
agcactgtgtcataccctaatttcgttcggggacctttgcttaatgacatgcgacctttctttggtccttgtgag

SEQ ID NO: 48579 - DNA, 1101 bp, Glycine max
  Peptide Sequence Number=SeqID_140264
atggctacctcaccaaaagaaacttcatctcctggttcaccctctgtaccatcatctccatcatccaccaaagcaccttcaaaccaggaacaacctgaattcaatatccaacccatacaaatgattcctggtcaagcccctattcctgagaaactggtccccaaaagacaacagggagtgaagatttctgaaaaccctagccttgcaacaagtcctagggaagtagacacggagatggataagaagatccgcagtattgtgagtagcattctgaaaaatgcttctgtccctgatgctgacaaagatgttccaacatcttccaacccaaatgctgaagtcctctcttcatccagtaaagaggaatcaacagaggaagaggatcaagccacagaggagacccctgcaccaagggcaccagaacctgctccagaatctgatgaggaacccattgccaacaagttggcacctggcattgcagaaagattacaaagcagaaagggaaaaacccccattactaggtctggacgaatcaaaactatggcacagaagaagagcactccaatcactcctaccacatccagatggagcaaagttgcaatcccttccaagaagaggaaagaaatttcctcatctgattctgatgatgatgtcgaactagatgttcccgacatcaagagggccaagaaatcagggaaaaaggtgcctggaaatgtccctgatgccccattggacaacatttcattccactccattggcaatgttgaaaggtggaaatttgtatatcaacgcagacttgttgtagaaagagaactgggaagagatgccttggattgcaaggagatcatggacctcatcaaggctgctggactgctgaaaacagtcaccaagttgggagattgttatgaaagcctagtcagggaattcattgtcaacattccctctgacataacaaacggaaagagtgatgagtatcagaaagtgtttgtcagaggaaaatgtattagattctcccctgctgtaatcaacaaatacctgggcagaccaactgaaggagtggtggatattgctgtttctgagcatcaaattgccaaggaaatcact

SEQ ID NO: 48580 - DNA, 195 bp, Glycine max
  Peptide Sequence Number=SeqID_140265
atgatgagtaagttgtggaagaaaactagtgagagaaacccccatgaagaaggaaggttgaacaactctttacttgccatcatattagcgaagagagaaaagttccattggctacccttagctttcaagggtatgccctctattggtggagatcccttgttagggaacgaagggttcatggggatcctccagtag

SEQ ID NO: 48581 - DNA, 693 bp, Glycine max
  Peptide Sequence Number=SeqID_140266
atgcaaaaccctcaacccgccgcgctgcccgagggcgcgggcgcggccataacggatcctgacgcctatgagcatgcggtgctggcacagcacgagcggtcgctgggcgcagagtttgcgcgcagctgcctgaaaaagctgggctggagcctgacggtcaacgtcattcagggcatcgctatctgcgtgctggttgtcatgtactggtacgtgccccgggagtatttcgccacggaggccggtcgcatcacgccggtttacgggacggacaagccggtctggagcgaaagcgacgtgcggcagttcggggcggacaccatcaaccaggcctttacgctggactttgttcactaccgtgatcagataacggcggtgtcaccgaacttctctgaggaagggtttgccggctacaaccaggcgctgaccaccggttctaacatcctgtcgcttatccgggacaagcgcatgaacctgaccaatacggctgagcctggcgtcattacgcgtcgcggcatcatcggcgatcgctacacgtgggagttccagtatcccgtcacgctgaagctgcagggccagaacagcagcagcccgccgctgcgctatatcttcacgctgcgtatccagcaggccgacgtgcgtaagaagccgcgcggtcttgaggtcacgcagaccatcaccaacaacgcaggataa

SEQ ID NO: 48582 - DNA, 430 bp, Glycine max
  Peptide Sequence Number=SeqID_140267
atgttgctaagtagcaatgtcatctatatctgtgtaagagtggtcatgttggtgcgcatgatccgcactcgtctctttgcagtggcacgggtgaaatcttgccccggtatgcatagtagctgtgtgatagcctccctctctggttgtgctcgcacagttggccctcctccaatatcagggggtggcccaggaaccatgtggagcacactgaaaatgaggacacgtagccctctaaaggtgagggcgtgcagccctctcaaggcgaggatgtgtagtcctctagaggtcagggcatgcagccctctgttggcgaggacgtgtagtcctctcaaggtgagggcgtgcagccctctgttggcgaggacgtgtagtcctctaaaggtgagggcgtgtagcccttacgaaggtgaggacatgcagtcctttgatg

SEQ ID NO: 48583 - DNA, 543 bp, Glycine max
  Peptide Sequence Number=SeqID_140268
atggggacaaatcaaaacggcaaaaggttttatcaagtcaaggttaagggtctagatgtcaccagcctcaaggaattgggaagattgatgggacctctccaaaggcaagccttccgcaaagtgtacagaaagattctagatttgaccgcagcgaaggtatttacggaagctgttgtatccctcgcccaatactatgaccagccgttgagatgcttcacgtttggggacttccaaatggtaccgactgttgaagagtttgaggagatattaggatgccctcttgggggaagaaaactgtaccttttctccgggtttcttccctccttgagtaagattgcagttgtggtcggagattcggaaaaagaatttggatcatatgaagcaaactcggaacggcgtagtgggcctgtcgcggaaatacttggaaggcaaggcaagggatatggcaagccaagagaagtgggtcccgtttgcggatatactagctttgctgatctttggggttgtcctctttccgaacatagacggtttgggtggacctag

SEQ ID NO: 48584 - DNA, 186 bp, Glycine max
  Peptide Sequence Number=SeqID_140269
atgattaaagcacgtcaaaagggggtacggaaagaaaataggggaggagcttgccacccagctcgcccaggcgagctcagcgcgcccgagcgagccaggttgcttcctccagaagcaaccaccttctggaggaacacctggaaggcccaagtgggtttggttgctatttgcacctttttttactaa

SEQ ID NO: 48585 - DNA, 321 bp, Glycine max
  Peptide Sequence Number=SeqID_140270
atgaaacaggccaaatacagtctaaaggcccaagtggagaaggacgaaggcccaagtggagaaggacaaagcccccgagtggagaaggatgaaggcccaagtaatccttgtggcgtctacccagacttatcttccttcactggaagtggcgtctacccagacttatcttccttaaccggaagtggcgtctacccatacttttcttccttcactggaagtggcgtttaccatgacttattttccttcactgtaagtggtgccattcaaaccttcgtagcctgtatcaaacgatcctttcctttcatgttcacattactttga

SEQ ID NO: 48586 - DNA, 171 bp, Glycine max
  Peptide Sequence Number=SeqID_140271
atgcctccccccctcttatggcgatgttctccgctggcccagcgccgggaaggggtgacgattggtcggtcacgatcctatccttcattcgccttcatccctaagtacctgcaagtaggagacaaacaatatgcggccaatcgtgactggtcatcgtcttaccttggttga

SEQ ID NO: 48587 - DNA, 165 bp, Glycine max
  Peptide Sequence Number=SeqID_140272
atggcagaatcgtcaaagaaacgtaagggttcatccgcctccgcttcggcttcaagagctcatcgtgccggagccactagcgcatccacagcagcaattccaccctcattatcctcttccacattgttttcttctgaagaacagcagaaacggacaacactttaa

SEQ ID NO: 48588 - DNA, 198 bp, Glycine max
  Peptide Sequence Number=SeqID_140273
atgacaaagtacaatgcagaacagcggggtcacctaaaggctgaatctcaacacttcgcaagtgtgaatgatgccaatccctatgtagcttccatcccttactttgggttcattgatgaaatttgggagcttaactatgtgaaatttacttggatctcatacaattggtttctagagagagagagctcacgaaagcaa

SEQ ID NO: 48589 - DNA, 126 bp, Glycine max
  Peptide Sequence Number=SeqID_140274
atgtcggtgtcaggaaatgttcgatcggcccaagtggagaaggacaaagctctcgagtggagaagggtgaaggcccaagtggaaaaggatgaaggcccagaggcagagacactatcaagactataa

SEQ ID NO: 48590 - DNA, 887 bp, Glycine max
  Peptide Sequence Number=SeqID_140275
atggcttcaagaaaaaggaaaagcacgacttccaggccccaacataactatgatacaaggaggtttacctcagaagaagcctggaacagatacgccgacaacatcctcggccagaacatccttccagaaaggaacgtcaagctctatatcatggagtttgtcaagtttagaagggagttggagaagcgcaacctgcacaagcatctcaccaacttagctgatggcaggattgatgtcacagtggtcaaggagttctacgcaaacctctataaccctgaagataactcaccaaagcaggtgagagtgagagggcacttgataaagttcgatacggacaccctcaacacatttctggggatcccagtggtattggaacctggggagaccatccccacatattctagattttgcagactgaggatggatcctcaagagatagctgtcgagctcctaccaaggttcgagaagcttctgaagcgtgacagtttcaaggcgaagccaatgccgtcaacgctcgtcgaaaccgccgtcgccgccaactgcacgtccgaccacacgcagttaaagagtttggttccctgcttggtggaggcgttgagcagcgacgattgggccacgcggaaggccgcggtggagacgctcgtggtggttgttgacatggagagggatttcttatcggagtttaaggttcgggacgttatgaatcaaatgttggaagcgtggaagctagttcctaatgtttcggatgaagtttctccacctcctaaatcgcaatcttcatccaaagagaatgcaagtgatggccactatccgcaagtctctcaaaattcatgtagtcctcgttcaatgatggccaatttgcagaagaaatctactccttttagcag

SEQ ID NO: 48591 - DNA, 164 bp, Glycine max
  Peptide Sequence Number=SeqID_140276
atgctggatgatcctgaacccctgaaactcccccattgtacagaagttcctcttaaagcttgtggtaaccacatgactgtgttaaggcgacacggccccccactacaatggaaagttgaaaccttgaatcctgctattggtggaaaaggtgttgtccaaccatg

SEQ ID NO: 48592 - DNA, 378 bp, Glycine max
  Peptide Sequence Number=SeqID_140277
atggctggcctcccaaactatacaccacccaatgttgcgtacattcccaatgaggatgtcaataactccacacccatactcattaagagccaacaacctcaatctgatcatgcacatgtctctcgacccatggaggagacacatggaatgccctaccacaatctagccgacttcgagccttgccttggatatgccactgaagggcaagcagttggtggtatacccctacaaaacactttggagggccctcagtgtcacccacaaccacaaccctcacattccacagcggttaaaaaccctcatgctatggcaaaaatgggaaagaggaaaggctcagggccattgaaggaggtaaagattatgcctttgctaacctag

SEQ ID NO: 48593 - DNA, 609 bp, Glycine max
  Peptide Sequence Number=SeqID_140278
atgaccggaagacttctttccggttcattggcttttgaaagccgcatcctccattaccttatagttcgcattttgcttcctagatcttcaaaccttgcccaggtttctgaagaagatctcattgtcatgtgggcctttcataaaggtttacaaattgattggtcacatcttgttagatatcgcatgcataaggcattgcgattgaatgccccattgccttatccttaccttgttaccctcttccttcaacatttcaacatccctcttgattctgaaccttatgttccaatcaagagatcattccttataggcgcttcagtcatagcatcctttggttatattaaggagcatgatggatcatgggtaaagaagggtgctagaaatattggtgaagaaggacatgagggagaagattcatctcttctttcgaagattttggaaaggtttgatggtcttcaaacctttgttggtgagaggtttgatactttaaaactgcaagtggatatgcgcttcaatgaaatggagtcaagaatgactaaggttgaagaagatgtatcttacatccggtcaagctttgatcttccaccaccgccgccaccatcatcttag

SEQ ID NO: 48594 - DNA, 291 bp, Glycine max
  Peptide Sequence Number=SeqID_140279
atggcaagacacaaggtcacacgcacacacacacacacacactcacgcaggcacaagggggaggaggggcttggtcgtccgtccgcccgggcacacacctatttagcaccaggcaggcaaaacgagagagagccgacgaacggtagcctcttttggcctgcagggtttgttggtgatttggaggggagggacgaatcacagcgacaagggctgaatctcagtggatcgtggcagcaaggccactctgccactacaataccccgtctcgtatttaagtcgctctgcaaatga

SEQ ID NO: 48595 - DNA, 504 bp, Glycine max
  Peptide Sequence Number=SeqID_140280
atggcagctagtgatcacgccatcctccgtgatcgagcctacacacccacaaaaaagagccttctcgagctcacatctcaagatgccctgctagctcaaaacaagctcatggccaagcaactagagaccctcggatgcaacatctgtggtgggactcatgagtcaggcttgtgcatggctcaagacgacgcatccaaagagggaggaaatttctctcaaggccaaggttggagatcccatccagggaataacttcaacaaagaccaaggagttccatccaatcggcctcccaaccaagggtccaatctatatgagagaaccaccaagctggaaggcacactgatgcaattcatgcaagtttctctgtcaaaccacaagagcaatgagtcaaccatcaagaatctggaggtgcaggtgggccaattagctaagcaaatggttgaaatgcccactgcaagctttgtggccaacactgagaagaataccaaggaggaatgcaaggaa

SEQ ID NO: 48596 - DNA, 439 bp, Glycine max
  Peptide Sequence Number=SeqID_140281
agaattagggttcgatttccggagagggaagcctgagaaacggctaccacatcccaaggaaggcagcaggcgcgcaaattacccaatcctgacacggggagttaaaaagctcgtagttggaccttgggttgggtcgatcggtccgcctccggtgtgcaccggtcggctcgtcccttctgccggcgatgcgctcctgtccttaactggccgggtcgtgcctccgcatgggataacaccacaggattctgatcctattgtgttggccttcgggatcggagtaatgattaacagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagataccgtcctag

SEQ ID NO: 48597 - DNA, 438 bp, Glycine max
  Peptide Sequence Number=SeqID_140282
atgtctcctatagtagtcataactcttgcaagagccgaagtgaagaacttcgtgactattatgaaggaaggcataggtcacatcttagacctcactcccataggagagaaaaatggaagaaagcctcaagaggttaacattaaactcccatacttccatgggaaggacaatgtagaggctaatttagattgggaaataagggtagagcaacaacttaaaaggaagtctacttcaaaatattatggctctcactcttatccaaaaggacacattacttctcaatgccccaccaagaaaaccatgattatgaggggccaagacatttatagtagccaagatgaggctactacttcaccttcctctagtgaaagtgaagaagcaaaggggggagaatctagtgaagaaatctatccccaagaagaaggacaacctttaatg

SEQ ID NO: 48598 - DNA, 201 bp, Glycine max
  Peptide Sequence Number=SeqID_140283
atgaggatcaaaaggtcttttaaggttgtaatgggccaaggacaagcctttgagaaacaacatttcattcagcatgcttgtagtgagcttcaaaacaaggaaagggaaacaaagctcaaaagggctatcaaaggaattaattcaaggacgcatcaacaagaatcaagccaaggctattgtgcaagcaatcaatggggctaa

SEQ ID NO: 48599 - DNA, 204 bp, Glycine max
  Peptide Sequence Number=SeqID_140284
atgcaaagagcaatgcaaccaatgaaaagcatggatgacatggggttgaatcaatttagatttttcaacatggttcatgacatcttggtcaaggtgaaactggaagtaacaaggatatcaacagtcctaaatgtgttcggcagtagacgaagcagtgataggaaaatgcaaggatcacgcatgagcgaacatgaaaaacaaaag

SEQ ID NO: 48600 - DNA, 210 bp, Glycine max
  Peptide Sequence Number=SeqID_140285
atgtcggctgaaaaatatcagtcgcggctgtttaacagcccgatgttggctgttgttttgtctattcaatccctgaataatatttggatgatgtcgattaggaaatgttcgatcggcgtcaccatcggtgacttttctttcacctccgatctgtctaactttcctggccgatgtcgtctagcatttttttcgatcagtatcggtgaataa

SEQ ID NO: 48601 - DNA, 180 bp, Glycine max
  Peptide Sequence Number=SeqID_140286
atgcccgtccccctagcaaggtcacgccatcgtgacataggtaaggattgcacccgcaagatacccagtggacccggagaagtccaacagggtcctggggttttcggctctgattacgggcttttgttagttctacggagtgcccgtcgcccccaacaaggtcatcaggccccttattag

SEQ ID NO: 48602 - DNA, 2733 bp, Glycine max
  Peptide Sequence Number=SeqID_140287
atggagctgcacgatcgccttggcattcgcttcccggtttatgtgctggtcaccaaaaccgacctgctaaaaggcttccgcagctacttcgcttcgctggataaaacccagcgcgagcaaatctggggctttaccttcccgtgggcgcaggcgtcgaccgcagagtttgagctcaacagtcagtttcagcaggagtattcactgctgcagcagcgtctggatgccggtctggccgatacgctgctggcggaaagcgatgcgcaggcacgggcggagagctatctgttcccgcaggagttcgccgcgctgcgtccgctgctggcggaggcgctggatacgctgtttgcccgctctgatttcgaaactcagttcgcgccgcgtggtatctatttcgccagcggtactcaggaagggctgccgtttgaccgcgtgatgggcgagctgagccgcgccctgcatctgccgggacagcgcagcggcgagtccggcagctgggaccaggtcgacaaagagtcaccgatcccgccgaacaaaggccagagcttcttcctgaaaggcgtgctggaaaatgtcatcttccaggagtcaggcctggcgggcagtaaccgctggtgggagctgcgcaatcgcgccggattgtggtccggctatctggcgctgctggtgctggtactgattgccggagcgctgtggcttaccagctacagtaaaaacaaagcctatttgcaggagatggcgggtaaaacgccgcaggtggagcaactgggacaacagctggaacgccagggcaatggcgatctgtttgcgctggtgccgtatctcaacacgctgctgcagctgccgaaaagcgccgacttctcgctggaagatcccccgctgacgcgccgcatggggctgtatcgcggtaccgaagtcagcgacgccacgcgcaccctgtatgacaaagcgctgaaacagctgctgctgccgcaggtggcgcaaaacatcacccgctggctgcgcaacgacaacggcagcgatgcggattacagctacgaagcgctgaaagcttaccagatgctgtatcagccaaaacattatgacggcaaattcctgcatgcctggctgatgctgaatattagccgcgaactgccgcaaaacgtgacgcagcaggaagtgaaacagctggcgtggcatctgcagcagctgctggagacacagattcagtcctcgccgtacgcgaaggatgatgcgctggtaaagcgcgagcaggcgctgattaaccaaatgccgctgtcgcagcgcgtctacggacgtctgaagcgcctgctgcagcgtgacggcagcctgcaaccggtcaccctcgcggcgctgggcgggccgcagagtgagctggtgttttcacgcaaaagcggcaaatcagtcaatgacggcgtggccggcctgttcacgccagacggttactggcagcacgtcgataaacaaatcgcaccggtcacgcaggcgctgttccaggatgatgtctgggtgctgggcggcgttgcgtcgccggagaacagtcagcagaccgacctcgcggtgcgccagctttacgtgcaggattacatccgccagtgggagcagttcctcagcgatatccagctcaacagcagcgcggatttgtcgcagcgcatcaacaccgcacgtctgctgtcgggcaaccactcgccgctgcgccagctggtggttaacctcagtaagctgctgacgctgaaccgcgcacagccggatgagcaaagtgcccaggcacagccggcgacgggcaacagcgccacgcgcactttagaagcgctgttcagttcctccaaagccagcgcggcgccgggccagggcgcagcccagcaggcaccggagcaggcggtggcggtgcacttcgcgcctgtgctggaactggcacagccgctgcagcagggcagtaaagtgctggcggtggatgattttctgcatcagatcgacgatctctatcgctatctgacggcggtgcaggacgctgccaatagcggcatgccgccgccgtccggcgatgccatcagtcgtctgcaggccagcgccggtcgcttaccgggttcgctgcagaatatggtttccagcatggccgtgggcgccagcagcgatgcacagcgccgcgatatggataacgtgcgcaagcgcatcaccatggaagtgggcagcttctgccgccaggcgattgccggccgttatccgctggtgcgcaatgcgcgcagcgaagtaacgccggacgatctggcgcgcatgttcgcgccgggcagcgggctgatggacagcttcttccgcgacaatctggccagcaaagtggataccaccaatacggcgtggcgtttcacgcctggtatcgacggcaaaacgctgccgggcggtgaggcgctgctgcgtccgttccagcaggcgcagtcgattcgtgatgccttctttgctaacggggcgaccacgccgtcgttccgcgtcacgctgcgtacggtgaagatggataacgacattctcaacctgacgctcgacgtcgatggccagattctgcgttacagccacggcccgcaggcggtgcagatggtgagctggcccggaccgggcggcaccagtcaggtgcgcatgcagcttggcctgaccaacggcaccacctcaacgctggtgaccagcggtccgtgggcgctgaaccgcttcttcgatcgcgctcgtgtaaccgcgtcggtggcctga

SEQ ID NO: 48603 - DNA, 1479 bp, Glycine max
  Peptide Sequence Number=SeqID_140288
atgacccagtcttcgcatcagcagcaacagggcgcttcgcactacagcgagaatgaactcagcgccctgctgaacaaagaatttcgtccaaccagcgatcaggcgcgtgcagccgtcgaaagtgccgtgaagacgctggcgcagcaggcgctggaaaacaccgtcaccatctcgaatgatacctatcgcaccatccaggcgctgatcgctgagattgacgacaagctgtcacagcagatcaatcagattattcatcatgaagagtttcagcagctggagagcgcgtggcgcggtctgagctacctggcgctggctgggatcagagtcccgctgtttaagaagatttatgagcaggagtacggtcagttcggtggtgaaccgtttggctgcctggtgggcgattactatttcgatcacagcccgcaggacgtggagctgctgggcgaaatggcgcgtatcagcgcggcggcacactgcccgttcatcaccggtaccgcgccgaccgtcatgcagatggagtcatggcaggagctggcgaacccgcgcgatctgaccaaaatcttccagaacaccgaatatgccgcctggcgcagcctgcgtgaatcggaagatgctcgttatctcggcctggtcatgccgcgcttcctggcgcgcctgccgtatggcattcgcaccaatccggtggatagctttgattttgaagagcagaccgacggctcaaatcacaacggctacacctggagcaacgccgcctacgccatggcagccaacatcaaccgttcgttcaaagagtacggctggtgcaccgccatccgcggcgtcgagtctggcggtgcggttgaaaacctgccgtgccacaccttcccgagtgatgacggcggcgtagacatgaaatgcccgacggagattgccatcagcgatcgtcgtgaagccgagctggcgaaaaacggctttatgccgctggtacaccgcaaaaactccgactttgctgcctttattggtgcgcagtcgctgcaaaagcctgcggaataccatgatgccgatgcgaccgccaacgcacgtctggctgcacgcctgccgtatctgtttgcctgctgccgcttcgcgcactacctcaagtgcatcgtgcgcgacaagatcggttcattccgcgagcgtgatgaaatggagcgctggctgaacgattgggtgatgagctatgtcgacggtgacccggcgaactcgtcacaggaaaccaaatcgcgtaagccgctggctgccgccgaggtgagcgtggaagagcaggaagataacccgggctactacgccgcgaaattcttcctgcgtccgcactaccagctggaaggcctgacggtgtcactgcgtctggccgtcatgtatggcggcctgaatgctcacaaagctttgcagttaccgtgcaaacgcaaaacgcttattgcgagccggctccacgtttcgatattaatgtcgaggaactaa

SEQ ID NO: 48604 - DNA, 615 bp, Glycine max
  Peptide Sequence Number=SeqID_140289
ggtaaggctttcaatgccaagattgaatataattgcaaagagggtaacctgacctgtaatgatattttactcaaatcttcaagtctgaaaaataattcttctattacccttaaaggcgaaacgattaacactcactgccctgatgtttgcgactttcagggctatcagtttaaaaacggggaatatgaatattcattttatcccagtgttaaggaggttaatctctgggattatattgtgacttacaaagataaggtcattgctcaggatgtagctttcgctgcagccctctgctccagcgaaccctcagatagcgccgtttatcagtgcacgcttcatgagaagcagttagctgaagacgcgttgaatcaggaatacacggcggcaaaaaaacggattgcatcatcataccgcgcggataaaaaactggcggatgattaccttagcacattaacaaatacccaacgtggctggctaaagtaccgtgatggacagtgtaagctggaagcttttgatgcagaggaagggagtatcgctcacgaagtagcgactaatatctgcattgtgcgcatcaataaagaacgcctggaatcattgaggcagattccttattaa

SEQ ID NO: 48605 - DNA, 5151 bp, Glycine max
  Peptide Sequence Number=SeqID_140290
atggagtcgttacaatcgcgcctggccagtgcttcactggccgagagcctcgccgatatcacccgccagattcaggccagcccggccaatgccgacctgcgcgcggcgtttgtgcagctgttgtgcctggcgggtaactggacgcgcgcgcaaacccagctgcaatcgtggctggcgctgacgccccaggcgcagccgaccgtcaccttactgcagcaggccattgccggtgagcagcagcgtgaagcggtactgcgcggcgcggcgcagccgcagctgccgggcagcgcgtgggcgtggtgtgaaaccctgctggctgcgctgaccgccgacatccgcggtgacttcgcgcagggtgcggagcaacgagccgccgcgctggcgcaggccgaagccaatccgggtcagctgcaacagcaggaacagacggcagaggtcgcgtggctgatggacggcgacagccgcttcgggccggtgtgcgaggccatcgccaacggccgctactactggattccgttcgccgcgatccgcgagatggaatttcaggcacccgccagcgtgaccgatttggtctggcgccatacgcgcgtgcagctggttgatggcagcgagcagatttgccagatcccggtgcgctatccgctgctgccgggggcggatgagcgttatctgcgcgccagcgtcacggaatggcagccgctgggccacgatgacacaatgagccgtgataacagctcgcacaacgacggctatgcccagctgcatggcggtttccgcgcgcgtaaaaatcgcgacgcgctaaccgcgcgcgacaagctgcaatcctcgttactcgatcgtctgactgacaacgcgccggacaagcagagcgaagccagcaacactacgctgatttcccacagcacgctgcgccgccacgtgctgcgcgatctgcagtggctgttcaacaccatcaacaacgaagcccagcaggatctcagcgcctttggtgaagtgcaacgctcggtgtggaattttggcgtggcgccgctggccggacagaacatctccgacatcgaatggcaggatatgcagcgcaaaatgaccgatgccattctgcactttgagccgcgcattctgccgcaggggctgcaggtacgctgcgtcagcgatctgaagtcgctcagcctgcacaacgtgttatcaattgagatcaaaggccgcctgttaatcatggacagcaaactgctcgactactacaaccgcgaactggcctatctgcgtgagctgggcgcggagttcgctgcgcgctatccgaaagtcgccgggcggctggggatgcgcggcatcgaagttgccgacccttatgttgagcggctgatggagggctttgctttcctcacgtcgcgcgtgcagctcaaaatggacgccgaattcccgcgcttttcgcagcggctgctggagatgattgcgccgtcttatctgtcacctacgccgtcgatggcgattgcacagctcacgccggacagccgcaaaggcgacatcagcaatggcttccacgtgccgcgcggcaccatgatggagagccagcacctgaaaaaaagcggcgtcacctgcagctacaccacggcgcacgatgtcacgctgcatccgctgcgcatcagcgacgtttcactcggcggcgtgccgggcgatctgccgctgggcgaactgaagctcagcggtcgcggtgccgccagcgcgctgcgcgtgcgtatcgcctgcgaaggcatttcgtcgctcagccagttgaatgtcgccgatttaatgctgtatctcagcggcccggacattcaggcacagaaactgctggagctgctgatgcagcaccgcgtcggcatcgtgctgcaatcggttgaacagaaaccgctgcgccaggtgctgccggatgactcgctacagcaggaaggctttgcgccagagcaggcgctgctgccggacgatctgcgtaacttcgacggctaccggctgctgcaggagtattttgcctttccggcgcgcttccagttcatcagcctgagccagctggcaccgtttctgcgccgctgcgataacgcgcaggaattcgacattatcatcctgctggataaggctgacagcgcgctggaaagcgtggtggacagcagccatctggcgctgcactgcacgccggtaatcaacctgtttcccaaaacggccgagcgcctgaaggtcagcgacagccagcacgaatatcatctggtggtggataacatccggccgctggactacgaagtgcactcggtgcagcggctgttcgccaccgttgagggcaagcgcgaagagcagttattccgcccgttctggagcaccttcagcggcgacgacggcgattacggtgcctatttctcgctgcgccgcgagcagcgtacgctgtctgagcaggcgcagcgttacggcacgcgcaccggctatatcggctcggaagtgtttttgtcgctggtggatgaacatcacacgccgtggcgcgacgacatgcgctacctgtcggcagacgtgctctgcaccagccgcgatctgccgctgatgctgttgcagcaggagcagggcaatttcgtcatgccggattcgatcccggtcggtcagctgaaattgtgtaaaggcccgacgccaccgcgtccggcgctggccgaagggctctccgcgtggcgtctgatcagccacctgcagatgaactacctgagcctgatggacagcagcgacggtcagggcgctgccgcgctgcgccagctgctgagcctgtacgctaatctcgccgaagcggcggtggcgcgccagattgacggtattcgccactgccagctcagcgcggtcaatcgccgggtgccggaaccgggcccggtggtgtttgcgcgcggcgtcagcatcacgctggaggtcgacgaacaggcgttctccggtgccagcccgtggctgctcggcagcgtgctggaacgcgtgtgcagccggctggtcgcactgaatagctttaccgaattcactctcaacagccagcagcgcggcgaggaaggcgctgctatgagcgaggcgcagatcattccgctgcagcgcgcccagcggctgccggacgatttctggcaggcagtgatggcggcaccgtggcgctacgatctgtttcagctgctgcgccggctggatgcacagggcggccagcgctatccgctgggacgtgcgccgctgccgaagttcgaagcgctgcgcattggtcagcaaccgtcgctggcgtttgccccggcaacgctggccagcgtgcagccgcgcgcagaggacgcgcgccatgacgtggcgatttacagctttggcctgtttggccccaacggtccgctgccgacccacctgacagaatatgtgcacgagcgcatcgtgcaccatcaggatcacagcctggcggcatttgccgacatctttcaccatcgcgccacgctgctgttttatcgcgcctgggccgatgcgcagccggccgtctcgctggatcgcgccgataaccgccgctttgtcgattaccttgcctgtctggccggcatcggtttaccggcgcagcagcaggccactggcacagaacgtgccgcagtggttgacgctggacgcgcgcgatcaggcgcggctgggagccggacgccagatgccgcggctgggcgaatcggcgttccttggtgtggcggtgcgcgatgtgcagcaccgttttcgcctgcggctcggtccgctgagcgcgcagcagtatgcccactttctgccagatgcgccgggcgcgcgcgaagtgcgcgactgggtgcgtcactatctcggtatcgagatgcaatgggacctcagcctgatcctggcggcggaagaggtgcaaagcgtcacgctgggaggcaatgcccggctgggctacaccagctggctgggacacgcgccacagccgcaggatcgcgaagatttcatagacccgatatgtcagaaatcagccgtgccgtgttattcggcaaactggatacgctgttatttacctcgctggaaagcgccaccgccttttgtaaactgcgcggtaatccttatgttgagctggtgcactggctgcaccagctgatgcagcagcaggatggcgacttacagcgggtgatcagccatttttcactggatgaaaacgcgctgacgcgggatatcgtcgcggcgctcgaccgcctgccgcgcggtgcgagcgcggtttccgatctcgccgaacacatcgacagcgccgtcgagcgcgcctgggtctacgcctcgctgaagtacggtgcgacgcgcattcgcggcggccatctgctgattggcatgctcaaaaccttcaacctcgccagcgtgctgaaaggcatttccggccagtttggccgtatcaatgctgatgcgctgctggagcagttcgacacgctgctcgccagcagcaaagaggcacagcaggcgctggtggcacagccgggcgtggagagtgccgcaccggcagccagcaccagcacgctggcgcagtacgcgcaggatctcaccgcgcgcgcacgcgaaggacgcatcgatccggtcaccggccgtgatgaagagatccgccagatggtggatattctgatgcgtcgccggcagaacaacccgctgctgaccggcgaggcgggcgttggcaaaaccgcggtggtcgaaggcctggcgctgcgtattgccgctggcgacgtaccggctccgctgcgcgatgtgcagctgtggctgctggatatcggcatgctgcaggccggtgccggcatgaaaggcgaatttgaagcgcgcctgcaggcgctgattaatgaagtgcagtccagcccgacgccgattgtgctgttcgttgacgagatccacacgctggtcggtgccggcggccagcagggcaccggcgatgccgctaacctgctgaaaccggcgctggcgcgcggccagctgcgcaccatcggtgccaccacctgggccgaatacaaaaagtacattgagaaagatccggcgctgacgcgtcgtttccagaccgtgcaggtgcaggagccggatgaagccaaagcgattctgatgctgcgcagcaccgtcagcgcgctggagaagcaccatcaggtattgctgctggatgaggcagtcagcgcagcg

SEQ ID NO: 48606 - DNA, 339 bp, Glycine max
  Peptide Sequence Number=SeqID_140291
atggaagctaatagcaattcaaatggtcataactttttactcggaggtttccgattcaggcacataatatatcgagacgtcgaaattgaaaaacagaagctctcaagaaattcaaatggtcataaattttcactcggaggtcagattcaggagcataatatatcgagacgctcgaaattgaacagcggaagctctcaagaaattcaaatggtcaaaaactttcacacggagagatgctcgaaattgaacaacggaagctctcgagaagttaaaatggtcataaattttcactcggaggtccgatgcaagcgcatcacatatacagatgttcgaaattga

SEQ ID NO: 48607 - DNA, 180 bp, Glycine max
  Peptide Sequence Number=SeqID_140292
atgaccctcaagcgtaaggtgcaaggtctaattgatgcgggattttcaactttcaccggaattgggtgcaagccattggtctatttgctcaagcgacctgtgaccattcaatcagaggttactcgtcttgcacgttggcggggctgccgtaaaacaacaaataaagctcaaaacaaataa

SEQ ID NO: 48608 - DNA, 243 bp, Glycine max
  Peptide Sequence Number=SeqID_140293
atgtcattgcctagcgctgttcatgtgtcctccaccttcgagtttggagctatgcttcaagattgcctaagtgtggaccctcaagtgcaatcctccattctccctttatttcggagtccccatgaaggtcattgcctagcgctgttcatgagtcctccaccttcgagtgtggagccccgcgaatgttcattgccttgcgctattcgccaatctccattctccacttttttcggagcccaatga

SEQ ID NO: 48609 - DNA, 957 bp, Glycine max
  Peptide Sequence Number=SeqID_140294
ggggctaaacgccctcaccttcagaagactacacgtcctcgccatcagagggctacatgccctcgccttcagaggaccacacgccctcgccttcagaggactacacgtcctcgcgttcagaggaccgcacgtcctcgccttcaaagggctacacaccctcaccttcagaggactacacgtcctcgacttcagaggacttcacgtcctcaccttcagaggactacacgtcctcaccttcagggggctgcacgccctcacctttacaggactatacgtcctcaccttcagagggctgcacgtcctcgcctttgtagggctacacaccctcaccttcagagggctgcatgccctcgcctttgtagggctacacgccttcaccttcagaggactacacgtcctacctttcgaaggactatatgtcctcgcctccaatgggttacacgcaccttcagaggacgacacgtcctcgccatcagaggactacacgtcctcgccttggtagggctgcacgccctcgcgttcagaggactgttagccctcgccttcagaggactacatgtcctcgccatcagagggcttcacgccctcaccttcagaggactacacgtccttgccatcagagggctgcacgccctcaccttcagaggactacaagtcctcgccatcagaggactgcacgtcctcaccttcagaagactgcacgtcctcaccttcagagggctgcacgccctcgccttcagagggctacacgccctcgccttcagaggactgcacgtcctcgtctttagagggtcacacaccttctccttcagagggctgcacgccctcgccttcaaagggcgacacgtcctcaactttagagggttgcacgccctcgcctttagagggctacgcgtcctcactttcagtgggctccatatccacaccttaagagaatttaaggtcctctgcccttaa

SEQ ID NO: 48610 - DNA, 432 bp, Glycine max
  Peptide Sequence Number=SeqID_140295
atggcatcgttcagcccggatacaagtcccagtttcagttcccagatgcaatttcagggacttacactgcctccggaccctctgttggtccctcaggaaacgatcctaggacaagtgactcagacaggtgcagcttgtacatcgaagcaaatcctgtctgccctggttgccctgggaagagtttatgagggatccactgttgttcataacactcctttgttgcctggacaagtaaaggtgggtgtggaggaggttaaagatccagatgctcccattcctgtacccactgatgaggtttccttagtggggctggcaattcacatcttccttgcttggccgacacatctggtcaagcctttatcacaccagttgtgtctccaacaaaaccacctcaaaagccggatccggaggtcgatgatcctctttatctga

SEQ ID NO: 48611 - DNA, 561 bp, Glycine max
  Peptide Sequence Number=SeqID_140296
atggaggccataaaagagcaaatggccacaatgataaaggccatgatgagcatgaagaagataatggaagccaatgcggtgaacccaatgctcccatctggcctcaagcaaatgaatcgtccaacctcaaatatggtaggcaaagatttgggaagtacggatgaccccatgatgtgcaaattcaaaacgagcacgccttcccatcatatggcttgcctcccaactatacaccacccaatgtggcatacactctcaatgaaaatctcaataactccactccgatactcattgagaaccaataacctcatcaggcacatatctctcaaaaccatgggaaagacacatgaaattccccaccacaatctagctgacttcgagccttggctcggatatgccactgaagggcaagcagttggtggtataccctttgaaaaccctttggagggccctcagtatcacccacaactgcacctattgcattccacagcggataaaaaccctcatgactatggcaggaatgggaaagttggatcatctaaaggaaaggctcagggccattga

SEQ ID NO: 48612 - DNA, 216 bp, Glycine max
  Peptide Sequence Number=SeqID_140297
atgtataatactataataaccaatattggtctccactgcaatgcacattggcaaatggttgtcattttgcctaaggaaaattttatcttttggttttgttccttgcataataggccagacaactacctgaaaggaataattaacagtgctttgaaaggccttaacgatattccacaacctaaatccaaggttggtgctaggtggattgttgttaaa

SEQ ID NO: 48613 - DNA, 431 bp, Glycine max
  Peptide Sequence Number=SeqID_140298
atggattcgcataagcgcaatgtgatgtcctgcgccgttctgccccctctcccttccagggtgagggctggggtgagggttaatgttcgcaccagaatagccgcagttcaggccgctgactggccgcgtcagattactgacagccgtggcacacatacactggaaagccagccgcagcgtattgtttccaccagcgtcaccctgaccggctcactgctggcgattgatgctccggtgatcgccagcggcgcgaccacgccgaataaccgcgtcgcggatgaccagggctttttacgccagtggagcaaggtggcgaaagaacgcaaactgcaacggctctatatcggcgaaccgagcgccgaagccgttgccgcgcaaatgccggatctgattttaattagcgcaaccggcggggattcggcgctggcact

SEQ ID NO: 48614 - DNA, 231 bp, Glycine max
  Peptide Sequence Number=SeqID_140299
atgatgacaatgatagtagacacattaccagtattctactatgaaaagatggtgggttacacaccttcaagcttcgctgatttagttttcatcgacgaaaggatcaaagcaaccataaccccaacccaaggttcatcaacctccatttctccgagaatacgactcgaacgcaacgtgtgcttgtcatggagaagcctcggggcattccatttgagcattgtaggggcctga

SEQ ID NO: 48615 - DNA, 195 bp, Glycine max
  Peptide Sequence Number=SeqID_140300
atgaacagacacatagacaacattgtggaagcaacttccaagattattttgatgatgccaaagaatcaagagttaagcaaattccaaagattcaagaacaagtttcaagaatcaagattcaagaataatcaagatcaagatttcaagactcaagattcaagaatcaagagaagactcaatcaagataagtactaa

SEQ ID NO: 48616 - DNA, 377 bp, Glycine max
  Peptide Sequence Number=SeqID_140301
aacacgctttacgacgcccttaccgaacccgtgctagagctagagtaatgggtgaagtagaggagctgcaagagcagatgaaggccgacatggaggccatgaaagagcaaatggccacaatgatggaggccatgatgagcatgaagaagataatggaagccaatgcgattgcagttgccgctaccagggctgttgctaagtacggacgaccccatgatatgcaaatacaaaacgagcacgccttcccgccatatggtttgcctcccaactatacgccacccaatgtggcgtacactcccaatgagaatgtcaataactccactcctatacccattgagagccatcaacctcaaactgatcatgcacatttctcttaa

SEQ ID NO: 48617 - DNA, 348 bp, Glycine max
  Peptide Sequence Number=SeqID_140302
atgaaagataagagggatgaggaagaaaaactagaaaaacaaaagaaaaagaaggatagtaaggtcttgtcatcaaaggccaaggggaaggaaaaagaggaaaaggattcctccaagaagattgttaagaaggaaaatcattttgcaacaaaaggtgatatcaaaagagcactccttcttaaaaaatctgtctaccttctcctatcaagggaaacatcccttagcactgccacacctcttgagcttgagttttttcctcaagtaaaggagttgttggatgagggtttggttcgtaagagcttaactagtgctttgttggtgcccaaaataagaattatgaggcactga

SEQ ID NO: 48618 - DNA, 596 bp, Glycine max
  Peptide Sequence Number=SeqID_140303
atgatgagcatgaagaagataatggaagccaatgcggtaatagttgccgctactagcgctgtcgctaagatgaacccgatgctcccatctggcctcaagcaaatgaatcatccaacctcaaatatggtaggcaaagatttgggaagtacggatgaccccatgatgtgcaaattcaaaacaagcacgccttcccgccatatggcttgcctcccaaactatacaccacccaatgtggcgtacattcccaatgaggatgtcaataactccactcccatactcattaagagccaacaacctcaatctgatcatgcacatgtctctcgacccatggaggagacgcatgaaattccccaccacgatctagccaacttcgagccttgcctcggatatgccgctgaagggcaagcagttggtggaatgggaaagttggatcatctagaggaaaggctcagggccattgaaggaggtgaagattattcctttgctaacctagaagagttgttcccaatacccaatatcatcacccctctcaagttcaaggtgctggactttgacaagttcaaggggattacttgccccaagaaccatctaaagat

SEQ ID NO: 48619 - DNA, 1383 bp, Glycine max
  Peptide Sequence Number=SeqID_140304
atgagtttcgtgccaaaggagacaatcgaagtcattgcacagagcatcggcatcaccaatttgtcctccgatgttgccctctctctcgctcccgatctcgaatatcgcattcgcgaaatcatgcaggagtcggtaaaatgcatgcgccattcaaagagaacttttcttactacagaggatgtggatactgcacttgcattgagaaatttggagccaatatatgggttcacatctaatgatcctccacgattcaaaagagctgctggacacaaggatttgttctacattgacgacaaagatgtggatatcaaagatattgttgaagctcctttaccaaaagcaccccttgatacatcaattactagtcactggttggctattgaaggtgtgcaacctgcaattcctgaaaatgctccagttgaagctccgtctgagataagaaaatctgaatttaaggaagacgggcttcctgttgatgttaaattacctgttaaacatttaataacaagggagcttcagctttactacgagaaaataactgacctaactttaaagaagcctggatccattccttttagaagagcattggttagcttgtcagcagactcgggactccatcccttagttccttatttcacattttttgttgctgatgaggtggcacggaatttaaataatttagctgttttatttgccttgatgcgccttgtgcggagccttctgcaaaattctcagatacacatagaactttatttacatcaattgatgccgcctatcattacttgcattgttgcaaaaaggataggaaacagactctctgatgagcactgggagcttaggaacttcagtgctaatcttgttacttcaatatgccaaagcccttatgatttttttggatgggcagtttggtgcacatttctgcaattgtatggtaccaaaaagagcaatgagaaggtcaagccacgtgtgatgaagacatttcttcattctttcttggaccctacaaaagctttgcctcaacactatggtgcaattaaagggatagaagctcttggatcaagactgattcgcttgcttatacttccaaatctcgagccatatttgcatcttcttgagccagaaatgcaacctgagaagcaagaaaacgaaatgaagaggcatgaagcttggcaagtttatggggctttgttgggtgcagcaggacaatgcgtgcatgaaaaggtcaaaacgtttggcaatttgttctctcctccaactcaggttacttcaagaggcagtggaaaatctgtgattgcgatgccaggtgtggctttatttttctacatctgcaattatagtgatgtttttgaaaagcaatatttgcctgctgaatggggtaattga

SEQ ID NO: 48620 - DNA, 225 bp, Glycine max
  Peptide Sequence Number=SeqID_140305
atggcagaaactgcagtgtccttggctggtcagcatgcgcttccaaaaatattggaagctatcaaaatgctgaacaagatgatggaaggcgtcatagaaataaaaagaaagggtgatgcggctgagagaagcagcttttgcatggaagatgtcatcgatgaatataacatctcctgtgaggataaacaacctggtgatcctcgatgtgcagcttttactatgtga

SEQ ID NO: 48621 - DNA, 549 bp, Glycine max
  Peptide Sequence Number=SeqID_140306
atgccaaggttaatgtacctccgtttcttttacaatgcttatgaaggtgaaacattgcattttcaatgtggagggtttcagaaactaaagcaactgcaactgggatctttggatcaattgaagggcatccttatcgacagaggagcactgtgttctgtggaaaaaattgttttagaagacctctcccaactcaaaacagttccctctggaattcaacacttggagaaacttaaaaatctctctatcagcaactcgtcaactgaatttgagcagcgcattgatcctgatggaggagaagaccactggatcatccaagatgtgccccatattgtgttaaatgttcctaattttgatgctttgaagtttgacccactttgtacaacgatgaattttagggaagcacggagggaagattcgttattaacaccaacacaatacgaagaagttgaaaatagtgttcctacaaagacagacaattttttacaacgggaaaactcaagattccctcaagttctttcttttacagcccgtgaaatggtggatgcatga

SEQ ID NO: 48622 - DNA, 2248 bp, Glycine max
  Peptide Sequence Number=SeqID_140307
gagcaatgatgcaacactgcagacactcagatttggggagcaagtaagatccattagaaatgagcctgttatcaatgtagtaaaggagactgatgctgatttgagtaataatatccgacacttgaaggaagaacttattagagcaaaggatgatgttcatagctcagctgggagtaaagatggatacttccaaggacataatatgcgggaaagcctgaatctgatgagagtcagcttaaaccactctcttctcctatctaacatagataatgatactgatgaacatgtaaatgtcaatgaggatgacataaggaaattacgccagcaaattgatgaattggataattcatctgaagggaatccaaaggacatatctgtcgatgaagattgtgtccagttttattctgatgaggaatattgtgatgcagacaccaatagttgtgatgaagttgaaaaggctgatgtatactgtggaaaaacattgagcaacccctcagtggcaactgaatcttcattcagagatagcatttcactcaattcatgcaatcattctgcaacacttgctggaccacagttgtctgagtctccaaaattcagcaaaactcaaaggagaagtgtggctatttcatcaagttatctgggaagttggaacaatgtagcagagagttcaactttcagtaacaaagtgttaagaaaatcatttaaacagggagatcatgtgcaatcctcattacagtctagcaaggccaagtccttggcagcaagccttcagaagggattacagattattgactatcatcagcagaactcagcattgaacaaatcttcaacttccttctcctttgagcacttaactttgacaccatgtctagacattgacaaggatgactcttatgaccaaacaatacaacagaaaccttccagtgatgaagtaactgctgctttcctttgtgcatcttgctgggcgaaaatatcaaatgaagattccagcaaggcccaggctggaaatcctgatggaatgacagataaaattccaaaacatttggagaatgtaatagcaaaaagcatcatgaaagagaaggagcttgagaatgtttgcaaggagcaagcagctagaattgagcaactaaatcagttggtggagaaattgaaaggagagaaagaactggactccgttactatgtacaactctatgaaagatgaagaaaagcttctaaggggaatttcctcaagtggtcatttaccatgcattatagaggaaaactgtgaagttaaagaagtccaggaagagttagcccaaagtgacgtctcttttgattcaaccgagaaggagtcacttcttaaggaaattcagaatctaaggagtaagctgcaattatgtagtgatgcaccagttaaaaagtctacagaaaaactaaggtcttctttggtgtcaagatccatacaactgcaaaaaagcggtgttttttcttatgataatggcaatgaagacctagagaatgaaagacagagatggacagaaatggaaagtgagtggatctgtcttactgatgaacttagagctgatctcgagtcctaccgccaacttacagagaggttggagatggaattgaaattagagaagaagtcctcagcggagatggatgatgcactaaagagagctgttatgggacatgctagaatggtagaacactatgctgatctacaagaaaaatacgatgacttggttactaagcatgatgctacaatggaagggatagcagaggtgaagaaggcagcagcaaaagcctcaaaaaaaggtcatgctcgcttcgccaaatctctttctgctgagctttctgcattgagagtggaaagagaaagggaatcaaaattattgaaaaaagagaaccagagcttgaagattcaacttcgagatactgctgaagctgttcaggctgctggagaactacttgttagactaagagaagctgaacacgcagcagctgctgcagaggagaactttgcaaatttgcaacaagataatgaaaatttgaagatgcaaattgcaaagatgaaaagaaaacacaagactgagattaataccatgaagcagtacattacagagagcaaattacctgagtctgcactacaaccactgtatagagaggaggattctgatgtggcacacaatgcaacttcctcctatacatatgacgatcaggcatggagagcagaatttggagcaatatatcaggagcattactaa

SEQ ID NO: 48623 - DNA, 396 bp, Glycine max
  Peptide Sequence Number=SeqID_140308
atggccaagagtgatagaaagaatggccaagagggaaacaaattacaaactagtagtatggcacttaaatgcaaaaacaaaatccccagcaacggcgccaaaaacttgttagctctttggcaagtgtaccaaatcgctcgtagtaataatctctcggcctgccagacactagctaggggtttagccactcatagtcatgagggctttacaatgaggaggggggtgaaagaaaggctgaccctcttatttataggtgcaaacttgggcttgcgccttcgtaagctcgttgggcgtgaagcctcgcgctcagcgcgtgtcgtgcgcttagcgccttgccttcatgcgcgctgggcacgtcctgcacttagctccttgctgaacttgagcttcttctga

SEQ ID NO: 48624 - DNA, 474 bp, Glycine max
  Peptide Sequence Number=SeqID_140309
atgattcatgtcattgtgccgacaccaaacacacttcttacagctcaagaccaaccaaatttgacctttgtaagggagtcaattcccactacccttattagagatgcttcaccttttacgccagatgattctcttacacctgagtacccacctgattcaaattgtgaatatattgttgatcagaggcctttcattcgtgcatataaaggagaagcaaagttcgatgaaccaactccaagttggttgaaggtatcagttgacctttgcgataggtggtttagagagtttaagccaaaggagtttcaaagaccaacaactgcttgggaggtgatggagaaaactaagaaattgaagtcaggagaatggattaatgataagtcttgcgaattggcgtctatcatgccagctcctagtccatcgactaccatagcggatggaactgagcgccatgttgatgatactcaggacatgtga

SEQ ID NO: 48625 - DNA, 45 bp, Glycine max
  Peptide Sequence Number=SeqID_140310
atggaggcaaagagggaagagcaaaagggtcatttcatggggaag

SEQ ID NO: 48626 - DNA, 600 bp, Glycine max
  Peptide Sequence Number=SeqID_140311
atggagttcaaagataaaagaatgaaggctacgtttgagattctgaataatatcaggattctaaaactgcaagcgtgggagatgaagttcttgtcaaagattattcagcttaggaagactgaggagatatggctaaagaaatttctagctggtacagcaattattaagattgcatcatttcttcgtctagaagagttgcagactgatgtagtagaaaagcttccatggggtagttctgataaggcaattgaattagtagatggatatttctcttgggacttatcttccattaatacaacagtgaaaaacataaatctcgcaatttttcatggtatgagggttgctgtatgtgctactgttgggtcagacaagtctagtttactttcttgtataataggggaagtaccaaagatatcgggaacgctgaagatatgtggaaccaaggcttatgtttctcaatcaccatggacacagggtggcaagatagaagacaacatattatttggtaaagagatggacagggaaaagcataagttttcagattgcaagcaactattggatgactgtggcaacacctgtttcatcaactgcagaacctga

SEQ ID NO: 48627 - DNA, 1689 bp, Glycine max
  Peptide Sequence Number=SeqID_140312
atggatatttcggagtacacgaggattgtttttgataaacttcaaagatttgagcctgagcatactacaaagatcatagggtatctccttctccaagaccatggtgagcaagagatggtgaagttggcttcactgccagaccatttaattcgtggcgtggcttacaaggcgagaactgagcttcaaaggctggctgctagatcagccattcagccaatttcacttcccatcaactctcaacaatgtttaaaccatttgtcagtaatctcccctacttcggtaatcacccctggcactcctacttcaccagcaagcttccaggttcaatctccctattgggatcctcaatctgctagcaatactaatgcagaattcatggcactgggttatttggattctatctcagaatttcaaaagcagacccctttgttcagtttagataatcatatggatactatgaattccgggactgctgggattgctaatgattactatggcttagatgcttcatcagttagtaatttgggtggcaaaaatggtagaaggtttgaatttccagtcaagacctgtcactatttcaacaaaggtttttgtaagcatggaaatagttgtagatattatcatgaacatggcgtccctgatatgttctctcacatgtatggaaatgatacttttaatgatgatccggtgatttcacctgggtcactagcacaattagagtcagaaattgttgaactcctgaaactaaaaaaaggcggttcaatatcaattgcttcccttccaatggcatactatgagaggtacaaaaaagtgctgcaagcagaaggctacctgactgagagccagagacatggtaagtctggctacagtttgacaaaacttcttgcacggttgaaaaatagtattcggctaattgacaggcctcatgggcagcattcagttgttctggcagaagatgctccaaagttcaacggaaaggtagattatggtaaatacatcagtgcatcacgacaaatatacctgacatttccggctgacagcacttttagcgagggtgatgtttcatactactttagcacttttgggaaagttgaagatgtaaggattccgagccaagagagaaggatgtttggatttgtgacattaaatgatcctgaaactgttaaagtaattttggataagggaaatccccattatgtttgtgaatctcgggttcttgtgaaaccttataaggagaagccaaaatttatgcccaggaagcactcagatagaatcgagcactctgcttattattcaccacactatgtagacattgacactgaacccacctcaagtgagcatgatattcttggaacctggatttttcttctcccagtcatgaaccctcgatttcttaggaggctgctcattgaaaagcaagaggaggcagcctttgaatttcagagacgacgatttgcagagctgcaaatggcccaaaaatcattgtccacatcaccccatttaggcttcaacacagacgggtttaaagtttcagatgaacatttcaatgtccagtctgcagaatctcacagtcatgcactgaatgacaaagcaggatatacagataacaattgcactgatgaggacagcaatcaaggactgaatctcccagacagcccatttgcatttccagtagatagtggattttga

SEQ ID NO: 48628 - DNA, 243 bp, Glycine max
  Peptide Sequence Number=SeqID_140313
atggttcggaaagcattagagtgttgcgttgatagcttgttgacggggatggtggcgtgctattgcaatctattctatgccaacaagcctgaactcgtcgcacatagaatcaaggccattggaaccacgagaacaaccggaggaggagctctagagagcaccagagacgtcacaattgctaacgaagaacatttaagcgactacatcgaggtaaaggatgagttactcacgcttggggattag

SEQ ID NO: 48629 - DNA, 396 bp, Glycine max
  misc_feature (5)..(5): n is a, c, g, or t
  Peptide Sequence Number=SeqID_140314
atgancacttcttccggaaagtcccggaagaggttttccgggagtcttccggaagaagtgtcttccggaagacgtttggttacttccgaaagaacccttcttccggaaactttccggaaatgttcttccggaacttccggaagaacccctaacgggtcttccggaagtctccgtcgttccactgctacaagctataacaatgttgtatcatacaagcaaaggggagttagggagactaacctcgttcgcggagaagaagaagacgaggttcgcgcttgccttgccggagaagaagaagcagttcgcggagaagggagaacaagcttcgcggaaggaatgagcagcagcagaaaagtttcttccggagagggggggctttttataattttttattaa

SEQ ID NO: 48630 - DNA, 105 bp, Glycine max
  Peptide Sequence Number=SeqID_140315
atgaaaaacctcgtcgggtgcccaggagtacatgacaagacagaccacacactaggagaccagtcaggatcacgctccgaccatgtgggatcaacacagacttaa

SEQ ID NO: 48631 - DNA, 4419 bp, Glycine max
  Peptide Sequence Number=SeqID_140316
atggcttccataagaaaatcagtcctcttgttcctcacattcctcacagtgatcattatccctgccactccacaaccatgcaactcatacaagttccccaacaactttaactacgctgcatgcgaggacttgccggtacttgaatcctcactgcactggaagtaccacccatcttcaggtgcagtagatgttgcattcaacaaggccaacgtaaaaggttctagttgggttgcatgggccatcaaccctacctcaaagggcatgcttggttcacaagcattcgtggctgtttataaacaagatggtagtatcaaagcctatacatcaccaataacaagttatgcaacaatgttacaagagggtaatcttacttttccggtttatggtgtttctgcatcctacacaaacgggcacgtgatcatcttcgcgagttttcaacttcccgggaatacgactttggtgaatcacgcttggcaagaaggcttggtttccgatgatggcactctcagaccacactctttctcacgcgctaatcttcagtcttttggaaccttggatttcttatctggcaaggtttctgaaactggtgggaattcggactcaagaatcacgttgagaaacgttcatggagttttgaataccataagctggggagtactaatgccaattggggtaatattggctcgctacttgaaggcatttgatggtttaggacccacttggtttcagctgcatcgagcatgtcaatcactagcattcttgatgggcattgctggttttggtactggtttgtatattggaaatcattatgggattcataacgctcctcacagatgcgttggaatcactctattgtgtctcgcaattacacaagtctgtcttgctgtgtttttgaggcctaagaaggatcacaagtacagaatgttttggaacatttttcattatatagttggttattcaattattgccttggccgtatggaacgtcttcaagggttttgacattctcaacgctcagaatatctggaaaaaaacctatgtgggctcaatcatatccttggctataattgctgtggtattggaggtgataacttggatctgggtgtgcaaaaagaagagggtcaaggagcctgagaatcatgttgaaattgttattgacttcgtagcctatggaaagcatgttttcttgccagttatgtatgttatttctgatataggttcctctataactggtttatttctatgttatgtgggatgttgtcttaacaatatgcgtaagcttgcgcctctcgaagaggcccttttgaatgggcactctagtgtatgcaacaattctgattcccgtgagactagagtaaataaaaatttaacccgttattcaaatgctggatttttcagcattctcactttctcatggatcagtccattgataactctgggcaatgagaagactttagaccatgaggacctcccacttcttgctactgatgacagtgcctatggggtttttccaacttttagaaataaacttgagtcagagtgtggtagtcttaggaatgtcaccactcttaagctggcgaaggtgttattcttgtccacatggcaaggaatccttttatcaggtttatttgcattcctatacacatgtgcttcttatgttggaccctttcttattgacatttttgttcaatacctcaatggggaccacaagtttaaaaatgaaggctatgttttggctatggcatttgttgctgcaaagcttgtggagtgtctttcacagaggcactggatgtttaggttccagcaggttggggttaggatgcaatcaaagttggttgcaatgatctatgctaaaggtttgactctttcatgtcagtcaaaagaggttcacagcactggggaaatcatcaacttaatgtctgttgatgcagaaaggattggtgaattttgttggtacatgcatgatccatggatgtgtgttttgcaagttgctttggccttgttaattctgtatagaagtgtaggggttggttcgatagctgctcttgctgccactgtaattgtgatgttgctaaaccttcctgtggcatcattgcaagaaaaattccaaggcaagataatggggttcaaagataaaagaatgaaggcaacgtctgagattctgaacagtatgagaattctaaaactgcaagcatgggagatgaagttcctatcaaagattattcagcttaggaagactgaggagacatggctaaagaaatttctagttggtacagcaattgttagatttctcttctataacgccccaaccttcattgctgtggttacatttggtgcatgtgctcttatcggaatcccacttgaatcaggaaagatcttatcagcacttgcaacattcagaattcttcaaatgcccatatacagtcttcctgacaccatttcaatgattgcacaaactaaggtttcccttgaaaggattgtatcatttcttcgtctagatgagtggaagactgatgtagtagagaagcttccacgggatagttctgataaggcaattgaattagtagatggaaatttctcttgggatttatcttcccctaatccaacattgaaaaacgtaaatctcacagtttttcatggtatgagggttgctgtatgtggtaatgttggatcaggcaagtccagtttactttcttgtatagtaggggaagtaccaaagatatctgggaccctgaagatatgtggtacaaaggcttatgtttctcaatcaccatggatacagagtggcaagatagaagacaacatattatttggtaaagagatggatagggaaaagtatgataaggtgctagaagcatgttccttgacaaaagaccttgagtttctaccatttggtgatcagaccactatcggagagaacggaatcaatttgagtggtggacagaagcaaagagtgcaaatagcccgtgctctataccaagattctgatgtatatctgtttgatgatcccttcagtgcattggatgctcatacaggatcccatctctttaaggagtgcttgcttggccttttaaaatcaaaaactgtgatttatataactcatcaagtagagttcttatccgatgctgatctaatattggtcatgagagaaggaagaataactcaatcaggaaaatacaatgacattctcaggtcaggcactgattttatggaacttgtaggtgcacacaaagcagctttgtcttcaatcaagtccttggagagaaggccaacatttaaaacatcaactaccaccaaggaggacacaagttcagtaagttattttgaacttgacaaaaatgtggtatatgatcaaaatgatatgtcagatgacatagttgaacccaaaggacaactagttcaagaagaagaacgggaaaagggtagagtagggtttaatgtctactggaaatacatcacaacagcttatggaggagctcttgtacccttcatattactttcaacgatacttactgtggcttttcagattgctagcaattattggatgattttggctactcctatgtctgcaactgcagaacctgatattggaagctttaaacttatggttttctatgttgctttggcaattggaagttccattttcacctttgccagagcatttcttgctgtgatagctggatacaagacagccactgttcgatatgctcctcacttgcctcttgttttacgaggtcttacttgcacttttactgctggagcaaaaactggtattgtgggaagaacaggaagtggaaaatcaaccctagtgcaaacacttttccgacttattgaacctgttgctggacaaatattgatagatagaattaacatttctttgattgaaattcatgatttgcggtccagactaagcatcattcctcaagatccaacaatgtttgaagggactgtaagaaccaacctggacccactggaagagtacacagatgaacaaatttgggaggctctagatatgtgccaacttggagatgaagtaagaaaaaaagaagggaagcttgactccatagttactgagaatggagaaaactggagtatgggtcaaaggcaattgttctgccttggccgtgttctacttaagaaaagcaagatcttggtgcttgatgaagctactgcatcagttgatacggccacagataatactattcagcaaacagttaagcaaaaattttcagaatgcacagttattaccattgctcataggataacttcaatccttgacagtgacatggttctgtttttaaatcaaggtttgattgaggaatacgattcaccaaagaaactgcttaagaacaagtcttcatctctagctcaactagttgcagaatacacaaggcggtcaaactctggttttggaaattaa

SEQ ID NO: 48632 - DNA, 1020 bp, Glycine max
  Peptide Sequence Number=SeqID_140317
atgcataagtatcctaaacttttcaacactcataatatagagggattcagtcctctcaaaattcttgccagtaggccctcggccttcaaaagtggaatcaatctcaagtggtgggaggcactcttgtaccattgtgtatctgcagaatctctagacgttgaaaaaacaaaggaatcgtacatgaaagatgaacctgcagaacacaacaaacattttggaataagattcgcatcaaggaaaacaaaaaagaagaaacagttaccagagaactacgacacatgtcgtcggctctattgtgcatttcgactttttgttctcgtgcccatatttctcatcgatagtataggatttgcattattaagaaaaaagagaaaacaagaagatccagaggaacatcaaatgcgagaagattcaagtagtgatcatgaggttgttccacaaaattatgtaacttgtcttcagtttttgaagcttgcatacataaatattattggcattacaggaccaggggttggagacattgggaagatgaagcaaaagcacatatggagtgctcaactcttgagggcatttatggaaaaaccctatctgtcatatacgggaggtccaccaccattgaacgagggtgttcaaacagattacagaaaagtaagtgttgacagcaaggagacagtgattttggttgcggcaagaaatggcatagttgaaatggtgaatgagattatatctaaaataccaagtgccatacatgaaactaactcagaaaagaaaaacgtgttgcttgtagcagtggagaacaggcaaacccttattgttgaggcattaaaaaattggtttgaacaggagaaaaaagagttaatcttttacaacctaaaattaggtgtggatgaccaagagaacaccgtgttacacttggcagcaacactacctaataagggttggatgatatctggccttgccttgcaaatgatgtggcatatcaaatggtttcaggtatacgtttatgatatccgtatgtaa

SEQ ID NO: 48633 - DNA, 659 bp, Glycine max
  Peptide Sequence Number=SeqID_140318
atggctgaaactgcagtgtccttggctggtcagcatgcgcttccaaaaatattggaagctgtcaaaatgctgagagatctcccaaaggaagttagagacattacagatgaacttgaaagctttcaagatttcatcaatgatgctgataaagtggctgaagctgaacaagatgatggaaggcgtcatagaataaaagaaagggtgatgcggctgagagaagtagctttttgcatggaagatgtcattgatgactataacatctcctgtgaggataagcaacctgatgatcctcgatgtgcagctttactatgtgaggctgttgccttcatcaaaactcaaatccttctccttcaaagtgcatataagattcaggatgtaaaatcccttgttcgtgctgaaagagatgctttccaaagccattttccattagagcaaagaccaaccagttctagaggaaatcaagatgtcacctggcagaaacttagaagggatcctctctttattgaggaagatgaggttgtggggcttgatggcgctagaggattgctgaggcatatgttgaatgagctttgcaaagaaaaaaaggaggaccctcccaaggatgtttctaccatcgagtcgttgacagaagaagtcagaaaccggttgcacaacaagag

SEQ ID NO: 48634 - DNA, 1080 bp, Glycine max
  Peptide Sequence Number=SeqID_140319
tggatagctgaagggtttgtcaaacatgaaaccgaaaaaacattggaagaagttgggcaacaatatttatcagggttggtccgtagaagtttggtgcaagtatcctcatttagaattgatggcaaagttaaaaggtgtcgtgttcatgacttaatacacgacatgatacttggaaaagtcaaggatacaggattttgtcagtatattgaggagcgtgagcaatctgtatcaagtaagattgttcgacgcctgacaatcgcaatcgatgattttagtggaagtataggtagctcacccattcggtcaattcttatttgcaccggagaaaatgaagaagtatctgaacacttagtaaacaaaatccctacaaattgcatgctattgaagcttccggtatacacggagagtaagtctaccaaaatccattggcaacctccagaatttagagaccttggatataagagacaagatattggaggcatgacatccctacaagagatacctcgagtgtttatagatgatgatggagtggtcattagagaggtcgcaaagctaaagcagttaagggaactgacggtggaagattttatgggaaaacacgaaaagactttgtgttccttaataaatgagaagccactcttggagaaactacttattgaaacagctgatgtgagtgaagtaattgacttgtacattacgtcacctatgtctacacttaggaagcttgtcctatttgggaagttaacaaggttgccaaattggatttcacagttcccaaatcttgtgcaactgcatctgtacaactccaggttgactaatgatgtattgaaatcactaaacaagatgccaaggttgttgttcctcgatttaagtagcaatgcttatgaagtaccctctggaattcaacacttggagaagcttaaagatctctatatcgaggacatgccaactgaatttgagcagcgcattgctcctgatggaggagaagaccactggatcatccaagatgtgccccatgtacgtatttggagtgaggatgctgaagaacctttgcatatattcggcagaagtcatcactaa

SEQ ID NO: 48635 - DNA, 810 bp, Glycine max
  Peptide Sequence Number=SeqID_140320
atggaaacgatagaagagcaacaatatggtgaccaactcacgaaagaagagtcccaaagagcagtggaattagaaactgatgcagaagatgtagaaattataggaattagaaaaatagatattgaagaagaaaaggaaatagggccaatgagttcagaggacaagtttcgcgggttaacagtggaaggaaaatgggaagaggttatcaaaatgtgtgaagaagacatcaagttatgcacgataaagatcaacaacaaaagaggcactgcactccatgtggcagtgaatgaaggcaatgaagatgctgttaagtgtcttgtgggaacaatgataaagcacaaaaggggggagaaggccttaacattgaagaatgagagaggggacacacctttgcaccttgcagctacaaggggactcaagaatatatgtgaatgcatcataggaaaaaataaagaaagaaagggtttgattacctttcttaatgatgagggagagacacctttttttcaggttgcactctcatggcaaaaagaagctttttggtacctttgttccctcgtgcctgctgatgaaaacgttaactattctaaatttcttattcggaataatggggatagtatccttcactgtgccattcggagagaattttttgatttggcacttataataatgtataaataccccaaactttacgacattcagaatagagagggattcagtcctctcaaacttcttgccactaggccctcagccttcaaaagtggaagcaatctgctatggtggaagagaatcctttatcattgtaagtag

SEQ ID NO: 48636 - DNA, 669 bp, Glycine max
  Peptide Sequence Number=SeqID_140321
atgattgaggtatacaattggtcaagtgcagagtttaccaaagagtgcgctttcatatacacttccatcactgatactgataagcgtagcatttttcgcttgagcctgaatccagagaagaggatgctattgagattcgcacactctttttgcgatgctcatccagtgcgatcacttcacatggaggccactgctgaaagagatagcaacggatgtttcaactttggggtagtgagagtagttgcggatggctttacttctgaacagacacttcgcgacaccgaacatttcgcccacctctgtggaacgaaatcttgtttttatggtgtggtgcgaaaaggtggaaacgtcaacgttggttctgaggagaaaatgaccacttgggaggttcttctctcgattaagggtcaggttttgagagagggtttgccgaaacaatctgaaggttcttcactgattcggcgcgaggttgatggaaagcccccaaaagcttgttgtgcatttgttgagagtgagtttacaggacaacaacaaggggaagggaaaggtacgagagtcaatattgttaatacaggtggacttttccatggtcatggtaatggcgctacatatgaaaactgcaatattttaatgaaaacatatttttgttctaattgttcctcgaagtag

SEQ ID NO: 48637 - DNA, 339 bp, Glycine max
  Peptide Sequence Number=SeqID_140322
atgtgcatgagtagacgagctacgaactcacgccggggactacgaggtacaaatgataaaatatccaaccaagctaaggggacacttggctcacccaaaccgagcacatcccccggtcatggtgaattggaagtgcctaagcatgatcaagaggagtattacttaactgataaccatgatgtgacaagcccacagacctcaggcccaacaagctttgggtcaaaccctcacttgagcgtcgaagtgccttttgcaagtatcctcccctccattctattggatactcatgcacctaagacctcggtaggaaaaaccaagcaaacgatccttcgatactaa

SEQ ID NO: 48638 - DNA, 558 bp, Glycine max
  Peptide Sequence Number=SeqID_140323
atgtactattaccattcatggttgagcagcatttatagccattataaagaaagtgtttatggaagaatagacaaaggcattgccgacactgccacgcatatatatgcgggtgaccctgccaatgatgactcatcggtgacctacgcattacccttgaagattgaacacacagctcagtctcagtgttttcaacttcaaacactctctctctctctcagattggggcttctaatcggacttgtgggcgtcgagaggagggtcgtggtggtggccggcgacgaagtcgaggagctcctcggcgggtttgggaagggaagcgtcggagttgagcgaagtttgcgtcttggcgaagaagagaacgagggcgagaaaaagcgcagtggagagaaacagtggccagaaataggcgaggatgttgaggaacctcggagcgaagtggagcacggagaagaccgagagggacacgaggagtgccactccgatgtggtacctgaacttcaacagttgttgttggatctccatgggaagaagaaggaaagaaagggaaatggtggatag

SEQ ID NO: 48639 - DNA, 732 bp, Glycine max
  Peptide Sequence Number=SeqID_140324
atgactgtcgagttagggcaacagacagtggagaatggtgttggccaaaataatggaacaaacattcgaaccaatgacagaaaacatgccaaggtttatccaagggaagctagaaatggcattttagacaacaagattgactacttggaaaacaagatgaagatggttgaaggagagttaagagaacctgctgctattgaggctggtttatattcagtagttgctgaccatatggccttgacaactggactaatggcctatgaagatatcacattgtcctacatttttatgatgactgatcatggtcatttttgcaatttgaggggtactgtgcttggaaatatgatgggagattcttgggacatactttcaccctccaatgtaaatgtgacaagccaagacttggcaaacagactaaatgctttcaatctagcttttgatgaaagagtgaatggaaaccatattccttatgctcacaatgtggttgcagtgaagtacctcaattgcggcagagacgaactcatttgcggtagttacaacttcaacggcaatggtagcttcagtagtgcagttttcggcagtcacaggagggtgagggtgggggagcatgagataaaacaaaaaggagaaggaggaaagggtgagtggtgggggagcatgagagaaaacataaaagggaaggaagagtggtgtgggggaagtgactcagaaggaaaatgggaaaaaggatag

SEQ ID NO: 48640 - DNA, 87 bp, Glycine max
  Peptide Sequence Number=SeqID_140325
atggagatagtggtcgcgaaagggagggaggagattttggagggttgtgttggagggaggagagggactttcaacatcgattattga

SEQ ID NO: 48641 - DNA, 353 bp, Glycine max
  Peptide Sequence Number=SeqID_140326
atgataggtggatgcattttgcggaccacgtactagctgtgggtgagctctgtctagtgcctgggcaggcaggtgaccagcctagagatgcacctgccgcagaccctgaggagtacatgcagccgcccagcccccaggttccagtggcatttgacccccctccacatgcagtggatgattacgacggctatgaggcgattgcactgaggttggagcgtgtgctcaaccttaggatggtcactgcaggcacaaagttatatgatattatgcaggattacctgacgatcgccagaaggggagccagtgctgatagaagtgtcagggctcgacagagacgacgcacagagcattga

SEQ ID NO: 48642 - DNA, 429 bp, Glycine max
  Peptide Sequence Number=SeqID_140327
atgctaggtgcactaagcaatattgctggtgcacccagcaatttattgaatgtaccattttgcccttcatttaaaaattttaaaaaactttctttccctctttcggaaccattcactccttcttcgctgctgcttctcttcttctccgtgagcctcgtgcgtcttcttctccgcgagcccgactgcttgttttcattggatcagacacaccatttgccttcgagaagatgccgaaaaaaatggggaaagggtggttacggtggcggcttccggaagatccgtgtaggattcttccggaacttccgaaagaaggtgttctggaagatttttagaagaagggttcttccggaagtactgaaaggtcatccggaagaacaggtcttccgaaacacctattctggaagaagggttcttccggatgacctttga

SEQ ID NO: 48643 - DNA, 66 bp, Glycine max
  Peptide Sequence Number=SeqID_140328
atggcgcgtgatggcgcgtggggaagctcctggcccagcggagagagacagtttgacaagctttga

SEQ ID NO: 48644 - DNA, 210 bp, Glycine max
  Peptide Sequence Number=SeqID_140329
atggaaaaagtagtcaatatatctaacaagagtgcttgcaacacactcttctcaacactcttacagctctctacatcatacacaatatttgcatgctacaccgctgctatgctaacaaaatgtgagggagaaaacaacaaagaagtggggaaaaatgatacaacagccagccaaaaggtggggaaaaaagatacaacagccacccaataa

SEQ ID NO: 48645 - DNA, 750 bp, Glycine max
  Peptide Sequence Number=SeqID_140330
atgtcttccaaacacaaacccaagtacatatattttgttgtgcctttgtatagcgtatttttctattctgatttgcaggacccacctatgtttttcgcatccggtatgacataccaatttaaggccgtatttcatgttgacaggaatatcattgaggtaccctctgtttatcataaacaatggactccagattacccggattatgtggtgttggactacaatggaaagaagcaccatataagagttagaaaatttagtaaccgagtctacattgttgatggtctcaaacacttcaggagggatatgggaatatatgaaggtgtgatgatcacatttgctgcgccggacaagaattggaagtttgatatccacttctcaccgccactgcatgcacagacatgtggcaggcctgtccattctgccagagaatatgtgtttactgtggatgtcgacaatcggatgattgttagactttatccattggtactgccactcgatgttgtgggttatgttaatgcaggagacggctatgttactgtccttggtgtttgtgggcattgtcacttttggaagttgagtatgcataatgggcttaaatgttttgctgacccatggttccaattcttaacagaaaacgatttgatggccggtgacgaagttgtcttttatttcaggccaaatcaacttctttgggaggttattgccagaaagcaaactgtgtgggacgaggacgaggacgactccccatga

SEQ ID NO: 48646 - DNA, 525 bp, Glycine max
  Peptide Sequence Number=SeqID_140331
atgcctcagatcatagccaaagcgacccaaagtgccacgccacccaaaatcatcggagccctgcatttggaacttgaacccgattcatcaccaaccgaaccccgtgaactttccggcgaactcgccggcgcagttcccggcgaggcactgctggatggtagtgtgattggtgaacctgccggcacggccgatgaaggaattccggcaggagaatctggcgtaggcgcctctgccaccggcggagtaccgaccggagaactcaccggagcaaccgtcggcggaggagtcgctggggatggagccggtggcgaagagacattgttggaagggctggaagctggaggaaccgaagatgtcgccggcggcggggtggacccagatggagaaactgccggagattgtgaaggcggtgataaagtcggagactttgcaggaggcgccggatgggtcgccggagagggtggtttggccgtcggcgacgagggtgatgacttgggtgaaggggcaggagcattgtctgcgtga

SEQ ID NO: 48647 - DNA, 426 bp, Glycine max
  Peptide Sequence Number=SeqID_140332
atgctccaaccatatgggatcagcataggcttaaagaagcactcaaacccggtgacccccaaggcctacactccgaagagtccgtcagggcctctccctcctgattcaggaaacctacactttctctttaacactgcgcatttacacttttctcaagataacattggtcggttttaccaagatagctctgggtttctgcggaaaagaaaaaggctacaatgcgaagggtatttctctcagttcagacatgatatcgaaattcccaacggtgagaatgctcggaattgggttgtgaacgtggtgctcaaatttcacaatgatccaacggtgaatgagtctgagatcgtcatttttctgggacaagtttggtgggctgcgggaaaaaaagaaagggttttgagaggagaagggaaaaaacgaaaatga

SEQ ID NO: 48648 - DNA, 462 bp, Glycine max
  Peptide Sequence Number=SeqID_140333
atgaagttggtagtggatccatggacatcgagatcccttgtaccgaaagtcttcctgaagggtgagtccatggatagagacaatgttactcaacccccaacatgtctgaattgctccaaatgtgaatacccttgtcaacaacaaccctcaacaccacttccatatcttgctccaccaccactacaaccatcatctcctccaccttatggttactctatatatggagcaccaccaccaccaaaagagaaagacaaagaccctagcaagtgccctcctgctgcaggtgttcagtgctgcacccctccagctccttatgcaaagggtattggatgtgtcctagctaacgaccaaaatggcctctgcaagatccttacacaacgacaagtgtttgagggcaaaacatttttctttgtgtatgtgaatccgatgagtaagggagtagtttctgcatatgggagaagg

SEQ ID NO: 48649 - DNA, 708 bp, Glycine max
  Peptide Sequence Number=SeqID_140334
atgatgtttatgttgagaaagacattgaaatggaatgttgatgatgttggaaatgcattgacagcattttttaggagatgcttaggcgctttaattgatccatggtcattggcacttgcttgtggccacgttcatacgtcttatgttgtgtatgtccatggggggtgcattgaccttgtcggacgtcccttgtgtgggaaactaaagtggttaaagaatctaagcatttctgagggaatgcttaggacctttaattcattcatggtcattgtacttgatggtgcccatggaactccttctggcctcgggcgtcgtgtagacacacttagggctatttctttggtattggatacggtacgtaccgcattgcatctgagagttgaggtcaggaaaaacccaaaagtcaactatgatgggcaacaattatcttacaagtcaaagtatggtattgaggacaaaacagagcttcttcaactggatgcttaccccactgtgatggaagatttgcagacctttgctgcttgttcaggtgcatttgaggatccagacattattcatgttgatgatattgttgacccagttagggatttagaggtcattactgaagaattgcggttgaagtcggtcatttacataacagatgtagaaatgagagtttaccaaggcggttttggtctgaaaaccgccttggataacgtcaatttctaa

SEQ ID NO: 48650 - DNA, 882 bp, Glycine max
  Peptide Sequence Number=SeqID_140335
atgataaaaaagagtaagcatctagtggtgtttactggtgcaggaatatcaacttcttgtggtatacctgattttcgaggtcccaagggaatttggacacttcagcgtgaaggtaaagccctgcctgaagcatcactgccatttcatcgtgcagcgccaagcatgacacacatggctctggttgaattagaaaaggctggcattttgaagttcgtcatcagtcagaatgttgatggtctccatcttcgatctggaataccaagggagaaacttgctgaattgcacgggaattccttcatggagacatgcccttcttgtggagaagagtactttcgtgattttgaggtagaaactattggtttaaaggagacttcaaggcgttgttcagttgccaaatgtgggactagacttaaggatacagtccttgactgggaggatgcattgcctacaaaggagatgaatcctgctgagaagcattgcaaacaggcagatatagtgttatgcctgggtacaagaacaagtctatttctaaacagacctgataatcattggcttaagttttgtggcaaaagttttactgctctagtaattcctaagtgtactgatatactgacttcttgcagtgaatcacagcaattgtggcatgtgtggttaagcccaatggacaatagtttacaaataactccagcatgcaacttgcctctgaaagcacttcgtggtgggggtaaagttgttattgtaaatctccagttcattctctcttgcggccaaaaatgggtcattggatcccaaggatcagctgcttacatcagttggcacatggcctcatggtttggagagtttacactaggaagaataaagggaggaatggcagaattctga

SEQ ID NO: 48651 - DNA, 360 bp, Glycine max
  Peptide Sequence Number=SeqID_140336
atggttactggagtggttggagggatcccaacggaaggggcaaacgccgaattgaacgacggcgaacttggtggcggagtctcggaccttcagtccgacgtccggacatggcgccggagctccgccagcgacggttcgaagttcgcggtggtaacggtcttcgaaggaaacgccactccacattgcgtggcggtggtggcggatcctagggcacgtgcgaacgcacgtgagagtgccggagaaggaagtttatgtggtttcattggttgtgcacttgtgctgcagtttttggtcggaggtttagaagagggacagcgaaaaatagtaggggaaggcggagacgtaaacggcgtcgtttaa

SEQ ID NO: 48652 - DNA, 1188 bp, Glycine max
  Peptide Sequence Number=SeqID_140337
atggggggtggaaatcaagaggcagtcaagcagctgcagaccctgatggaaaatgtggatgatgagcagctgaagaatacattccagattatgcaccagggttatcaaacggaaacgttaatacggtttctcaaagctagggactggagtgttgccaaagcccataaaatgtttaaagtgttacagttaattgattgtttgaactggagggtggaaaatgagattgacaatgttttaaggaagcctatccctacggatttgtacaaagccatacgggattctcaacttataggaatgtctggttactcaaaggaggatctacctgtcattgctgttggtgttgggctcagtacatatgataaagcatctccaacagctacaaggaaacatggacgatacattggcacctgtgttaaagtgttggatatgtctggtttaaaattttctgcattgaatcaattgaggttgttgactgctatatctacaatagatgacttgaactatccggaaaagacagacacatactatattgttaatgcaccatatgtattctcagcgtgttggaaggttgtgaagcctcttttgcaagaaagaaccaggagaaaaatccaggtgctgcaaggttgtgggaaggaggaattactaagggtcatggactatgcatcccttccacacttctgcagaaaagaagattccaagtcatccaaacatcatgcttcaggaaactctgaaaattgtttctccttcaatcatgccttccatcaacaactctacaatcacatcaagcaacaagccatcattatggagtcaatttcaccaatcagacaagggtccttctgtgtagacataccagagccagaccctgatgatgccaaaatagccaagaccatagaaaatgagttccacaaattggagaatcagaagaatggttttaccaactcactaactggtcttttacagttaatggccattgaaagctatgctactaaagctagtaactgtttttggcctctcctgagccacttttatttgttgattactttatggtcccttttggaaaaggagggttatacttgtaggtcatacttatacccggttattagatctaatattgtaatgtttgcatcaactagatgcaaaattcttcaggcagaccttaatctaatttctacaaccaccttgagatga

SEQ ID NO: 48653 - DNA, 793 bp, Glycine max
  Peptide Sequence Number=SeqID_140338
gagaacattcaaaatacgatgcaaggactattttgataagctaagactagttcaagcacttggtattgcacttttgttagggctcctttggtggaaatcttcaaccaacactgaagctcaactcagagatcaggttggtttggctttctacatctgtatattctggacatcttcaagtatttttggagcagtctatgtctttccatttgagaagtactacttgataaaagaaaggaaagctgacatgtatagactaagtgtatactatgcatgtagcactatatgtgacatggtggcacatgttttgtatcctacatttttcatggtcatcttgtacttcatggctggctttaagaggactgttgcttgcttcttcctgacactattcagtattctgttaattgccataacaagtcaaggggcaggagaactatttggagctgcaattatgagtgttcaaagagcagggacagctgcttctttaatactaatgttattccttctcacaggtggctactatgtccagcacataccaaagttcatgaagtggttgaagtatttgtccttcatgtactatggcttcaggcttcttctaaaagtgcagtattcaggtgaccaattatatgattgtgaaagcaagggagggtgcaggaccctgcagagttcacctacatttggcattgtaaacttgaaaggtggattaaaagaagtgtggattctgctagctatggccttagtctttcgattgttagcttacttgtgccttcgtagaagaattgatcattccaactaa

SEQ ID NO: 48654 - DNA, 2418 bp, Glycine max
  Peptide Sequence Number=SeqID_140339
atggggaagagaaaagagcgtcgccgcctcgccgctctcggcaacgccggtcgcagagtcaaactcgatcttttcgcggaaccctctggagagttgggtggctccactctacatggtgatgctggaggagatactgattctcaacatcgtgatgggtcacccaattcaccctcttcttcaggtcaacaaccacagaatcccctgctgttacttgggcaatatagtgatgatgaaggggatgccggatcaagcaaagggcttaatgatgcaaatgtgcaaagtcccatgcttaatgaagagactaagggtgtacatgatgaagaatccaaagatttggacatcagtgtcccagtagatcttgttgctcagagtaatggactgcaaaatacaatacaaaattctgcttcacttgatgttgcgtacagtgaaagaaatgaaagcgatggtgctgctggtagtttgcaaaatgaaatgatttccaaagatcaaatatatgtttctgaaagttatgatgaacaagttgtcactgatgttggtttggggtggaagatggtgatgcacgaggaaagtcaacggtgttattactggaacattgaaactggggaaacttcatgggaagtgccccaggtcttggctcatgcggatcagttggctaatgactcaatacctcatgcttttgtcaatgataaaacaaagagtgctgctgttggtgataattccaatgtgctctccgcggtgatgcaggacacttcttctgctttcataattgactgttcgctggaagccacagtggcttctcataaagaattgtatggtcacgggtcccaaattaatggtggtagtgttgaatgtacaaatcagaatcaaggttctgatgttaatggaaatgaattgacaagaaatgatggtcatatgagtttatctgataagggacaccattcatctgtttccaagtttggtgttgaagaacagcaattggacattgtttttccttctcgtcttgtcgaacaaagtgagagtttgttagagaggctgaaatcattgaaaaatgtgaaaagcttatatcttccagttccagatttaactaacagaatactacacaggtcaaaggacaatctgcaaggccaagacttcttgtcaaagtacatgctagagattgagattaggctctctgatattaggtctcttgcatcatatggatcatctttgcttccattctgggagcattctgacagaaagataaaattgcttgaaagtttgatcactgatgatttgatgcaaactggtaattcttcacatgatgaagttgaggatgttgaggataaacttgtccctgtctctgaagaattggctgaccaactgaatggcatgggacatgagtccgaggtagataataataagaacaaagggagccttcttacttgtgatgtttctaatgaatctcaggttgatgcttcggctgcagttctagaagatatcaacaataatatttctgccaatggtcagcatgttccattgtctagttctcctggtagtcatatggaaacagatgtagaaattaattcaaaggttgaagcaattataaatcctcaggaaccaattcataaacatgggtataatgttggggaagatgttgatatggatgtggacatggaagtcgaagatatgaattcctcaggcaatactactgtcatcgatgtacctgttgcaaacgattccgtgcacacagatcaactggttcagttgaatccacctgttgactaccattctgtgttgcctgaggagggtgaatttgttcctcctcctccagatgatgaatggattcctcctccaccccctgataatgagcatgtgcctccaccaccaccgccagacaatgatcaggtgccccctccacctggtgacccactagcaccttcttatagtgttctcccatgttacgcagagacagggcagcccctttcttatgctcaatatagtctatatcctggtgttgctgctgaatattatgggcagacagctgctgaagtcccaagcagtaatatatatggacaaattgctatgccacctgcacagatctactataatactgcagttcctaacatttatagtgaaaatcctcaatttatgatcaatccaactggcactgttgcttattatgaggttcaagatggagctggttcaaagtccatacctgctatcaatattaatgattctggtgttggtgaggctgactgggcatcttgtgattctccgtccacctcatctagcatccatgcacctgcaactgtttcagttgacgaaggtgtctcattgcctcctgctactgccaaatctgctgcagaaaacaacacatcatcattagttcctaaagcccaaacaaaaggtacagatactgaacaagtctactgttactga

SEQ ID NO: 48655 - DNA, 312 bp, Glycine max
  Peptide Sequence Number=SeqID_140340
atggcaggtggagattgcttacacgctgaaagtgccggaaacggtgtcgttggcagacctaacggcggattcgatatcgaaggggaaagcggaggagtcctcagaggattgggcggatgcgtaggagttccaatcggcgagcaacgacgacgccggcttcgcctcctcctcgctgctctgccccgagaaccaaccctgcatttttctcgccgattcccacaaatgcaattgcgatctttgcttgaagaaagtcacaaaccttcgagaaggggaaatggaacgagggtttgtgattcgctctccctggattag

SEQ ID NO: 48656 - DNA, 3075 bp, Glycine max
  Peptide Sequence Number=SeqID_140341
atgccacaagagagctcccaaaactcatttttcacatctccttcaaagagaggattgaagggtttggtctccatcaacaaggagccttcatgcactgctgccacagatgagagtttcaatgataatgaattggctcagaggaaggcagaggaagcagcttcgagaagatacaaagcaactgaatggctacgccaaatggaccactttgcgtcttcatcactctctccaactccctccgaagaagagttttgcctttcactccgcaatggcctcattctatgcaatgtcctcaacaaagtcaaccccggtgctgtccttaaggtggtggacaatcctgggcttgctgtccagtctgcagagggggcggcccattctgcaattcagtattttgagaacatgaggaactttttggaggctgttaaggatatgcagcttctcacatttgaagcatctgatttggagaagggaggttcatcaaataaagttgtggactgcattctatgtttgaaaggattttacgaatggaagttatctggtggggttggtgtgtggagatatggtggaactgtgaggatcacttcctttccaaagaagtctccttcctccacagttggcagtgaaagtgctgatgaatcactggatgagtcagaatcatcacagtatgaacaattgcttgaatttcttcaactatctgaagacttcttgattgaagaaaccagaactgccaatgctcttgctttcctttatgatcactttggactcagacttcttcaggcttaccttagagaggccaataatgggattgaagatctgcctctgaatgcaatggtaattgataccttactcagcaaggtagtcaaggatttctcatctttgcttgtttctcaaggcaatcagcttggacttttccttaagaaaatacttaaaggtgatattggttgtctctcaaagagagagttcatagaagccatctcactatatcttaaccaaagaagtagtttggcatcaaatgatttctccaaattctgcaattgtggcggaaagcgtgatagtattcgacagaatgccaattattctgaaaaatatgttgaagtaatcaatactcaacagaaacaacttgagggtatgaagtacttttttgaagagacaaaattggaggtcagacaaattcaatcagaatgggaagaagaattgagtaggctagagcatcatatcaaaagcctggaagtggcctcctcttcctaccacaaagttttggaggagaaccgccttctttacaatcaagtacaagacctcaaaggagccattagggtctattgtagagtgaggccattcttaccaggacaatcaaatggaccgtcaacggtagactacattggagaaaatggagatatgatgatagtaaatccccttaaacatggaaaagatgctagaagggttttttcattcaataaggtgtttggaacaagtgtaacacaagttccggttacttgtactcaagatgttctagacttgatgagaattggtcagaagaaccgtgctgtaggtgctacagctctaaatgagagaagcagtcgttctcatagtgttttgactgttcatgttagaggaagggagttagtttccaactccattcttagaggttgtcttcatcttgtggatttggctggaagtgagagggttgaaaaatctgaggctgttggtgagagactaaaggaggctcaacatataaacagatcactttctgcacttggggatgttatctcagccttggcacagaagagtccacatatcccttataggaatagcaagctcacacaagtgttacaagattctttaggagggcatgcaaaaactttgatgtttgttcatataaatcctgaactgaatgctattggggagacaattagcacactcaagtttgctgagagggtttcgtccattgaacttggagctgctcaatctaacaaagaaactggtgaaatccgagatctaaaggaagagatatcaagtctcagattagcattggagaagaaggaagctgaattggagcaatgtaaggctgggaatgctcgaaacaccattgattctcaaaaaccaagagctgtttcaccttttcaattaccaaaatatggtaccagtggcaacatgaagcatgaaagtggtcaaagactcatggatgatagaaactttgagtctagaagttgctcttctggtaagcaaagaaggtcaaggtttccctcagcatttatagacaaggactccatgccaaaaatgtctctactaacggaagaaaagttagtgagctcagggaaaggaagatcacaatcccctccagtaagaagatcactatccaatgatagagggacaaccattaaaagcaaggtcaaaactgaaacagtagacaaccaaccaatattaaagcatccatttccagctagagtaccagctaacaaatcccttgccacaatgccagtggctgcatccactgacaataacacaagaatgtatgtgaattcacaagagccagtaaagcagaaaaacatttctgaaacactcttcaacctccagaaggtcaactataagaaagtaaatcaagaacatgaagaggaacaattcaagcaagcactcagtgcagtaagacaaggtggtattagaaaaagcaaggttgagagtatggctaaagccaagcatcctcaactatcaccctttaagattcaaaagcctgatctgatcccaacatttattcctgacatggattttgctggtgaaatcaatttagagcaacctccaaagaatgattactctgaggctgaaaatgatcttagatttatggagactgctgtccatggtgctttaagtctcaaaaaaatacgtcagaactttgctaggaattttcagaaccttgaatcaagaggaatagtgcaaacaggagagcctttattggttagcaaagttgaaaacaaagttgtgaatggttcgggtagcaatattaaagaaggaagcaatgcatccacgcctgaatttagaaggagccgatctacccctcgtggaaagttttttggtttatcatga

SEQ ID NO: 48657 - DNA, 150 bp, Glycine max
  Peptide Sequence Number=SeqID_140342
atgtcgctttctttaagacgtttcatggcactgccaaaaattgtgcaaccttacccttgcatatgcaaagaggctgtttccggattcgaacccatgaccaacaagtcaccaaggcacaactttaccgctgcaccagggctcgccctctga

SEQ ID NO: 48658 - DNA, 348 bp, Glycine max
  Peptide Sequence Number=SeqID_140343
atggtcattattgtcaatgcggaagcttgtggttacgtgagcctgaactactaccaatatatagatgttgtttatacaaatgagcacatcttaaaagcttactccgcacaatggtggcctcttgggaatgaagcagctattcctccttctaatgacgcatggacacttatccctgaccctattacaattcgtgcgaaaggtcggccaaaatcaacaaggataaggaatgagatggattgggtcgaaccatctgagcaccgacaaaaatgcagtagatgtggaaccgaagggcataacaggcgtcgctgtccaatgcaatctgagcgtgggagttgttcaaatcattga

SEQ ID NO: 48659 - DNA, 399 bp, Glycine max
  Peptide Sequence Number=SeqID_140344
atgcaagtcgcaggagtcattggcgcgtttggcgacgaggtgacacctggcactggtctcgccagtggtgttagctctttcaggcaggttggactcgtcagtcaaactggcgagttgagagtaggggagttccgagggttgcaggcagcagaggccatttccgagggtgtagtccgcaacgcgcagaggttgcagggtgtcgccaggctcaatggcgagttggttgggcaaaagcgccatcccctgcagcgatttcagttgcttgaggtgcttaaatcccccctcccccgtagaccattcacgcggaaaaaaaaacgcagaaaagaagaagcttttgttgctgccttcgtgttccacacaggagaaagaagaagggctgttgctagtatttgtgtttga

SEQ ID NO: 48660 - DNA, 495 bp, Glycine max
  Peptide Sequence Number=SeqID_140345
atggatgaagaccagtggatgtatgatagtatgatgtctcaagaagttgaaatgaatgatgaaaatgagaaagatgttggcgttaaagttgattgctctgatgcctttaatacttctgagttgtttggtagccgtgatgaagttttacaatgggctcgatcgttggctcatgacattggatttgttgccgttataatgaggtcatacaccaatatcggtgtacgaggaaaagtctcatttctgttgatagcttgtgaaaggagtggggagtataggcctaagaaatataatttggtaagaacatgcactggtcgactgacaaaggatgagaagattgttgttgcagatatgacaaagtccatggtgaagcaaaaaaatattttgttgacgttgaaggagcacaatgacaacagttatacaacaatcaaacaaatttacaatgcgagacatgcttaccgttcttccataagagggagtaacaccgaattgcaataa

SEQ ID NO: 48661 - DNA, 456 bp, Glycine max
  Peptide Sequence Number=SeqID_140346
atgtcagagttccatgatgatcactctttctactgcgatgaggagatacaagagtggttgaaggacaaagatgaaagattgcatccttctacgatgagctcttggacattattactgcctctcaagattctttcccttaatctcaagattcatcctgcattattgagtgagagttattcaatgggttacacaagtgaagtgttgtcctcaaacacagtttctgcgtgtactgctgttaattattttaagaagtgttgtagtgtattagtcaagtccaaagctggagtcaggagtgagcagccgcagagattgcatgctacagcaatgacgacgacttcagcacggagaacaaaagagttagatgagttcttgaaggttcttagtgcctctcaagattcttcccctcagcctgaggttcttgcttctgctccttccacccaggctcctgcatattaa

SEQ ID NO: 48662 - DNA, 1206 bp, Glycine max
  Peptide Sequence Number=SeqID_140347
atggagtggttcccaatgattccatatggtgagggtgtaatcattgataacattgatacaggcgtttggcctgaatctaaaagttttagtgatgagggaatgtgccctgttccatcaagatggcgcggaatctgccaacttgacaattttatttgcaacaggaaattgataggagcaagattcttcagcaatggttatgagtcaaagtttggcaaacttaacaaaacactttacacagcacgggacctatttggccatggcaatggcactgccaagggtggctctccaagagcctatgttgcagcctacaaggaagggagtccaaaaaacccaacatgctggctgggaacaatcgatcttgaatgcaccgacgcagatatcatggaagcttttgaggatgctataagtgatagggttgatgtaatttcttgttccctagggcagcctactccaacagaattttttgaagatgggatttccataggggcctcccatgcaattgttaatgatagaataatgcttactggtggtggcaatgcaggaccagaacctggaactggagctagtctttctacaggcttgccatataagaagttctattctttgatcaattctatagatgctaaagttgctaatgcaacaattgaagatgctcaactatgtaaggctggaactattgatcctaagaaggcaaagggaaaaatcttggtttgcctcctaaaaaaggaggttgatggattaagttatgcagaggggagccccatggcttacatgaccagagcaaaaactctattaggactgaaacctgctccagtaattgcttcattatcatctaagggacctaaccccatccaactatcaatccttaagcctgacatcactgcaccagggtcgggaacttttgcatctttccctcatgtttctggcatcattggccttctcaaaagactctatcgcaattggagtcctgctgccttaaaatctgctatcatgactactggccatgctattccagcattgaccatgctgattttcaagaaaattcctcatcagcgtcacacatccgagcacacctgtgctactcatagtacgactcacgttgttttagagccaaaaatcagaatcaacctcacacgtccaaacatggtcatgttttcttcagcaagatttagcacggccagtgctgacctccgcactgctatttaa

SEQ ID NO: 48663 - DNA, 1776 bp, Glycine max
  Peptide Sequence Number=SeqID_140348
atgaaaatcactgtcatgactgctgatgaacaaatcatcacgttagatgtggatccccacgaatctgtggaaaacgtcaaagcattgctcgaggttgagacaagtgtgcctcttcaacaacagcagcttctgtttaatgggaaggaagtgaggaattctgagaagttgagtgctcttggtgttaaggatgatgatttgctaatgatggtgtctggtgctggcgctggcgctactgcttctagtggatctacgaatgatttgagcttaaatgctgatggatctgctgtcaaccctggttctttccagcagcacattagacatgattctaatttgatgagtcagctctttcagagtgatccagagttggcacaagctattttagggaatgatctgaacaaattgcaggaagttttacgattgcgtcatcaccaaagagatgaattaaagcgtcagaaggaagaagagcttgctcttctttatgctgatccttttgatgttgaagcacaaaagaagattgaagctgccatccgccaggaaggaaagaaattaatgaacatgggaccaacaggagctattccttctcaagtggagaaagggattgatgaaaattgggctgctgcattagaacataatcctgaagcttttgctagagtggtcatgttgtatgttgatatggaggttaatggtgtcccattgaaggcatttgtggatagtggagctcagtctaccattatatcaaaaagctgtgctgagcgtcttggacactgcttaccagtgttgttaaatggcggccatggcggtgccatggcagatttaggtggcggatttgcgaaaaaacgccaccgaatagcggtggcgtggcgggtttgggatggcggccgtggcggttatggcggggtggcggaaatggcgggattttgcttggtttttgtccgcggtaggagttgggccgacccgacccaaccctacccgcccctgcgtccctcccgcacctctgcgtcctccctcaccccgccgcacccagccgccgccgcgacaggcgatacccgcagtccgcacacccagccgccgccgcccgcgacaccccttacacttagacgaaggctgacttcgcgacgagccccggcaaggcacgagctccgacgacgaacggccttccttctgtctcgcgaagaagacgaagaagccgaagaagacaagctcgcggatcagcgttacagaggaattgctcatggagttggccaatcagaaatattgggtcgtatacatgtagctccaatcaagggtaaaatgattggagaaatgagtttgcagtttagtcatgagcaggtgtccatttcttctggttttcttgtgtctgattgggagtatattttacccctgctcattcttggtgctggattctcccaatatggagtttctctttggactggatatgctccgaaagcaccagaaaatgttttgcgagttggtggaggagaagtttctgtaccatttttgcaagagaaagacataccatctcggtttctagacgaggaaaagtatgctaaggaagcttcaggctctggtggtcaagttgcatcaggcagcaataatccatcaacaggaggccactcttctggtggagcttctggtgacaggactaaggattctgagtttgaagccaaagttgcaaagcttgttgaattgggatttgaaagaaatgcaattatacaagctcttcaattattcaatggcaatgaggaacaggcagctgggtttctttttgggggctag

SEQ ID NO: 48664 - DNA, 789 bp, Glycine max
  Peptide Sequence Number=SeqID_140349
atggagtcaaatcaggaagcttcttccatggaagttgagactgtcccatctgaagccaaacttttgccaccaaagccaaagtttgagcctttgaagcctcatgagatgtctgatggtcaggtacagttccgcaaggtgaatgttccacctcatcgttatacccctctcaagaaagcttggatggatatctatagtcccatatatgaacagatgaaaattgatgtccgtatgaatttgaaggctcgtagagtggagctgaagacaaggcctgatacacctgatattagtaacctgcaaaaatgtgctgattttgtccatgctttcatgttgggttttgatgtcatagatgccattgctcttctgcgtttggatgagctctacattgagtcctttgagatcaaggatgttaaaacacttcgaggagatcacttgtctcgtgctattggaaggttgtctggtaagggtggtaaaacaaagtttgcaattgagaatgcgtcgaagacaagaatcgtgattgctgacaccaaaattcacatattgggatcttttgccaacataaagattgccagagattctctttgtagcctgattctaggatcaccagcaggaaaggtgtattcaaaactaagggcagttactgctagattggcagaaagattttttaatgatttctgtgagatcaagtatgatgaggatgagttcttgtgggaagctgcttcaaaaaatcctgataggttctgtctcccaatgtgccgagttcattatcaaggggcaagggccaatcgatga

SEQ ID NO: 48665 - DNA, 450 bp, Glycine max
  Peptide Sequence Number=SeqID_140350
atgacatccctaccagagatacctccagtgattatagatgatgatggagtggtcattggagaggttggaaagctaaagcagttaagggaactgttggtgctagattttaggggaaaacacgaagagactttgtgttccgtaataaatgagatgccactctttgagaaactacgtattcgtacagctgatgagagtgaagtaattgacttgtacattacgtcagctatgtctacacttaggaagcttgtcctaagtgggatgttaactgtgtttgcgccgctccagtggagggtttcagaaactaaagcgactgttcctcggaagtttgcatcaattgaagtgcatccttatcgacagaggagcactgtgttctgtggaagaaattgttttaaaaggcctctcccaactcaaaacagctccctctggaattcaacacctggagaaacttaa

SEQ ID NO: 48666 - DNA, 818 bp, Glycine max
  Peptide Sequence Number=SeqID_140351
atgccctgcgcgaccttactcagactaggaggtatgcatggggagctgctggcctcgtccatatgtatgatcaccttaatgatgctagtatcggcaccaaccgatacgttgctggttacatcatgttgttacagtgttggatatatgagcacttttcgttagttgcggagtgcaatgctgattcggagtacgacgaggtgtcactatatgcgtgtcggtggattgccacaaagaagattgtcaagaagatatctacagcaacgtacaagcaacgcttggatcatctcaggattccagatgtttgctggatgccatatgcggagcaccgaccggtccaggactttcatccgatttcatgtttctcaagacagcttcgctgggggcctgttgttgtcagatacagaccagagacggttatgcgccagttcagatacgtccagtgcattcctgcacacccggtcgattcatgggtgtcatttgatgatgtagacgataggtggacgcactactcagaccatctggcgctaacatcaaatcctcctcgagatgcatttgcggcgcagcccagacatatccctcaggagccagcaccaggatcgacacatgcagattctgatgcggacgagcccagacatgcagtggaggcttgccatgccatcgccgagacattggagcatcatcttagcctaaatgaagtcacactaggcacattgacacatgaggtcatccaaaaatgcctcaggattgacagaggtgtcacagaagaccgtaatgtgtatgtcaggtctcgacgtagacggcgtacagatcaaccatag

SEQ ID NO: 48667 - DNA, 387 bp, Glycine max
  Peptide Sequence Number=SeqID_140352
atgaaagcagacgcttacctcgatggagcagcaccaacagagaagaagaacgcgcaaagtcgaggtgacgaagaagaacgcgcatcaacaatgttgaagaagaatgtgcaacaacaaccacaccgtcgacagttgaagaacgctcagaagaagacgaagatgaacagcagtcacggaaggaagaaggagagaaagagacgtcgcggaaggaagaaggaactgttgggtgcaccagcaataatactgggtgcacctagcaacagtcccaatcaaaccttactacatttaagctcgaagaatataacaactgaaggtggttttgaaaggaataaaatggtgctaagaatatgtgaagctggtttggattgttataacggacatgcttag

SEQ ID NO: 48668 - DNA, 507 bp, Glycine max
  Peptide Sequence Number=SeqID_140353
atgaagaagtcttcgggaagcgcagctgacaagaagagggtgcgacggtcctccgccctagatcccacctccgacgcccctccaaggaaacaagctgtcaagaaagatgtgttccgggtgtttgctgagaaggttagagaccataaagaattggtttcaagatgggctgttctacaggagacgcgtgttgagtattttagagggaaggatttcgtgagcttcttaaaaagccatccggagctcaaagatgttctagaattagataggattttggaaacagaggagattgccaacattctacttgcaaaaaatcttttagtgcgctgtgatcgtgttgtaaaaactgttcgtcctgggaagaaaaagctgtctacctggcctgcacatttagaaattttcccttatggggaaattttcgatgttggaaacttatggtcattctcaatggatggcttaggtctgcctatgcctgatatagttactcgtgctatgttgagaaatggataa

SEQ ID NO: 48669 - DNA, 1389 bp, Glycine max
  Peptide Sequence Number=SeqID_140354
atggcagttgtggatgctgctgctcgttctttacgaatgatttatcaatcaatgctagctccaaagtatgacttttttcaagaggaaaacatgcaatttcttctttcattattgaaaagtgagaatgaaaatcttactgggctaggtgctggcattgttattcattcttgcaagacaattggcgaacaaaacatattatgccatgctggtgttttagagaaacttactagccttcttgaaggttctctaagtcagcgagatgctagtctagagtccttagctgcaattattagagacaacccagtgtctgtctctgaatttgtggaacttcatagtggaagagctttacattctgtaacagaattaactaaagacagatatcctcgaacaaggttactagcctgcttgtgcttgatttctgtgaagaattcttcgacatgctacctccaagacgtaggaatcaaaaccaaattggtatacattttgcttgagctcctcgatgattctggtcaagttggagatgaagcttcttttgctttctcaagattaattgcagagaaggaagatttgcagaagttagcatttgaggcaaatgctattaataagttcaactgtctcttgcaaaagcgtcctgtacatcctaaacgacttgaaggggtatttctggccttggctgatctttgctcaaaattggagtgctgcaggtctagttttctttcattgcaggtcttaaacctggtagttgatgccttaactcatgaggatgccagtgtacgcactgcagcttgcatttgcttaagaagtgtctctcgctcaatcaagaatttgagtgcaggtcgttttatgaatgaaagggttgtttttcctctggttcagcttctctctgatctttctacttctgtccaggttgcagcccttggtgccatcagcaatatagtggttgactttatgccacataaatcaacattcatacaatgtgggggcattaaagagcttgtgcaattgacgaagtcgatggattcatctttaaggcttaatgctgtatgggccttgaggaacatggtattcctggcagataagatatgcaaggaaggaattttcgtggagttaacagcatcttcaatggctagccttatctgtgatcctgagccttctgttcaagaacaagctctggcccttgttcgcaattttgttgatggatgtgtgtactcagttgaacatgcttttgctgaagatggtatcatactagatgctgttggaagacaattacaaaaatcttcaaaaattgaaattgggatacagaatgatgatatagaactccaacaacaacaacaacaacgccttatcccactaggtggggtcggctacatggatcaacttccgccataa

SEQ ID NO: 48670 - DNA, 210 bp, Glycine max
  Peptide Sequence Number=SeqID_140355
atgggttgcgctcttcaaggcacacctaaccctgggttcgccggaagaaaagacgacgacgatggccggagacaatggctgatggtggctggagacaacagcggacggtggcgacgccaaagacagtcagaatgggattgtacccgctctgataccatgttgaagttaaggactacattgttgaagggtttaagatacacattacattag

SEQ ID NO: 48671 - DNA, 486 bp, Glycine max
  Peptide Sequence Number=SeqID_140356
atgaggcaatggctacctgagatggcaagaaagccaactgagtggatccatcatccttcagacgcaccgcttcctgtgcttagagcagaaggacagcaaaaagctgctggctctgaaccaagggatgaagttgttgtagacaactctaacactcttgaaaatttggacactcgaaaagttgtggttctgggaaaggctccatcagctactattttagctaatgataaaaaggtgccagcacttcaggattccaaaactgaaccacctacgcggaagaggcaaaaacatatggtagaggaggggaagaaccaggataactctcaaaatcataacaaagatactggcatgtcaagcattgaccaagacatttgctctacagctgattcttcatcatttccactgcagtattcctcatcttctaatctgaagtggcacggcaagatcagattgacatggagcagagttcaagcgaagatgctgatctaa

SEQ ID NO: 48672 - DNA, 519 bp, Glycine max
  Peptide Sequence Number=SeqID_140357
aaagccgcccaaccagaaatcgacgccgcaatcgaagccctaaacgcgctgaagctcgaaaaaagctccatcgagcgctccctcctcggcggctccgactgccgcaaggccttccgtcagtccgtggtgaacacccttgaacggcgcctcttctacatcccctccttcaagatctaccgcggcgtcgccggcctattcgactacggccctcccggctgctccgtcaaaggaagagtccatgacgaggaaggcaactcagatctgagtggaagaagaagagatgagagagaaaataaacgagggacaagtctggaggagatgcgcgagggtgtgaacacgtggcgcattgtggaagcggaggaagaaccagagtccctgctgctgcgacgatggaggtgccgcccccgccgctgggcttccgagaggccgagagtgattcgccgcctcgctggcggaaaccaccggacctacggcggcggcttcctcgccgtctccgctgtattgaggggagttgtttga

SEQ ID NO: 48673 - DNA, 249 bp, Glycine max
  Peptide Sequence Number=SeqID_140358
atgtatagacatgattacggggagctaaagccaaatgcaagtttgagctgttcctatagcctgcgtccctcaggtgtccccccagttatcccctcgaagcacgcaaggccaagtcgccactcagagtggcgagaacttgccacagcaaaatcgccatctccaatggcggtatctacaccgatatcgtcggttttactggcgatatcattccacgtgtcaacggcttgcagatttcgtcattcatactga

SEQ ID NO: 48674 - DNA, 369 bp, Glycine max
  Peptide Sequence Number=SeqID_140359
atggccagccaggcaaggaagtcgttacagaatgtcatgagccatggaatgtggagggctatacattgtattatggggatgctgtcattgtttcaagaggataatttgaggtctgagcagaagattgttgaaaatgaaaagggaggcttccggttagagatgaaacctttccttctgcattcgatgatgagggaagctgcttccactgccaagtgcttgtgtgtttatgaaggctttggttttgaaattgatgtccagaagtctttgcctgaaacagttatgggtgatgaggctagggcttttcaagaaattttacacatgattggctatttattgaacatgaatgacaaagggactctcaatttttga

SEQ ID NO: 48675 - DNA, 372 bp, Glycine max
  Peptide Sequence Number=SeqID_140360
atggccaaccaagcaatgaagtcgtttgagaatgtcatgagccatggaatgtggagggctatgcattgtattctagggatgctgtcattgtttcaagaggataatttgtggtctgagcagaagattattggtgatataataaaacgaaaagggaggctttcggttagagatgaaacctttcattcgatgatgagggaagctgcttccactaccaagtgcttgtgtgtttatgaaggctttggttttgaaattgatgtccagaagtctttgcctgaaacagttatgggtgatgaggcaagggcttttcaagaaattttacacatgattggctatttattgaacatgaatgacaaagggactctcaatttttga

SEQ ID NO: 48676 - DNA, 519 bp, Glycine max
  Peptide Sequence Number=SeqID_140361
atgtcattgcccgcaatccccaaggatgtagagaagacattccagcagcaaaagataagttcgtctgtgtgcccattaaaactcaatatgaaaatccacaaagcgtaccttgtccttatagccttggagttaacttgtattggaattaagtatggagtctccaacaccaataatccttttcaacaatcaagccttcttatgcttttcctcactgctatattttcccatgtccttgcatccaccgctgatatgaccaaacaaattatcatcataacatttcacatctcagggataactggatgtgaaacactcctgtggattctcattcatgactttatgtgctactgtatggtcaacttgcttcttttactcctagccaaattcttcttcttcaaccaagttgctcagctggtcgtttacttcttcaaatacatcagtcagctgctgcgccaagtttcaggttcaaatgttgatcagatgtcaaatttggagctgcaaccacagcaagatcgggtgtag

SEQ ID NO: 48677 - DNA, 1113 bp, Glycine max
  Peptide Sequence Number=SeqID_140362
atggctggcacgaacttgcaagctccactcataatattccacctgtcaggaatagttggatgtgaggtactcatctgggttcttctcgctgacattttctggtacagtatggtcaacatgtttgcttcaatcgtagctttcatatgcttcttcaatcacattcttaacatctttgctgatcatgagatgccagttatagaaatgcagccgccagaagaagagtaccttgttcttgtagctttggagttaacatgtattggaattaagtatgaagtctccaacaccaataatccctttcaacaatcaagccttctgttttttctcactgctatattttccaatgtccttgcatcaacaactgacacgaccaaacaaatcaccatcataacatttcaagtctcaggcataactggagttgaaacactcctatggattctcattcctgacttcatgtgctactgtatggtcaacttgcttcttttactgctagccttgttcttcttcaaccacgtcgctcagctggtcgtttacttcttcaaatacatcagtcagctactgctccaagtttcaggttcaaatgttgatcagatgtcaaatttggagctgcaaccgcaggaagatcggaattctattctggtaaacgactctgatgtgtgggagataagaaagaacaagggggtgaagattttgaggcctaattctgctgaagtctcagctaatgagacagaatatggaagagcaaaactgagaactgcaacaggcttaaaagaatgcaatgatggccagcaaggcaaggaagtcatttcagaatgtcatgagccattgaatgtggagggctatgcatttttgattaatgatgtaatggaaattgcagaaaatgaaaagagaggcttccggttagagatgaaacctttccttctgcattcgatgatgagggaagctgcttccactgccaagtgcttgtgtgtttatgaaggctttggttttgaaattgatgtccaaaagtctttgcctgaaacaattatgggtgatgaggcaagggcttttcaagaaattttacacatgattggctatttattgaacatgaatgacaaagggactctcaatttttga

SEQ ID NO: 48678 - DNA, 156 bp, Glycine max
  Peptide Sequence Number=SeqID_140363
atgtatgattcacaaatgtggatcaggccttccaaagaccaaggtaaggactctagacaaaggggcggtccatacatggcaacactaagcacaagaacattcagagagtatgatactgcaatgaagctaaaaatgtttgcgtgtgataagtgctaa

SEQ ID NO: 48679 - DNA, 216 bp, Glycine max
  Peptide Sequence Number=SeqID_140364
atgccacacggtttgtttcatccaagatttggaagtctctcatatgcctacaagggtgttaataagcgtaagaggtactcgcgaaagaaagttcttccgcaggaaggaaaagcactcccacggaagaacctttctttcgcggatgccagcggaagatggaagatatggctcttccgcgggagttgtgacaccctctacccctcacatatatactaa

SEQ ID NO: 48680 - DNA, 582 bp, Glycine max
  Peptide Sequence Number=SeqID_140365
atgagtccgcggaagaaccatcttccgcgagaaggaaatggaacgtctttgacacacgcggaagaagcttcttccgtggatggttcttccacggaatccccggaagtgccatatcttccatcttctgctggagtccgcggaagaaacgatcttctgcccgacctccaacagcaccgatacacgcgcggaagaaacgaaccttccgtggaagaaggctcgtcttctacctcgcgcaacgaaaaccagcacagaccaaaccagaccaaacatggcgtaacacgaatgcttaaaagcttcaaatgccggcaatggaggacgacgcgcgcgaagaagaagacctggacgcggggagaagaagaagaactcgttgctgaacgcgtggagctctggtcgcggaagaagaagaactcgaaggtgaagaagctttgggtcgcggaagaagaagaagaaatcgaaggaggaagaagaagcgcttttggtcgcggaagaaatcaacagggggaccccactattcccccacccccactagagctaaaagcagaatctgacaaaattgtgttttgtaacacacaagcaacatga

SEQ ID NO: 48681 - DNA, 393 bp, Glycine max
  Peptide Sequence Number=SeqID_140366
atggagtatcaaaaccaaagggccaaggagggtagattctgtgagaaacttaagatcaagaataaaccaaagtttataggagtgagacaaagggcttcagggaaatgggcagcagagatcaaacacacatcaaagaagattaggctacaactattaatattaagggaatgcttttactttgcagctagcaagcaagaagaaatgccatcatatggagtgttccctgagtatagagatcatccagatggcccaccaatcaccaaagaaattagtagaattgggcatggtccacttagaccagaatcaaatgaggttgagcttctcctcatgcttaaccaattcttctccccaacttgtgttactaatctgattgcagagagaagtaatcagtga

SEQ ID NO: 48682 - DNA, 216 bp, Glycine max
  Peptide Sequence Number=SeqID_140367
atgagttatctactcttcttaacggtcaaagcgaaccctttcattcattccgaattacagatttcggaatcaataaaatctccccaagtaggatttacgacaagtcagttaacagctgaccgctctagccccagcggggatggagcgaaagaagttttgagaattcaagagaagctgaggcatcctccagtagacttgaaccttgttcctacatga

SEQ ID NO: 48683 - DNA, 225 bp, Glycine max
  Peptide Sequence Number=SeqID_140368
atggccagccaagcaacgaagtcgtttgagaatgtcatgagccatggaatgtggagggctatgcattgtattctggggatgctgtcattgtttcaagaggataatttgtggtctgagcagaagattattgattactcaagagttctcagccagatgaagcaatttcaacaatacattatactggtaggaggcagtactacaacaatgaaactaaggaggggctga

SEQ ID NO: 48684 - DNA, 543 bp, Glycine max
  Peptide Sequence Number=SeqID_140369
atggcatgcggtaaaatctacctctacatagctaggcctgtacaattattggttggagtaatgaaattttgccgtggcattcaatgcataaattcgagggcgagccctggtgcagcggtaaagttgtgccttggtgacttgttggtcatgggttcgaatccggaaacagcctctttgcatatgcaaggggttttccgcattaaaatattgcttgcaatcctcaaggacgtagagaaggtctgcaaaacaaaacaaaaaaatcagaaaatacagcaagttcaagttgaagaatatcaagagcatgaggaagagaaactcttcgtcaccaactgttatgtgctttatgctgcagagagcaacatagatgcttggcagataaacaaaggcagcagcagactaagtttatatggtggcatatttagaagtttaggactgagttttgtgcttggtttgtatgtgtctaggaaaggcataattgttagccgatgtgggacttggattattttcaacacactcccacaaggagggctagtggaagcgtga

SEQ ID NO: 48685 - DNA, 240 bp, Glycine max
  Peptide Sequence Number=SeqID_140370
atggctgaaacaagtgatgaattgatccaaattaaaatcgtcgaggctgatctccaggaagaggtggtggattcttcaacgatggttctcttggtggtgcacttgaatgtcgttgcagccattagagaaaaggggaaattcaaatgtcaaattctagggttcaaacaaaaatatgaaaggggagtctgcattgcaataaggaaagtgcatttagcaaaggccgtgtttttcgacaaataa

SEQ ID NO: 48686 - DNA, 591 bp, Glycine max
  Peptide Sequence Number=SeqID_140371
aattctattcctgtgagcgaccctgatgtgttggagataagacagaccaagggggtgaagattttgaggcctgattctgctctaggagctgcgagtagtggcggctctgcagagctgggtgctgtggcggctatatacgctcttattacttgcaattatattgctgttgcattcagttgtagcttagacttaataattaagctattaacgaataattctattccggtgagcgactctgatgtgttggagataagacagaccaagggggtgaagattttgaggcctgattctgctcttggagctgcgagtagtggcggctctgcagagctgggtgctgtggcggctatttacatagtctcagctgatgagatagaagccggaagagcgaaaccgagcactgcaaataatgcaatgatggccagccaggcaaggaagtcgtttcagaatgtcatgagccatggaatgcggagggctatgcattgtattctggggatgctgtcattatttcaagaggataatttgaggtctgagcagaagattattggtgatataatgttgccagttggccatgtgccctcctctccagtttga

SEQ ID NO: 48687 - DNA, 516 bp, Glycine max
  Peptide Sequence Number=SeqID_140372
atggagtgctacacaaggccaaacaggagtgacatccacctctcagcagaggaagaagccaccatagaagcaaagaccagagagtactttgatggagtcgcaccacaacgccacacaaagcctcaacgaagtgactattcagctcaatatgtcgatgctttctccaatgcccatcactcttctttaactataccagaattaacacaattccaactcctccagaatgatccccaagagaagaaattggtgtacaatggaagtcaagtaccggaagaatttgtggaaacagagtattaccaagatctcaacagcgtggacaaacaccaccatacgactggaacaggatttatcaaagtagagaaaaatggaaatgactttcacatagaaccagataatgacactggttgccatcactcttgcaagggcaatccagcaaccaatgattgggttcctgctccttccactgaggcaaacctaacaggagtgacaactagaaatggaggagtggctacatga

SEQ ID NO: 48688 - DNA, 279 bp, Glycine max
  Peptide Sequence Number=SeqID_140373
atgggtggatatgatgagtattctgttattgatccttactacactgagcagcagccgaattggtttcctacgatgcaattcaacctcaacaactctatgggggctgatcaaatggtgtctggttcaacattcaaagacagttattatgtaataaccgtctttaaatgttacatctgggttgacattcaaagacggttattacagcaagcagaaagggagggttcaaacgaaggagcaaggagcaagcagtctagggttcaaagcaatctcgaaagctag

SEQ ID NO: 48689 - DNA, 351 bp, Glycine max
  Peptide Sequence Number=SeqID_140374
atggaaggctacgatacaatgcaaaatgggttccttcattatgattacttggaggccatcgaagatgacttgatgaaggacaaccaagacgacctgcagttgaatgacattgttgctatcgaagatgaccaagatgaccagcaagaggtgcagttggatgacgataattttttcgagtactgctgctttcaagatcagttgttgaacctggatctcaaaggcgaagaacaatctcctaatatcatgaaaggctcctccgcaatgtacgagcaaaatgggtttgctttcccgaagaatattgaagatgagttgatgaaggacgaccaagaacaagacctgcaagttcaatga

SEQ ID NO: 48690 - DNA, 1644 bp, Glycine max
  Peptide Sequence Number=SeqID_140375
atgcagcaaggcaccttgactagtattctgaaaaaacagggagatgagagagagaaagaaacaaagagtgggaacacggaaggacaaattggagggatgcaccggacgttcgctccttctatttcacaagatttccaaaggagatgggtgagaaggatctgtggtttgaattttaagaaatgggaggatgtgagagaggtcttcattgcgaagaaaaaaaacagaagtggtcggaagtatggctttgttagattcaagggagtggaggaagtggggatgcttgaatgtcagttggacaacatggttattggggatttgaaactgcatgccaatctcccaaagcatggaagggagccagtgataaacgacaaatctatcatagacatgaagcacaaggtagggttagtcatggacaaggtagcagaggatgagcagcaacaaggcaaaaaggaaacagaacacacgttcaagaacagaggactactaaagcaacatccacaacgaatgcaatccccagtctcgtacgcgaaaggaaacaacaacatggagaggagatgttttccaaggcatgtgactccaacgagatcaatctctcattcgacgctgcagccgagtatacccatagaggaaaataaatggtactataatgcgtgggttggaagattaaggaacttggtgctattcgataaaatggaagatcaaatcatgtgggttggaggagaagatatcactcctaaatacctaggtgatgatatggtattattgttgggactcactgatacaagagctaaagaaatgtgtaggaagggagcttgttggggaatcccactacacgcatgggacaaggagaatattaagaagaatgtgcctgcggtaggggaagtagtggaggtggatgatgaggttggcgaacttcagcagctggatagggctcgggagacatgctacagtccaaacacctgtaaatggcatatgaggagcatgatggggtcatcagaggagattagctctaatgagagcaaaatggggttgccattaaccgcggccaatgagtcatcagaaagcaagtttccaatgaacatcagcaatgaaaatggaggaggcggaaaactgggaggtgttgctcgtgataagcaattctccgacggacaatgccccacgcttggacccaagggaataccctatggtgagacagcagggaacgttaaccgtggtataagcagacctactcaacaactacagtctagaggcaaggatacgaaacatacgacagccagagatcacgaggaagagacaggagggaataaggaaggggggccatccaggttagcaaattttgaattaaagtggagggggtcacaagctcttgaggaagctgaaagccctttaatgggccttgctactcaaaaccacaatggaacaaatgcaggagaaaaggacaacttggaagttaaatcaaatgggtcagctcacacttggcaagtatactcaagaaataaaggacgtaaaaagcaaatgggacttaacaaaacagctgacctcaaagttggacattcaacacacaaaaataccaatgcctcacgtatatgtaatatatcatcatcagtgatgaggggtaacaggctgaaggaagtggctggatag

SEQ ID NO: 48691 - DNA, 204 bp, Glycine max
  Peptide Sequence Number=SeqID_140376
atgaaggcaaaaaaacttacaagtgatgatgcagtgctattcatgacggcgaaggagagaaaactcgtagaggacgacaagcaactgccggaggagaaactagggaggagtcatggacaacaaatacacaccacgaataatatcaactctagcttcacggaggagaagaaagagaccaacagacacaccaaaaattctaaatga

SEQ ID NO: 48692 - DNA, 432 bp, Glycine max
  Peptide Sequence Number=SeqID_140377
atgtgtgctctttatcaatttgttcgtctttcattcaaactctggcctcaaaagatgcacttaggcatgataacgggtaggtcgaacgtgactctccttattcttgttcctgcaaaaacctttcaattcctcactcccctggttgctccacgtattgttccagctttctctctctcaaagcagcaaggtcctccaccaccaccacctccaatctccctctttcacacaaagagagatactgtgtgttcgaacaagttttgggcttttggtggtaatgtggtggctatggataaggactcgtgtggagtggggttcgtggcggaactatccggggaaagtagccgcaaaacggtgattgatgctttgaagatgctggtgcgcatgacgcacagaggtgcttacggtgtgaagccaacactggagatggagtag

SEQ ID NO: 48693 - DNA, 270 bp, Glycine max
  Peptide Sequence Number=SeqID_140378
atggaggatgattacttctgcaagatgtctgatgaagttgacatggatatgtataagaatatggatgatacagttaaaaatgaagcttgtagcatatttttacaactacacagcacaaaggaaagagggcaaacaaagagccacgatgttgtgaggaaggtacaaggggaaagaggtggtgtcgaagaaggaggaattgttgcggtgaaccatatgtcattgcaagaaggaggtatcatcatcacgggaagggaggtgcctcgtcactag

SEQ ID NO: 48694 - DNA, 1599 bp, Glycine max
  Peptide Sequence Number=SeqID_140379
atgggaatcaaggttatgcaattgtcgcaacccgttcttcctcattccccttcttcgtctcataccctagcttccgcaatcttttccccttcttcgtcaaaaacgcgaacgctagtgtgtcgtttcgtgcaccgctcgagcctctttccgaccaccaccacgcgccttctccgcagaactaaatcgtttgaacagcacgcgcttttcacgcgcagaggaaacatacgtagggcgtgcagcgcaagtttggagccgttctctgatgaagagttcgcgaagaagattgaagatctcgcgcttaagtttcagctctcagatgacgccaccaccaatgcgaacgatttggaatcggaggattttcaggagatttcgtcgacggtgaatttcgcggaagagttcgagccgccggaggagattattccggcgaacatcgaacggaaagcaaacagcgtggagcttccgttttcgctgaggataatcaagaagaagctgcagtggaaggaagggttcagggaggcaggggaatccgcgtattgctctgtcaagaaagcgttctcttctatggtttttataatcagggagcttcacagtttcactctgcaaatgagggaggtcctgttctacgaagatctgcaagggattctcgaaagggtgcagaatgaaatgcacgcgtccttcgtgtggttgttccagcaagtcttctctcacacgccgactctcatggtgtatgtgatgattctcctagcgaatttcacggtttactcgatggggaacaacgcagctatcgccgccgtggcaccgccgccggtatccaccgtcacggaggctcacgaccaaaggggtcatattcggggtcataacattgattcctctgccatcaagacgttctccgtttcgaatggaaaaatcactgcctacgttggcggcggcaatggcggcggtgggaaggtccgtccggcggctaatggaaccgacggtgacggccggtttgaccggtcgcgacacggaacggttttcagcgacggcggtgcttcgacgcaggcttataaaacaggggaaaaaacagagtcggtgtcagggcaagaagaggaggaagaggagaatctgtggaacgcgatggtggaagaagcttcgagaatggaggtgagttggagagggaaggatttggatagtgatgttatgaaacggttcgtttcgccggtgatggcgagtattgaatccgatgactatgcagagtatctgagaacagagcttgtgtaccaaacagggttgtctcaggaccccaacaacactctcctccttgccaactatgcccagttcctctacctcgttgcacacgattatgacagagcggaagagttcttcaagagagcaatagaggtggagccaccagatgcggaggcatataataaatacgccacctttctatggaaagtgaagaacgatttgtgggctgcagaagagacctatttggaggctatttcagctgatcctaataactcattctatgctgctaactatgctcactttctatggaacactggtggtgaagacacatgcttccctttatcctcccctgacaactcccaagaagtttaa

SEQ ID NO: 48695 - DNA, 442 bp, Glycine max
  Peptide Sequence Number=SeqID_140380
cacaggagaagatgaagcagtatctgaacacttagtaaacaaaatccctaccaattacatgctattgaagcttccggtttacagggagattagtaagcttaaaaagctacgtcatcttctgagtggctacataccttcaattcaatggaaggatattggaggcatgacatccctacaagagatacctccagtgattatagataatgatggagtggtcattagagaggttggaaagctaaagcagttaagggaactgacagtgatagattttacgggaaaacacaaagagactctgagttccttgataaatgagatgccactcttggagaaactacttattgatacagctgatgagagtgaagaagcttgtcctatgggggacgttaacaaggtttccaaattggatttcacagttcccaagcctgaacttgaattggagtga

SEQ ID NO: 48696 - DNA, 687 bp, Glycine max
  Peptide Sequence Number=SeqID_140381
atgggagaagctgcaaacaagatctgccttgcctcactgaaaaatcaatcatgccatgtgtttggtaatgctgaggggagaaccaaactcaacttggatctcaagcttggcctttctgacatttattctgcacaagcaagagacaaccattacaataaccatacttttaatcaagttgaggagaatttcatccatggtagttcttcaactcatggtgttggaatcaatttcaacactaaccaaacttatgaaggacaagcaagtaaaccgggcttggatctcaacatggccacaaaaatggaggatccaaaaaggctaaagaggatcatggcaaatcgtatttcttcaaggagataccgattgaagaagttggaccgcatggaccaactggaaaaacaaataaaagctatccggcaacagatctccaacttgcgtcaacaaattggagaggctaaaaataagcaacaatcattgcggattgagcagcagcatttgaaattcagaattgcagattttcaaaacgagaaaatagttagagaagttgaaattggaaacaacatggaagaagtgaaaaggctgagagaactccacattaatcaattgcaaactaatgcacaacctgcaatgcctaattcagatgatggtcatgcagttgaggcacaactcgatctcaacctaggcctctag

SEQ ID NO: 48697 - DNA, 129 bp, Glycine max
  Peptide Sequence Number=SeqID_140382
atggctagctgtcctcatcctggcacaaaagtattgggaaatacccaagtcccacatcggctgcctcaatccttggagtgcggcttatatatctgttgggcaacttcacttaatgccaattggttttaa

SEQ ID NO: 48698 - DNA, 99 bp, Glycine max
  Peptide Sequence Number=SeqID_140383
atggcgaacatggtgagaagctgcacgagttcgagtaatttaaatgcactgcttaggataacagttgtgatgaatatgatggcacttggcaacatgtag

SEQ ID NO: 48699 - DNA, 261 bp, Glycine max
  Peptide Sequence Number=SeqID_140384
atgggggcagagcatggagttgttgaaggaggagagaaacaggagataatggctctgccactcatcgtggcttctgcgttcttcttcttcttcttcttcttcgctcgctgttacttgctgaacaagacgaggatttttatcagcactggctctcgtttttacacgtggacactgcatacagaacaagacccctccacttgggtgactaatgattatcgaattttatacttgttccattttgtaatgtttaaactaaattaa

SEQ ID NO: 48700 - DNA, 249 bp, Glycine max
  Peptide Sequence Number=SeqID_140385
atgttgaatccgactcagtttcaggctaaaaaagagaaggttcaagtagttgatgactcgcttagcgaggcagattcgctcagcgagtggcatccgcttagcgaggcatacaactcacttaacagcgagccagtcttgctaagcgaaccagtctcgctaaacgagtcttcaaaagttaaagagtccaagagcctttacaacactaaggttggcagaatttcaagggagaacacattttgtgaagaatag

SEQ ID NO: 48701 - DNA, 2550 bp, Glycine max
  Peptide Sequence Number=SeqID_140386
atgggtttgaatgtgaaggacattcaaattcgtttgttcaaagtggttcaagattcagccaacttcttggtttgcatgtcccctttccttgtttgtgctgttattttcattaaaatcttttggagttctgagcaaactcaactcaaatatgtcaaaacaaaggaggaaaaaggagggcagaaaaaggttgaaccaaaatgtccaaagataccaaataataggagacctgagatgctttgtaagtatccatcacagaatgccacaagtaaaaggagaaactttagtgacaagaattgggatgtatatagtggtttagaggataaggccaaggatttgtcagcagtttttcataatgagttcaccaaaagaaacatagagaacaaaggggccagatcttttgagaagggagagagttctctggataataggttgtcagcaaaaaaaactcaggttcctaagaggcaaatcttgagatctgaaccttcaatggttgacttggtggaatgtggtgatttagagatagagaaaaagatagaggatggagatgatgaggatggggaagaaacacaggaggaaagtaacaaggctatcgaatggacagaagatgatcagaaaaatcatatgtatcttaggaattcagaaatggaaagaaacagaaggatggagagtctcatagccagaagaagagcaaaaaaactattcaaggggcagattgagaagggtcaaattgataaaaagtcaatggcaccagtgcttaccaaaagaagaaatcacttagattcttcaaaggattttgatgatggcttagacatgcctggttctgccccatcttttatgccaagaagtccttatgatattccctatgatccttctgaggagaagcctaacctcacaggagatagtttccctaaagaattttctagtcagaaggatatgccatttagcaggcatggaagcttcagttcaacccatcttttcccatcagaaaccaaacatgaccatggagctagagagcactattactttaataaaggaagcaaatattctgacagacttgcatactcaagattcagaaggcatcatacagataagggaactcatgactggctaattgaccagttgatatacaatgaaggtggtgaaaatggattgcaaatacctaatacactaacaaatggagaagaatcaacacatgaggaggatagaaaatgtaaaactgatggggaaaacatgaaagatgagaatgatcatgaaacaaaatccatgtcaggtcaaataagtgagccaggatcagatagatcacggccatggccaacgtttcctaagcctcacaggaggctccttacttttccggtatctactactgctactactcatactactaacataaatgaagctttgtatgaaactgtcacatctatagttgataagaggcaagaaagtatatttttaacccatgggagaatttgtcacaccccaacatattctgtagcttctgacttacaagtggaggtttctgaagttggttcgccaacatcaacagttggtgagaatgctgagactaactcatccattgatagagactctatactgtatgatggggacattgatagagatgttagttctggtagtgaagagttgtggggagcctcattccatggaggaaaagaagcacaaggagttagaagtgaggcggatgataatgccgaagttaacaacaattcaaaagatgttgtctcgtcaactactccgcgacatatagatgaaaatgaagctgatgtgagctcaatgtcctcaaaatctgatgtgcctgaagatactccaactcatgcaagtcatcataacttctttggttatatgaaacatcccgaatggtgcaacatgccagagaatgtaacaaatgaggcacaggttatcaatgctgtgaacaactcaacaagcacagaacaagataacacagacaacttaagaagtaatgaagatccaggcacatcggtaatgcgacaagaatcaatcgatgaaaccttcaatggctcagtttcttcatcaccaaggtctgtgctacctgagataaccatggcagatgaagtttcaccttcagcttttgatcaagacctgcatatagatgctcaacaatttattatggagggtttggcccaagaaactttaaacagtgaaagtccacctgacaccatgcctcaaactattcagccaacgatggatgatacaactgatgaatcacatagtgttgacttcaatttcaatcattgtcaggagcagactaatcacttagagaattgtattgaagaatcaaatgtctttggcagtatgaatgatgaagtcagcaatatggaagaggaggacaagtcaaagaatgatgagaacagtgaagacaattcttaccacctaaatagacaagaagctactacagaatccaccagaccaataagtgagatagcaactttggaggatatggtgccatcaacagagctgattgaagatgataagaatgacaaaccatcaagcagtagtaatattcaaaaggagtga

SEQ ID NO: 48702 - DNA, 1209 bp, Glycine max
  Peptide Sequence Number=SeqID_140387
atgacttccattgtttcaggtttgcaaggccagcctccacaaggacatgaacatggatatccttttgtagctggaagttatacttcaggaacaatgtcattgcatgtaccaagcattttgttggagatggaggtacctacaaagggttttgtgatatctgactgggaaggacttgaccaactgtgcgagcctcatggatcagatcatcggtactgcatctcctctgccgtcaatgccagaattgacatgctacatagagatctagcacgcaaagcagttcagaagtccttggatctgttgaaaaatggaaaagatcctagcaaaccttttcttccattgatcaggaatgctaagagaatgcttgttgctggaacacgcgccgatgatcttggatatcaatgtagaggttggactaaagcttggtatggaatgagtgggcggatcacagatgagactacaattttggatgttgtgcaggcaactgtgggagctgaaacagaagttacatacgagaaatatccgtcgatttacaccatagaacgtcatgaattctcttttgcaattgtagctgttggtgaagctccatatgctgagacctggggtgacaattcagagcttacaatccccgtaaatggtgctgatatcataagcctagttgctgaccaaatcccaactctggttattttgatatctggaagacgtttagtcttagagccacggctattggaaaagattgatgcccttgttgctgcttggttgccaggaaatgaaggagagggaattatagatgtcatcttttgcagtcatgacttcaaagataaactaccagtgacttggtttagaagagttgaacggcaaatttcccaaattgggggacgtgtcacgtggcgctggtgtcgccattctcacaagtgccttgccttttgtctacgtggcattgaaaacaccagcactaatggcgagttggtcatggctccagtcaaacgcgagaccctagggttgcagcgttgtagagtgcaggtcagggttgtagcgacgcagaagcagcaggtcagtggtgagggacgcgtcattgggtattgcgagttgcataaaggaggcgccattccctccagcgatttgcttctctccattgcgctgtcactcctcactcctcatacttcaactttcatcttcttatttaaaaagcttggttcatttggttcctag

SEQ ID NO: 48703 - DNA, 738 bp, Glycine max
  Peptide Sequence Number=SeqID_140388
atggtggatgagagaaaagaagaagaaggctgcttcctcgcgtttctctgcaccagtcggggccagttttcgaaaaatttccaggatgtcacactcctccctattctctacctcttcctcacccttcccttcaacctctctttcttccacctaggtggcaccaccaccttcttccttgtttggcttgacactttcaaactcattcttctctccttctaccaaggccctcttgccctatcacccccaaacattctccatttcatttccatagcttccctccccatcaaccccaaacaacactcaccaaccaaaaacaaccacacaaacaacacccaaaagccaaaatggcttttgctcctaaaagtgcttatttttgcaatgatcatacgtgcttatgactatagagaaaagttgcaccctcatttcatcttagtcctctattgctgtcacatgtaccttggcatagaacttgtgttagcccttagtgctatcccgattcgaacccttttagggtttgagattgaacaacaattcaatgaaccctaccttttcacatcccttcaagacttttggggtcctagtcatgtgcttttttgtgcttcacgatgtgcacactgcggtgaagatgacgacaaagaaggtgatgctccgtcatgggtggcggttgcatcgcgttgcatcaggaccgctcgtggtggcgttcttggcggtcatcggaaggtgcctcatacttcttaa

SEQ ID NO: 48704 - DNA, 915 bp, Glycine max
  Peptide Sequence Number=SeqID_140389
atggcgggtgaaaaatgggttcaggtggcggttcatggagtgcatggcgtcgtccagacgagcaagggcctcgtcgagctggcttcgagggcagcaaacctccagcaagaagaagaagacacagaggaatattacatcataacagaatttgttatgcacgaatcaagcaagattttcctaattactgtattgcccatactgccctctgcttcaaacaaaatcacgaagtcattttatctaccgggatcagttgatgcaaacgacaggcagatagatcagtggaatgtaaagccaccccagctctacctttggactgataagcataaggccatagctcggaaacatgttatggtgagaaaggctgataagacctcatggaagaggaaacgaactgaggaaaacgatggaagaagactaggtgtgacctcaccacccaatccaattgatgggagaccctatgtcagggaggatgagaactaccttagggaattagagacaaggcaacagactcgccattatggtattcagaatcctaattctgtaatgagtaattatctatctgtgcatgatcctgctaatagccaccacatggggccaagttatccagcccttgctttagcatctgagccttatgtgatgaatacaccagccatgcagcgatatgcacctcgcctagacgaattaaaccatgcaaggatggatcctttggggtctgaacctgctatagttggtagaaacggtgcttttgaacgtagtgccctcccacctggatatgggagtaggatgccaggttttgcagctggttctcaccatatgtattcacgccagaattcatcagaccgattcaatggttgtcaatttcatggagttaaagccactaagccagcagttgcagattacgagcaacctttttaa

SEQ ID NO: 48705 - DNA, 1534 bp, Glycine max
  Peptide Sequence Number=SeqID_140390
ggatggaataataaactttaacccatcgggtatcgggtacgggtatgagaatatgttggggagtcaggataagagattggggagacaatacccgtacccgttctgtctcattgccatgtctacttatggtttcttgtcttccctactctacagtatacaaccacgtaaactgtacaattatgggtttagtgggtccctcgtgtgccaatcagctgccatgttggccacgttccttgtgtctgggcttgtgcatgagttaatctattatcatgttacacgtgtacctcccacgtgggaagttacgtgtttttttgtgcttcacggtgtgtgcacggtggcggaggtggctgttaagaaggtggttctccgtcgtggatggcggctgcaccgtgccgtgtcagggccactcgtggtggcattcttggctatctcagcgaattggctgtttttccctcaattgttgaggaatgaaatggataggaagtccagtgaagacttccggtatgcagggatagaaagtctactaaaatccatcggcaagctccagaatttggagaccttggatataagagagacaggtgtgtctgagatgccagaggagattagtaagcttactaagctacgtcatcttctgagtgactatataacttcaattcaatggaaggatattggaggcatgacatccctacaagagatacctccagtgattatagatgatgatggagtggtcattggagaggttggaaggctaaagcagttaagggaactgacagtgagagattttaagggaaaacacaaagagactctgtgttccttgataaatgagatgccactcttggagaaactacttattgacttgtacattatgtcacctatgtctacacttaggaagcttgtcctatgggggactttaacaaggttgccagattattggacttcacagttcccaaatcttgtgcaactgcgtttgggtggctccaggttgactaatgatgcattgaaatcactaaaaaatatgccaaggttaatgcacctctgtttcgttctcaatgcttatgaaggtgaaactttgcattttcaatgtggagggtttcagaaactaaagcaactgttcctccaaagtttggataagttgaagtccatccttatcgacagaggagcattgtgttctgtggaagaaattggtttagaatacctctcccaactcaaaacagttccctctggaattcaacacttggagaaacttaaagatctctttatcagcagcatgtcaactgaatttgagcagcgcattgctcccaatggaggagatgctgagaaccctagcccaccaaacctatctcagaaaaatgacgatctcggactcattaactgttggattgtcgtgacatttgagcaccacgttcgcaatccaattccaagaatttcaaccattgggaatttcgatatcatcaaccagaggaagaaattgaggaatcttaggaacttgctagagatgcctctatcgctttcggaaacacgtgagtccgcttag

SEQ ID NO: 48706 - DNA, 105 bp, Glycine max
  Peptide Sequence Number=SeqID_140391
atgtaccgtgtacctataccagcaccaccaaagagtattgcgaacctgggagttccatacactatctattggaaaaatgagaatgctttttacaggaaactctag

SEQ ID NO: 48707 - DNA, 228 bp, Glycine max
  Peptide Sequence Number=SeqID_140392
atgtgggaatcaggggcaggtcctttggtagccaaattcgtcccttcttgtggatcaagttatgaacaaaaagatgtcaatactcaggatgatcctccaattggtggcgcagttcttcaaagaaaagagggcacaggacataaaggctcatgtaccgatggtgatggtggaggtgttggagaagaagatgacgagaggatgggaggagttcatcaattttctgagtga

SEQ ID NO: 48708 - DNA, 861 bp, Glycine max
  Peptide Sequence Number=SeqID_140393
atggtgatgcgcaattcatcaagcactttggtagatatagtgattgaggacactcacattatcaatggcaagcaggtggagattaagcggacgatactgaggggggctgctggctggaactcaaaaagactttcgaacgaaaaagatttttgtgggtggaattccttcgacgtgactaaaggtctgcaaccgtatgtgatcgttttccattgcgacgttccccaagccttaaaggatgagtatggtggttttttaagtcctcacattgtagatgattttagggactatgctaaactttgcttcaaggaatttggcaatagggtgaaacattggattactttgaatgaaccgaggagtgtgagcaagaatggctatgcaaatggctggtttgcacctgccaataataatgtccataggattatcccttcatgggctttatgccatcttattattcttgctgatcctctttttcttttcctcctcacttcggaagggcaggatgaatatgaaaatgatgggtttatagcggatgaggacgaagaggaggatgaagaagaagatagaacagaatctgatgataagccacagaagaaaaagaagaggaagaaaagggaggagtatgtccttgatgaagatgattatgaattgctggaggacaataatatcaatattcatcgatggaaggagagcaaaaagtttaagcggctgaaaaaaaaccggagggataccgaggaggagccctctgggctgtctgatgaggaggagtttgttgggagtggtaaagttgggcgaactgttgaggagaagcttaaacgcagtttatttggtgatgatgaatgtatgctcgatgtcagtcattag

SEQ ID NO: 48709 - DNA, 57 bp, Glycine max
  Peptide Sequence Number=SeqID_140394
atggaggagaagaccactggatcatccaagatgtgccccatggtcgtaagcatataa

SEQ ID NO: 48710 - DNA, 132 bp, Glycine max
  Peptide Sequence Number=SeqID_140395
atgatttcttgtctagccaggccccattacaagccaataaaagtccttagtgatccaccaaatgtaaatataaaaactggaggtgtaacaagcaaaaaggccaaaaaaattgaagaaaagaagaaaatctga

SEQ ID NO: 48711 - DNA, 738 bp, Glycine max
  Peptide Sequence Number=SeqID_140396
atgagagtgagagagaggcttaaacttaaagaacatcaaagaaagagaagaagagtgggttttgttttgtctgagtgtggaaaattgtccgagttaaaggttacttcttcctcttccaccttcgccgttctctcctttgtctttttaggcggcgccacatgtcagctgaacgtgcatgtcagcacaggacctggggtcaacagcgccgaccctggtgtgggagtgttcataggcggtgccgccacactaggaggattcggaggggttgtttcctccgggggcggtggagactgcagaatcggcggcggcggcggcggcggcaaagatgtgttattggaagatttcagaagccgcgcgcactcgaaaaccttgccctacctcttctctttgtcatcctcctgcctgaaatcgctgttctctttttcctcccgcacgaaatctgccggaaaccgctccgtcgacacccacattgtcgttggtcgaacccacagaaccccctacactgccggaaaacccacattgcccttgttggaacccacagaaccccctacactgccgaaaaacccatattgtcgtcgctcgaaccccacagaacccacattgtcctggctcgaagaaaaccctagatacactattgctactagggtgctgaaacaatcgtcggtgctcaaaggtcaaagctttctccgcaaggctccgctgacgtgtgtgtgttgctgggttctcttgatcaagtaa

SEQ ID NO: 48712 - DNA, 318 bp, Glycine max
  Peptide Sequence Number=SeqID_140397
atgttgaaagccatggttgttgacatgatttgtattagaggttactgtttcaataatttgcaagttgtttctgtacaggaaagtaaagggaaggttcttatcatgacaccaaccagcggcgaaggagctgagaagatggatgcagaagatgaagatttgtgggatgggaatgaagaaagtggagggtactggtcaaggatatatgaccgaaacaaggctcatacaaagccacttcttatgaaggggactaacaccacctcccagattgctattgtttgtgctaacctctgccctattgaaagccttgactatgagtaa

SEQ ID NO: 48713 - DNA, 417 bp, Glycine max
  Peptide Sequence Number=SeqID_140398
atggaggctaggaagcgggtcccgcatgtgttgtggcagcacaaggtactagagcatgttggtggaaatgtgtctcaatcctacactgtagaagaattgctgaaggatacgttgcacaagctatgcaaagaaaaattggagacacctcttcacaatgattcattgatagatgaaatgagaaatcacttgcgccacaaaaggtatcaatcactacttcggacacaggttgcggagttttgtcagataacttccttcattcaggcatttttttcgggttttggtggatgctgtacaaaagaatatgaagacgtaggtcttgaaatggttagaaagtgtgaacgtttacctctagcaattgttgcattggtggtcttttatatagcaaatgtcaaagtgcacttgaatggacaggtttag

SEQ ID NO: 48714 - DNA, 202 bp, Glycine max
  Peptide Sequence Number=SeqID_140399
gagccccagcccaacacgcgcgctaagcgtgcaaagcagcacaggcgctaagcgaggcgttaagctcgaagatgcagaacccgttacgcgcgctaagcgcgagccacgcgctaagcgcgcgatcccacagaaacacacgctaagcctgcagcgcgcgctcagcgcgcgttctgaacgcgctaagcgtgaggtgtcgcgctaa

SEQ ID NO: 48715 - DNA, 618 bp, Glycine max
  Peptide Sequence Number=SeqID_140400
atggcctcccgcaaacgtcgagtcgtgcctacattcggggaagcgtccacctgggactcttcccgtttcacatccgagattgcttggcacagataccaggacaacattcagctccggaacatccttccggagaggaatgtaaagcttggaccagggatgtttgataagttcctccaggagttccagaggcgcagatgggaccaggttctgacccgacttccagagaagcggattgatgttgctcgggtgaaggagttttactccaacctatatgatccagaggaccgtaatccgaagttttccagggttcgaggacaggtggtcagattcgatgctgagacgattaatgacttcgttgacaccccggtcatcctggcagatagagaggagtatccagcctactctcagtacctccgcactcctccagaccatgacgccatcctctccgccttgtgtacactagggggacaatttgtgctgaatggcccgactcatatatggcttggtgatgaagatggacctggacgtggacagcctcatttctcttctgatcagttagatcgcccagtccagcatttccaggctcgggtttccagcgttgatcacaacactgtgtga

SEQ ID NO: 48716 - DNA, 214 bp, Glycine max
  Peptide Sequence Number=SeqID_140401
atgaagcagtacagtacaaagagcaaattaccggagtctgcattgcaaccactgtatagagaggattttgatgtgccgcataatgcaacttcctcctatacttatgatgatcaggcatcaagagcagagcagtcggaggaaaagctggaggaatctcaggaaaccactagagatgtcgctatcgctgttggaaaacatgtgagtccgcttagag

SEQ ID NO: 48717 - DNA, 390 bp, Glycine max
  Peptide Sequence Number=SeqID_140402
atgccaaggttgttgttcctcattttaagagacaatgcttatgaaggtgaaactttgcattttcaatgtggagggtttcagaaactaaagcaactgaacctcggaagtttggatcaattgaagtgcatccttatcgacagaggagcactgtgttctgtggaagaaattgttttagaaggcctctcccaactcaaaacagttccctctggaattcaacacctggagaaacttaaagatctctatatcaactgcatgccaactgaatttgagcagcgcattgctcctgatggaggagaagaccactggatcatccaagatgtgccccgtgtatgtatttggagcagggatgctttagaaccttcgcatctattcggcagaagtcatcactaa

SEQ ID NO: 48718 - DNA, 816 bp, Glycine max
  Peptide Sequence Number=SeqID_140403
atgagtgttgtcaccattactgccaccaccatgatcaccagtagtggtgaccatgttggtggtgatgatcacgatgttgctggagctcatattggaccagagccaacaactgataggtttgttgttgtcatgtctggacctgatgaaagaagcattcctggcaatactattgctgtccaagcagacatgccatttagtggtcttacaacttttggtacatcatttttgtccaaatttgagtgttctcaaatgcctcatcctctattggagcacattacatttgttgacagccctggagttttatctggagaaaagcaaagaacacatagacaatatgattttacaggtgtaacatcttggtttgctgctaaatgcgatttaatacttcttctatttgatcctcacaaacttgatgttagtgatgagttcaagcgtgtgatatcatccctacggggacatgatgacaaaattcgagttgtcttgaacaaagcagaccaagttgatacccaacaactaatgagaatatacggtgcattaatgtggtcacttgggaaggtgttgaatgttcctgaagtcatgcgggtatatattggctctttcaatgacaagactataaatgattctctcagtggtccacttggaaatgaactctttcaaaaagaacaagatgaccttctttcagatttgaaagatataccaaaaaaggcctgtgatcgtaaaagcctacatgctttatatacttgcaccgctgctccacccacgggacacgccgcctcgatcacaatcaagaagactttcaatacaagggatccttag

SEQ ID NO: 48719 - DNA, 639 bp, Glycine max
  Peptide Sequence Number=SeqID_140404
atgggcccgaaatctaccctaaggctcatgagaaccctagggccgtctcttgcatctttggcccaatcttcttggagtcttctatccaatgcccttggggtctgtaaggagataaaagttggttggatgagtacgaaagaagggaaggaggaaaaggttgcagcaggaaaaggttgcagttccataacaagtgttggattatcacagcaatggaaaaaatataatgaatttctagaaatacacaaaaagaataattgcattaagggatgccctttgacccaatcaattagtaatgctcctgatatattgctccaaattctgctctccatgcctgatcgtcatatgtataggaggaagttggattgtgtgccacatcagaatcctctctatacagtggttgtagtgcagattcagttaccggctgcacttatgtctcactctcaatggagaaagaatgtagtgggaagtttgcaaggcaatggcgtttatgtgaaggggaaacaggaacatgaaaggacacaaggaaagggttctggtggtagacagaggaaaaagtccaagtctagaaaatgcaagaaagagaagagtgttacaaacgcaaccaaaaggggcatttcaataggtattgcccagagttga

SEQ ID NO: 48720 - DNA, 1170 bp, Glycine max
  Peptide Sequence Number=SeqID_140405
atgtatggtgaaattgaaaggttcatcaaagtatggatttcagccatcttaggtttatgttattgttattacatggctgcaagaataccaaagggcttcttgagacttctctcccttctccctattctctacctcttcatcatccttcccttgaacatctcttcacctaacttagttggatacacttccttcttccttgttcaacttggcattttcaagctcctacttttttccttcaacaaaggccctcttgccctatcacccccaaacattgtccatttcatctccatagcttccctccccatcaccccaaaacaacatccaccaaccaataaaaataacaccaccaacacccaaaagccaaaatggctattgcccttaaaattgcttatttttgcaatgatcgcacgtgtttatgagtacaatgaatacttccaccctcatttcatattagtcctttattgtcttcacttgtaccttggcttagagcttgtttttgctcttattgcaaccccggttcaaaccctttttggcttaaagatagaaccacacttcaacaaaccctacctttcgtccccacttcaagatttttggggtcatagatgcaaccttatggttagacatggcaagaaaacccataccggtgggtacccgcccgaatccttcccgactttgacagggatacccgatactcgacgggtactcgatgggtacggggatgggataataaactttaacccgtcgggtgtcgggtacgggtatggggatatgttggggagtcgggataagggattgtggagacaatacccgtactccccccgccccattgccatgtctacttatggtttcttgtcttctacgctctacagtatacaaccacgtaagcttgtgtgcacggtggcggaggtggctgttaagaaggtggttctccgtcgtggatggcggctgcaccgtgccgtgtcagggccactcgtggtggcattcttggctatctcggcgaattggctgttttttcatcaattgttgaggaatgaaatggataggaagtccagtgaagagtatctggctaagtttccttctagattagtcaaaggcaagatcgagaggcacagaagcgtggcaattaatttgggtagctataatctgctgcctgtagaacttcagaaataa

SEQ ID NO: 48721 - DNA, 330 bp, Glycine max
  Peptide Sequence Number=SeqID_140406
atgaaaagtggtttacgaaaagtggaccacaagatcacaacttgctcacaaaagagacgctgcaaagctcaaagtcttcgtctccgcgtacacagtgcactaagttacaaaatatcatctcaaacatcaagttttgcactcacaacaaaccaaaaaacagagctagctagcaagactaaaatggcagaaactgcagtgtccttggctggtcagcatgcacttccaaaaatattggaagctgtcaaaatgttgagagatctcccaaaagaagttagagacattacagatgaacttgaaagctttcaagatttcatcaatgatgcttgttga

SEQ ID NO: 48722 - DNA, 3494 bp, Glycine max
  Peptide Sequence Number=SeqID_140407
atggcatcttcagatgatgagggagaggctcaaccactatctgtgtcgaattaccattttgaagacaacaaagatgcgcctgtgtgtttttccgtgttgccaattcagtggagtgagtctcagagtccagttggcaagaaaatgcaggtgttcttgcacggttttgtggataatgggctgcagaaatttttcgtgcaagttgttgcatggaggtttgatctttcctatgtgaggccagagatattggtgctatcaaaggatggaagatggattaaactcgagaagcctcgtaagagctacgaggataccataataaggactattttgatcaccattcacttcctgagttatgtgaagaagaatcctgactcgtctgccaagtctgtgtgggataacttgagtaagaataaggagtttagatcttatgaggttatgccttcgcaaaatgatttattaaatcatatgactttaatgggtgaagctgccaaaagagacactgccttagcaaagtccaagcgctatttcatagcgaaatttctcagatccgcgattgtgattctgtccactattccggctgctatcaatgttgtggttgtgcttttgctcatggttctggaagataaggataagctgaagattaaaaaaccttctgacaaggaagttaaagatttagcacgacctggatttataattgatgatattgacaatgatatgattgatgaatttggtgaagattctgatggagaggatgagttgtttgattctgtttgtgcaatttgtgacaatggtggtcaacttttgtggtcatttcatgctaatgaggaggatggtgaagaatctacttgtgcctctcttggttttagccggaaggaagttgatgagatccagaacttttactgtaagaattgtgaatataatcaacatcagtgctttgcatgtggcacactaggctgttctgataaattttctggtgctgaggtcttcaaatgcgcttccgcaacctgtggtttcttttatcatccacattgtgttgcaaagttacttcatgggatagttgaggatgctccaaaggagcttgaggaaaaaattgctgaggggggaccctttacttgtcctactcattattgctgtgaatgtaaagaaatggaagacaagaagaaacatgattttcaatttgctgtttgtaggcgttgccccaggtcgtatcatcgcaaatgtttgccaagagagattgcttttgatgacatagaggatgaagatattataacaagggcttgggaagatcttttaccaaacaatcgcattcttatatattgtttagaacatgagatcgatgatgaacttgggactcctataagagatcatataaagttccccaatgttaaagctactgttcgagaaattgatgcagaggagaatgcaaagtctgcgaccaaagagagagttatattgaacaagaacaatattgactcaaaaaatttatttggcaaaaaagctactgctaaagtttctaaacttcctggtaaaatgtcttctgggaaagttggagacaagaagtctgaaaagatttctagatcaaatatttcaaggaagaaaataaacgaagcatcaagatgttttaatgaaaataagaggtcaacaatctcaaaggaaaccaaaaagtctgacggtgcagaaaacaggccatcattgggtgcaaaattatttgctttaaagcagaacagttctgagcatattaattctggtaatgaggctgatgatgtagccaaaaataccctggttgttaagcctactaaaaagctgagtagcacattgcccgcattagatgcagattcaaagaggagattgttggctttgtttaaagaagctacttcatcggttactttggagaatgttataaaagagcacaaatttgctgctactcatactcactcgttgaaaagtgttgtggagaagaccattacattggggaaattggaaggctcagttgaggctgttcgaacagctctaaggatgctagaggacgggcacaatattcgggatgcagaagctgtttgtggccctgatgttctaaaccagatatttaagtggaagaatgattttaattttgagatgagagattggatgactatccaaacaaaggagttgcctacagggtcacagttgatcatgggccttaatcccccctttggacttaaggcagctttggctaacaagtttatagataaagctctcgagtttagacccaagctcctaattctcatagtaccacccgaaacagagaggctagatgagaaacggtcgccttatgatcttgtctgggaggataagaggtttctattgggcaagtcattttatctaccgggatcagttgatgcaaacgacaggcagatagatcagtggaatgtaaagccaccaccgctctacctttggagtcgtcctgattggactgataagcataaggccatagctcggaagcatggtcactttatcagccagcgggggctgttaagaattgaaagctttgataaagaaaaatcaccggccagtcatactttggatgatagttctggtttcaatagcatgccaggtcatgatatcttgaatttgactgatgcacctatcaatgagggccagacgggatgctcaccacatggaaatgttgatcgagagagtcaagagagacagaaatatatggtgagaaaggctgataagacctcatggaagaggaaacgaagtgaggaaaacgatggaagaagactaggtgtgacctcaccacccaatccaattgatgggagatcctcagttgaaagttttcagctcagacctgacatgccacctcctgattatgagcttggtgataaaagttataggcatttggagcccacctcttcctcacgaatgggggggattagagcagcctatagcgggacccaaaattggccaagtgttgccaatcccctttatgattctgggattacagatgtaggtgaacaccatagcagccttccaagagacatcgccaatagcatcggatatagaccctatgtcagggaggatgagaactaccttagggaattagagacaaggcaacagactcgccattatggtattcagaatcctaattctgtgatgagtaattatctatctgtgcatgatcctgctaatagccaccacatggggccaagttatccagcccttgctttagcatctgagccttatgtgatgaatacaccagccatgcagcgatatgcacctcgcctagacgaattaaaccatgcaaggatggatcctttggggtctcgcctagacgaattaaaccatgcaaggatggatcctttggggtctcgcctagacgaacctgctatagttggtagaaacggtgcttttgaacgtagtgccctcccacctggatatgggagtaggatgccaggttttgcagctggttctcaccatatgtattcacgccagaattcagcagaccgattcaatgg

SEQ ID NO: 48723 - DNA, 290 bp, Glycine max
  Peptide Sequence Number=SeqID_140408
atgacaaatagtagcgtggagaatgccatgccctcaaccattgtctttgacatgctcgccagcaaaggtcttaaggtgaacttttctaagagcaagtttggagttattggagtggaaagggatgtagttgagagggacttaaagaaagtgtgtggaggtggagcccaaagtgattggtgtgactggagtatggttttggagttagggaagggtgatgcagcgaggaggttggcagcttctttgccacaagaccctgctgcacatttgtggcaacaaactagaatggaaag

SEQ ID NO: 48724 - DNA, 906 bp, Glycine max
  Peptide Sequence Number=SeqID_140409
atggctgataataccagaaatcaaacgcatattcgtgaaattgaagaacgtcttaatacgcgaatggaagaacgattcatggatattggagcttcgttacagcacaagatcgatgatatgtttcgacgccatgaaaattcctgctcatcaggttctagctcgttttcccgaccctattcgtgtaacactaggctagcacatttggattttccccgattcaatggcgaaggcatcaagaattggataatccagtgtgacactttcttttcgggtatcaaaccctcgaagagtacaaggtgcgcttggttgtggtccattttgaaggcaaagctctcaaatggaacagtgcatatgggactcgataaatttccctcatggaatgactatacgaaaatcttgattgaaagatttggtgaaattcaaatgatggttagaatgttccaaccaacctccgttatgaaagctttttccctagctaagatgtatgaaaatgccaatgccactagcatgcaagccaaaccactctctaaaaccttcaaacccaaccctgtagcaaagccaccactcttactaaaccctcccaaaaccttagaacctatgaaacctaaaacacaaaccactaaaccgctaacccctacctatatgagtgaaatgagggctaaggctgagaattttgactctgatgaagacctaggacctaatgaaaaccctcatgatgaaaccaatccaaaacccttgatttcagtaaatgccctaactggagtaaccaagttttggaccatgagagtcattgccaagaagctagggtgcaaaattgaagatatggatcctgttagtgtcactgtggctgatggggctagagtgcagattaatactatggtgaaagggttctcttggcttatatag

SEQ ID NO: 48725 - DNA, 231 bp, Glycine max
  Peptide Sequence Number=SeqID_140410
atgggtggtagcagtgtatgccacaaccgtgtcaactttaataaaaacttcgtaccccattacccagaggctcttcgctatgcgaaggtatgggggagggatattgtacgcagccttacccttgtatatgcaaagaggctattttcggatgcgaaggtatgggggagggatattgtacgcagccttacccttgcatatgcaaagaggctgtttccggattcgaacccatga

SEQ ID NO: 48726 - DNA, 582 bp, Glycine max
  Peptide Sequence Number=SeqID_140411
atgttcgctctttccagccaccaaaccacgatggacctctttgaagaggctgtatactactttacccagaacctatccaccatgaccaccaagacattggagatgaacgccaagcttgatgtcatccttaaccgcctatctgctttcacacccactccatcccctcccaaatcacccccacctgtggagaccataataatggaaccacagaacatagacaccaacctctcccgtcttagctttgatttcaccgccaccgcgttccacgttgacaacacatctctacaacccgtggacaccatgaagtcaccgccaacagatgattcgcgaaggtcacctaagaaaaggagaggaggtgccccctctgtcgatgacacaggttgcgacacaagcagttttgttgtcgtcgcggccaatatcgacatcgcacttcccgtccaagctgccccctctggtaacgaaacacgctgcggcgcaagtgattttgctgggggtgtttcgcactgtccaccaacattatcgccacgaccactgcaacacgatcccctacagcagtgtcatcctgcacagcgatgccgctaa

SEQ ID NO: 48727 - DNA, 108 bp, Glycine max
  Peptide Sequence Number=SeqID_140412
atggtgaagctcaggatggattttcctgctaatcttgttacagaattcagatttgattccataattgatttaaagaggacagaaatcagagatgacttacttctatga

SEQ ID NO: 48728 - DNA, 2169 bp, Glycine max
  Peptide Sequence Number=SeqID_140413
atggctatctctcgtgtacttgctatactcattcttcagtactcattagtagcactagtttcttcagctggaccacgaggtggctggaaaacattgcaaggatctccacctctggtcatagcacgtggcgggttttcagggatatttccagattcaagttcacttgcctatagtttgacactagatacttgtggcccaaatgtgactctatggtgtgatgtgcaattgacaaaggatggtgttgggatttgtttcccagagctcaagctggacaatgcctctgacatttccattgcttacccaggcaaggcaaaggattacttagttaatgaggtctcaacccggggatggttttctgtggactacaacttggcagaactagcaaatgtctctgttgttcagggggtatattctcggactaataagtttgatggtaacaagcttcccattcgcagtgttgaagacgtagctaaattaataaaatcaccatctacaggcctgtggctaaatattcagcatgattcattcttcaagcaacaaaatttgagtgtagaaaattttctgcaatccctccctgctaaaagtgtacctgtcaattacatctcatcacctgatgtggatttcttaagaagagtaaaatcaagctttagttctggaccaactggcttcatcttccggtttctcgagcagtctaaacttgaacctacaaccaatcagacttatggtgaactcttgaaaaatctcatgcttatcaagacatttgcttcaggaattcttgttcccaagggctatatatggcctgtagactcaggcctttatctacaaccacatacccctcttgtcactgatgctcatagagaagggctgcaagtttttgtatcagaccttactaatgatgttccatttagctacaatttcagctatgatcctctggctgagtgtctatctttcatcgatggtgatgatttttctgttgatggtgtgctgtctgacttcccagtaactccatctgcagccataaattgcttttctggcctaggaaaaaatgccaaaaaacaagtggacactttggttatcacaaaatatggagcaagtggagataatcctgcgtgtactgaccttgcatataatcaagctaaatcagatggggcagatgtacttgactgtcctgttcaaatgtccaaggatggaatacccttttgcttaagctctatagatctatcagagagcacaacagttgctgatacacaattgaaaaaccgtgcaacgactattcccgagattaaatatcgcagtggcatatatacattcagcttgacatgggatgagataaaaacattgactccctcaatattgaacccttatgagaaatacatattgtcccggaatccaaaatccaaaaatctaggaaaacttataaccttgtctgactttttgtccctgactgaaggctctcgcatcttgattagcatagagaatgcagcctatcttgctgagaagcagaatttacgtgtgactgatgcagtccttgatgctttacagaaagcaaaaccaagatcacataaagttatgattcagtcaactcatagctctgtgcttaaaatattcaaagataaatccaaatttgaaagggtttacaaggttgatgagaacattggcggtgcagctgactcggccattgaggacatcaaaacatttgctgatgctgttgttataggaaaggcatctgtttttcctgaaagttcagcctttctagttaactttacaaatattgtggcaaggctaaaatcatttaagctcccagtttttgtagaaactttcagcaatgaatttgtatctcaagcatgggactactactcagatccatccattgaaataaattcatttgtcattggaaccaaggttaatggcattattactgacttccccaagacagcaaatagatacaggaggaacttgtgtttaaagcatggcaatgaagcaccttatatgagccctattgaacctggcaaactttttaaacaaatttctaacttgtaccttccaccacttccccctcctctcccaatcttgactgatagtaatgtgacagaggcacctttgcctggtgtctctggaagagttccaactcctggagtaggagtagctccagcccccattacagcataa

SEQ ID NO: 48729 - DNA, 408 bp, Glycine max
  Peptide Sequence Number=SeqID_140414
atgaaaactaagaaagcatgtagcaagtggaaatacaagatattcaacgcttttagtatagtcaagctatttcggagctccaccgttggtcatagcacgtggaggtttttcaggatatttcctgattccagtgatttggcctatatttttgcagtaagaactggtttaaaaaatctcattgcatggtgtgatgtgcaattaacgaaagataggcaggggatctgcttaccagacatcaagcttgaaaatgctaccaacattaattatgcttttccaaatcgaagtcagacttacccagttaatggtgtaccaaccacggcttattttgctgtggattataccctagaggatctgcggtcctatgtcgtctgtgacatattaaaaggcgtaccggttgatagttcttaa

SEQ ID NO: 48730 - DNA, 306 bp, Glycine max
  Peptide Sequence Number=SeqID_140415
atgggaattgggaagcctgcaccactcaaagtagaagagaagctgcaagcacagggttgtgctcctgattcagtcccagcaatagggctagatggggctattttagaaagaggaggcaatggtggttctgtcacttcagcttctgtcaggggaggggcaggagccaaagccgaaggcctaaccggaggtggtctaaacacaaatgatagtcatagagttggagttggaactgaagcactttcagcattaggagttagagttctttcaaaattagctagaggttgttcaacttctggaatatgttga

SEQ ID NO: 48731 - DNA, 1152 bp, Glycine max
  Peptide Sequence Number=SeqID_140416
atgggagacaatgttgtagtgtccaatatggagctagagaggttgcttagcatgaaaggaggcaaaggagagggaagctatgccaacaattcccaagcacaggccatacatgccaagtccatgcatcaccttctcaaagaagccctagatggagttcaacttcaagcccctaacatgccatttgtggttgtggacttggggtgttcatgcggaagcaacaccatcaatgtggtggatttgatcatcaagcacatcatcaaacgctatgaagccttgggattagacccacctgagttttcagctttcttctctgaccttcctagcaatgacttcaacaccctctttcagctccttcctcccttggccaactatggagtaagcatggaagagtgccttgctgccaataaccaccgctcctactttgccgccggagtacccggctccttctaccggagactatttccggcaaggttcattgatgttttccactcagccttttccttgcattggttatctcaggtgccagaatctgttttggacaaaaggtcaagtgcatacaacaagggcagggtgtttatccatggtgctagtgagatcaccgcaaatgcttacaaaaatcaattccaaacagacttagcaagcttcttgagatcaagggcagtggaactgaagagaggggggtccatgttcttggtttgcttaggcagaacttctgtggaccccacagaccagggtggggctggcctcctctttgggacccactttcaggatgcttgggatgatcttgtccaagagggattaattagcagtgagaaaagagacagtttcaacattccagtgtatgcaccaagcctgcaagacttcaaggaggtggttgaagctgatggttcatttgccataaacaagcttgaggttttcaaaggtggaagtcctcttgtggtgaaccagccagatgatgatagtgaagtagggagggcccttgccaacagctgcaggagtgtgtctggtgtccttgttgatgctcacattggtgacaagcttagtgaagaactgtttctgagagtggaacgtagagccacaagccatggcaaagagttattagagcaactacagttctttcacatagttgcatccctttcttttgctctatga

SEQ ID NO: 48732 - DNA, 1962 bp, Glycine max
  Peptide Sequence Number=SeqID_140417
atggatcgaaaggaaaaaccagttgtcgggatgcacttcaacaactgtggatgggacaatgctggtgatgacgaaggagtatggactaaggtgattagtaaaaagaccgcgaaaggtttgaagaagaccctgaaggctgacaatcaaacgcagcacctaggggcaaggggtaaacctacacgttaccatatcaaatggagggacaaggatgacattacgtcatactgcttcacccattttcctgaggaagctgatgaagagttgttgtggaagcattttaaaaaatggggtgatgtgagagaagtttacatagcgaaaaggcgcaatagggaaggtagaagatatggttttgtgcgtttcaagggagtctcgaacgcaaaaggtttggaggtgaagttggacaatatcttcatcaatgagcataaactgtttgtcaacttacctaggttcatgaggacagcaaggactgaagggatgcagcaaaacactgttattggaagaaacctcattaacacgtttcccaaactctgcgatgctcccacagatccctatcggagatcgtatgtggaagtgacgactatggggaagctttcaggccataagaggagcaacgaagctgtaataccatctataatgcttaccccatttctcggagatgacatgattctcttctctggggtatcggatgaaaaagcccaactcatcatccaaacggagaaagagagtggcaactcactcttctactctctggagaaatggaggtcggggtgtcggcctaacaacagggtggtttggatccaagtatggggctttccgttagaggtctgggaagtcgaacacttcaagaaagccatctccttcatcagcaatgtcattgagctggacgacgacacagaggaccgccgaacgcttgaccgtgctcgaatactggtgaggacacctctcccgccgtcgataaggagagaggttgttgttcgagtgggtgagtttgagtactgggtgtggttcgtggaggagacagggacacatggcgggacgaagcagaaaggattgtctccgtccgacgactggtgggaggagataacttcggatgacggcggagacattggcagcgccgacgacgataaggatactaacttatccttctcatcggaattatccaacaaaccaattttccgcaataaccagtggtcaggggaagagactgatgggtactgccgtgaaatcggtccaacgggtatcgaagaggagattcatgatcctgatttggcaaaggttaaccttgaacctagcagggcagcaacggataacgagaaggttttcactaaaatggcaacctgtgacatggctcagactgttgctcaaaaagaaaacagtcaacaacaaggaaataatttgaatgaaagagataaagtgacttctgaaatatattataatggggaagcagaaggagaaataaggtgccttcaaccccattcggacctgtaccccaagcagtctagtgctggtgttgggcccagtcataacttgggcccattattgatgtctgagaggtgcaataagaaaaaaaaatttcttgcagcccaacaccctaaagagacaccagataaatactctaaagtctatgttagacaaagacaccccctgaataaaccccgtaacatgcaatctgtggaaaagcaactccatttacaagaagaagatgatgacatggaggccattactgataaatgcgacaagacccacaacccgagccagcttgaggcagacagcaggttaaaaagcaagattatatgtaccacagaggtgatggaggaggcccaccaactatgggatgttggaaaaagaataggcatggaagctgaaacagaacactctgaattcattcaacactatgctaatatggaatccagggacagaaaggaagctatggagttggggaataggaaagttcatacatga

SEQ ID NO: 48733 - DNA, 1113 bp, Glycine max
  Peptide Sequence Number=SeqID_140418
atgacctccagaaagaggaaagccacatcatccctaccccaggagccctatgataccaccagattcacttctgagggggcctgggaatgttattcacagaacattcactcccaaaatattcttccaaagaggaatgttaatctttttgtcatagagtatgatgaattccgtcgggagctgatcaggcggaactggcacaaggccttgacccagttcatggacaggcacattgatgtggccctagtcaaggagttttactcgaacctgtatgatccagaagacaaatcaccaaaacaggttcgagttagagggaggctgattaagttcgattcgacatcattgaatgcctttctggagacaccaccactcatccagttaggggagcagtacccctcatatcctctcttttgcaggtcgtgcacagatccttggaagcttgcttccaagctctgtattccagggcatgaatttgttttaaatgctgaaggagcgccctggaagctcttgaggaaggatctgacgacactggcccagacttggagtgtgttatcatactccaccctcgcccccacttctcatacgtccgatttgaatatggatagggcgaggttaatctatgggctagttatgaagatggacatggacgtgggcttcctcatcttgcatcagatttctcagatggcccagtcgacctcctcgaggctcggctttccagccctcatttcgcactctgcgtggcccaaggagacccgcaaggcacaggctcaaggatctgagggtccatcttcctctgctacccatgctcttgctccccctgcatctgctccttctccagctccagctccctctactccagcaccagctccctctgctccaccatcctcaattctagcatatatgcacgactcagatcaacatcgacctattgtcagcatggaggatttcatggcacaggaggctcaaccagagccagaggtacctcatgaggccactccagaggctactccatggacctcaccagtcacttcaccagttttggaggtctctgaggaggaagatggcgctgttgatgcgaattatgcagctgatatgaccgcagtgcagagcacctag

SEQ ID NO: 48734 - DNA, 696 bp, Glycine max
  Peptide Sequence Number=SeqID_140419
atggctgaagagcaactgagaagagtaacccttgaagaatactcaagttctactgtgccgcagtttttcattagcattgcgcggccagagggcaacctattccatggtttgcctaatgaagacctatatgcacatttagccacttacattgaaatatgtaacacaatcaaaattgctggcaacagtctaaagacttgggacaaagttgtcgaaaaattcttgaagaaatatttccctgaatccaagactgtagaaggaaaggctaccatctcttccttccaccagtttccagatgaatccttaaggagcaaaataaaattgaaaacccctgaagaagccatggaattaattgagaatatggctgcaagtgatcacacaatactgcgtgataggactcacatcactaccaaaagaagtctgctagagctctcatcccaggatgcacttttgcatagaacaagaggttgcagcatttgtggtggagctcacgagtctggcagttgcattcccattgatgattctactcaagaagtgaactacatgggagggaatcaacccaggcaagctgacaattcttccagcacttttggagcaaatacagagaaaaatccaaaggaaaaaggtaaagctattatgacccgcagcaagaaggcagacatagaggatgaggaaaggaggattgaggataccaaatag

SEQ ID NO: 48735 - DNA, 207 bp, Glycine max
  Peptide Sequence Number=SeqID_140420
atgaggtccttcaatggttattttccaccaaggagatgcagcagaaggcaaaggagaaaaggagaggggagacaccatccactagggaataagtcatggaagaaggagcttcaccaccaagaatgtaccttggataaaaagcttgaagaggatgctttaatggaggaaaagaaagagagaaaggggagcatgaaattgaaggaataa

SEQ ID NO: 48736 - DNA, 450 bp, Glycine max
  Peptide Sequence Number=SeqID_140421
atggtagatgtctttcctaatgctcttgcccttcatcacttcagttgcaaaacaattgaagagaatctgaggcaagtcaaagggagtgccctctataagatgggctccatatcaccttggggtcttagcctagttgggcccccacaaggagtgcctaatgtggtcttcaatgaagtagcctccaatgactttgtttctgtacaccttggcaatcctccaaaactcgcagatgagttcaagcaccaccaccttggggtctttgaaaaagtgatggatgccacacaacatgaggttggctttgatgacgtacccaacattctccaaagtttcaatgtcaaagaagtgtttgacattaactctaggttattttccctttatcatgacttctacatcaaggatggtcatgggtgcaggtcttgtgataagaataggggagtcgtcctcggatga

SEQ ID NO: 48737 - DNA, 384 bp, Glycine max
  Peptide Sequence Number=SeqID_140422
atgccaaggttgttgttcctcgttttaagagacaatgcttatgaaggtgaaactttgaattttcaaagtggagggtttcagaaactaaagcaactgcaactcggatttttggatcaactgaagtgcatccttatcgacagaggagcactgtgttctttggaagtattttctttacgaaaactctcccaactcaaaacagtaccctctggaattcaacacttggagaaacttcaagatctctatattgaggacatgccaactgaatttgagcagcgcattgctcctgatggaggacaagaccactggatcatccaagatgtgccccatgtacgtatttggagtgaggatgctgaagaacctttgcatatattcggcagaagctag

SEQ ID NO: 48738 - DNA, 198 bp, Glycine max
  Peptide Sequence Number=SeqID_140423
atggtggctacaaaatgcagcgttttaggggccaagtgtcccgccaaagagttaaggcttagttgggccgggtatggttccagtttagtgagtgaggtaacgggtgaggttatatcggggtcaggatcagatttgttatgcttgtctcctactgcccgacaagcctcaagcaaggatgattgcactgctaattcctaa

SEQ ID NO: 48739 - DNA, 1149 bp, Glycine max
  Peptide Sequence Number=SeqID_140424
atggctggtttagttagaactgggggaaagggcaccgtgagaagcaacgacgtagaaaacacaggtttctacatcgatcgtagactaaccgatgtagaaactagtttcgcattcaacgacactactttcaaagacagtcgtccaccgtctttgaaaatcgttttccaccgatatttgccgagcaatgtcagatcctgcttattatatttcggaatgtatccggaggactatgaagttagatctgatagattgattggacattggatagcagaagggtttgtcaaacatgaaactggaaaaactttggaagaagttgcccaacaatatttatcagggttggtcgggatagaaattctaccaaaatccattggtaagctccagaatttggagattagtaggcttaaaatgctacgtcatcttctggctgattctacgtgttcaattcaatggaaggatattggaggcatgacatccttacatgagatacctacagtgactatagatgatgatggagtggtctttagagaggtagaaaagctaaagcagttaaggaatctgatggtggtaaactttaggggaaaacacctaaagactttgtgttccttaataaatgatatgccactcttggagaaactagctattggtgcagctgatgagagtgaagtaattgacttgtaccttatgtcacctatgtctacacttaggaagcttgtcctacgctccaagttgactaatgacgcattgaaatcactaaaagatatgccaaggttaatgttcctctgtttcgctcacaatgcttatgaaggtcaaactttgcattttgaacgtggatggtttcaaaaagtaaagacactgcacgtcatatgtttggataagttgaagtccatccttatcgacagaggagcactgtgttctttggaagaaattgttttacgagacctctcccaactcaaaacagtaccctctggaattcaacacttggagaagcttaaagatctctatattgtggacatgccaactggatttgagcagcgcattgctcctgatggaggacaagactactggatcatccaagatgtgccccatgtaggtatttggagcagggatgctgaagaacctttgcatatattcggcagaagtcatcactaa

SEQ ID NO: 48740 - DNA, 690 bp, Glycine max
  Peptide Sequence Number=SeqID_140425
atgaatttttattttaattttaatgctagctgtagtaccgaaggttctagagagagagtacgaagaggaaaagacggaggtagctccgcttccaaatgcggcctagccggtggtagtactacttcaacttcaggaactggtccagatcggacttcaccttgttcttcagctccgcgtccatcgccactcaccggcgtcggagttcacaacgagcgcgtcgccggaggcattggtccaggagagcctggcgccaaggaaggtatcatgaacggtgtggttatggtcaaggtggaggaagatgtcgaagggattggggtaatcagaatcttcaacagagggaagagaatcgagaatgactatacatttatccaggagttgtttgctaggctaaaatcgccaaccacctctcaagaatcaaagaagaacttggtatccaggggtgaatttgctcgatttgttgctgataaaaagagcctcaaaagcctcaagatggaagattgttctaaccttggagggcctgccatagattctgttgtctggtatgatggagaggtttggagggttcctcttgacacacacagtcttgatgatgatccagattgtgggaagcttgctaactttatacccttaaccaattataggcaagtgatgatgaagggggcgtggcagactaggggagcagagctgtag

SEQ ID NO: 48741 - DNA, 123 bp, Glycine max
  Peptide Sequence Number=SeqID_140426
atggtggttgaagaagaaaaacctcttcccaacaacctcctcttaacggcaacaatggtgacaaatggaaacgccggtgaggcgagcaagaagaagacaaaaacggctgagattaagatgtaa

SEQ ID NO: 48742 - DNA, 505 bp, Glycine max
  Peptide Sequence Number=SeqID_140427
atggcagaaactgcagtgtccttggctggtcagcatgcgcttccaaaaatattggaagctgtcaaaatgctgagagatctcccaaaagaagttagagacattacagatgaacttgaaagctttcaagatttcatcaatgatgctgataaagtggctgaagctgaacaagatgatggaaggcgtcatagaataaaagaaagggtgatgcggctgagagaagcagcttttcgcatggaagatgtcatcgatgaatataacatctcctctttactatgtgaggctgttgccttcatcaaaactcaaatccttctccttcaaagtgcgtataagattcaggatgttaaatcccttgttcgtgctgaaagacatggtttccaaacccattttcctttagagcaaagacaaaccagttctagaggaaatcaagatatcacatggcagaaaattagaagggatcctctctttattgaggaagatgaggttgtggggcttgatggccctagag

SEQ ID NO: 48743 - DNA, 849 bp, Glycine max
  Peptide Sequence Number=SeqID_140428
atggcagaaactgcagtgtccttggctagtgagcatgcgcttccaaaaataatggaaggtatcaaaatggtgagagatctcccaaaagaagttagagacattacaaatgtcatcgatgaatataacctctcctgtgaggataagcaacctggtgatcctcgatgtgcagctttactatgtgaggttgttgccttcatcaaaactcaaatccttctccttcaaaatgcgtataagattcaggatgttaaatcgcttgtttgtgttgaaagagatggtttccaaacccattttcctttagaaccaagactaacaagttctagaggaaatcaaaatgtcacctggcagaaacttcgaatggatcctctctttattgaggaagacaatgttgtggggcttgatggccttagaggtacattgaaaaattggttgacaaagggaagagaaaaacgcactgtcatctctgtggtgggaattcctggggtgggaaaaaccactcttgccaagcaagtttttgaccaggtgcgtaacaatttcgagtgccatgcattgatcacagtgtctcaatcctactctgcagaaggactactgaggcgtttgttggatgagctttgcaaagtgaaaaaggaggaccctcccaagggtgtttctaacatggagtcattgaccgaagaagtcagaaaccgcttgcgcaacaagaggtatgttgtcttgtttgatgaggtatggaatgaaacattttgggatcacattgaatatgctgtaattgataataaaaatggaagtaggattttaatcacaaccagggatgtgaaggttgcgggatattgttggaaatcatcatttgttgag

SEQ ID NO: 48744 - DNA, 431 bp, Glycine max
  Peptide Sequence Number=SeqID_140429
atggagaacaacagccttcgatgtttacagtgcaatggagaagagagcgcgaaagggttcacagagaagaagaaagcgagagaggtgctaatacacgacatgatccttagaaaagtcaaggatacagaattttgtcagtatattgacgggcgtgatcaatctgtatcaagaaaagatgaagaagtatctgaacacttagtaaacaaaatccctaccaattacatgctattgaaggtactagattttgaagtgattatagatgatgatggagtggtcattggagaggttggaaagctaaagcagttaagggaactgttggtgctagattttaggggaaaacacgaaaagactttgtgttccttaataaatgagaagccactcttggagaaactagttattgaaacagctgatgtgagtgaagtaattgactg

SEQ ID NO: 48745 - DNA, 1482 bp, Glycine max
  Peptide Sequence Number=SeqID_140430
atggcaccctcaattgttttgtctctactaccccttcttctggtttcaacttgttgttatgcgcaaccccttgaagagggttttatctctggggtcatatctgacaagggtcttgaatatgccaaggagttgttgatagagaaaggtattgcctccattgttatgcttcagctgccagagattgagaattctgcccaagtccctttggttggaaatgctaaagtggttctttctgacatcacaatcaaggatgttgaagtcaattcttcatctgttaagactggggagagtggcattgttctagtgatttcaggtgccattgctaatatgagtatgaggtggaggtacactgtcagctcttggttaatcccatttggaatttcagatagtgggaatgcttcagtgaaggttacaggtatgcaagtgggactcacagtaaatataaggaaccaagaaggaactcttaaattggctctcttagattatggatgttatgtgggagacttatctataaagttggacggtggtgcatcttggctttaccaattgctggtagatgtttttgaaggggatataacatctgcagttgaagagggtatttcagagaaaataaaagaagggataatgaatcttgatcattttttgaaatctcttccagagcagatctcactagacaaaactgctgcactaaatgtttcttttgttggcaatcctgtgttgagtaactcctctattgctattgcaattaatggtttattcacagggaaaaatgaagttttagtacctcaacgttactaccagaaaggaatgaagatttctgctgcctgtggtggtttacaaaagatgataaaggtttcaatacatgaaaatgtgttcaaatctgcttccctagtttactacaatgcaggtaaaatgcaattgattattgatgaactgcctgatcaggacattttgaacactgctgaatggagattcatagttccccaattatacaagcgatatccaaatgatgacatgcaacttaatatctctatatcttctccaccagttatacaagtgacctaccaagacattggtgcaactatttttgtagatataacgattgatgttctggaagacggtgaagtcatacctgttgcatgcatctcagtggaaattagtgcttcatgtgctgtggaaattgaaggaaacaatattgctggttggctcagattacaaacattttctgcatacttgaagtggagcaaaatagggaaactgcacgtgcgtctgatccagtcactaatgtcaagtgtcctcaaaactgttgtccttccatacctgaacttcaaattaaagagaggattcccattaccaattattgatggttatggctttcagaatgcaattatcttgtacaatcatccatggattatggtgtgtagtgatgtttccttcttagaagattactatctaggtcaacagttagcttatgtttcataa

SEQ ID NO: 48746 - DNA, 282 bp, Glycine max
  Peptide Sequence Number=SeqID_140431
atgctggagttgcactgccccgaagttgcaactagacaagtacttcggtgggtttcgaacttgaaacccttcctccattgtcatgacttaagaggcttcagccactatgggatatctgatggtgaagctcctggagagcttcccatggccgaaggtggtcatcaagtccacgtagcctctgatcttgactctcttgcttgtaaagctgaggagtggaccaacgcgagagtggagagtgttaggggagacctcaaatttctgaaaggtttttcaattgtgtaa

SEQ ID NO: 48747 - DNA, 804 bp, Glycine max
  Peptide Sequence Number=SeqID_140432
atgatagacgcgagctgggttcgaggcccagaacctcctaagaagaaaggaacgcagagaacagagaaggaaaagattacaagcataacgaaaatggtattgctgccccctgaggctcgacaacaatctcagcagattctctattctctattccagctcagcttggtcacgcataatctttcagtgaaggatagtattggaggcatgacatctctacaaaagatatcttcactgataatggatgatgaaggagtggtgatcagagagttaggaaagctaaagcagggaatcatttatacgaacttggaagaattcattatcaacttctctcaactccaacagcttactaaggtgagcaagggaaaaacttcgtaccccattgcccggaggctcttcgttatgcgaaggtatgggggagggatgttgtacgcagtcttacccttgcatatgcaaagaggctgtttccggattcgaacccatgaccaacaagtcaccaaggcacaactttaccgctgcaccagggctcgccctcatactaagtttgaagaactaggctttttcgaaaagggtgataatcataattttccaccagtcctaagccctgactatgtctccatttcacttcaaattgcttgtggcaacatgaacaagaaaccagaagcagacaacaagaaagcagaaacagagaagaaaatggcaatatccagcaaaccggagcaaaggacaaatagggcaatgcagcagcaaagatcttgcttgggttgtgcttgtctcatttcatccgacaagaataacaaattctga

SEQ ID NO: 48748 - DNA, 1095 bp, Glycine max
  Peptide Sequence Number=SeqID_140433
atgattattggtcatctctttttccagattactctaaaactagaacccctcttcaagcgatccatcacttatgtggaaaaagatgattcagatttgggagaccaagctgctgcttttggagatgcacatgagtttggagatatactgtggtacccaagtcaacgcaaggttctctatcgtgttgatgatcgtgtcccaactaatacatcgggaaatggtctttacgacattatttctttccgtcccactccttcaaatacgtcggctttcataagaaccagagaggatattcaagaatccactaaagatgccaatggaaagtgcatagatgcaactaccacaacggacaccttcatcaccgaagcttatggtcttactaacaatggtataatcttcactggatacccagtaattggatttcaaaaccgccttcaatcatctgggtcatgcttggatagtcctcaagacgcattgaacacaacatgtgcctgggatccgagggtgaaaggcttgttcttttaccaaaccgcatttagcattaagttgtcctttgtaaaaagctttattgaagatgtgcaaaagctagttgaattggagccaaagggattatgtgtcttagggctttacaatggaatgttaatgcgctatgtcacggcttcaagtgcctacttggggcaccaagaggatgctttagacattgatatcacctactaccgtagcaaagacccaatggctcccaggctttatgaagacattcttgaagagattgaacaagttgggattttcaaatatggagggctacctcattggggtaagaatagaaacttggcgtttaaaggagtcatcaagaagtacaaagatgcaaagaaatttttgaaggttaaagagaagtatgattcgcatgggcttttctcaaatacgtggacagaccaagtgttggggctaaaagatggagtgacaatactgaaggatgggtgtgcattagaaggtttgtgtatttgctcccaggatagtcattgcaatccaagcaaaggttactattgcaggccaggcaaagtttacaagaaagcaagggtttgtactcatttgaaatga

SEQ ID NO: 48749 - DNA, 141 bp, Glycine max
  Peptide Sequence Number=SeqID_140434
atgtatgatgatgatgactttttgagttttgtcatgatgaaaaatgagaatgatgttaagaattttgttcagaagctgcttgagaggcttgtgaagcagtaccagccactgttgctgccacacttgttgacgttgttgtag

SEQ ID NO: 48750 - DNA, 192 bp, Glycine max
  Peptide Sequence Number=SeqID_140435
atggaaagaaaaaggaaggagagagagagggtcatgcatggaatattcgtgtggtctcagagtttttttgtgaatggtgttgttgtgaaagagaaatgcgttgttgttgttggttcgttcaaaggagtgttgtatgttactgaaacgttgtacttgggtgcgacaattcagaatggggaagacgaagagtga

SEQ ID NO: 48751 - DNA, 1332 bp, Glycine max
  Peptide Sequence Number=SeqID_140436
atgccggaaaacatgagcatatcagtgaatggtcaatctcaagtccctcctggcttcaggtttcatccaactgaagaagagcttcttcagtactacttgaggaagaaggtctcttacgagaagattgacctcgacgtgattcgtgacgttgatctcaacaagctcgagccatgggacatacaagagaaatgcaaaataggaaccactccgcagaatgattggtacttcttcagccacaaagacaagaagtaccccacaggaacgcgcaccaatcgcgcaactgctgcagggttctggaaggccactggccgcgacaaagtcatctacagcaatggaaagaggattggaatgagaaagactctggttttctacaaaggaagagcgccacatggccagaaatccgattggatcatgcatgaatacagactagacgacaacaacaccagcgacatcaatattgtgtccaatgtgatgggggatgctgctcaggaagaagggtgggtggtgtgcaggatattcaagaagaagaaccatctgaaaaccctagacagccccttagcttccggggaaggtagaaggagccacatgttcgactcgtgcgacgagggagctttggagcaaatacttcagcaaatgggaaggggttgcaaggaggagagcagctatgaaggcaactacaacagctatggaaggtttgcaatggggttgaacaatggcggcggcggtggatacaatgataggttcatgaagctcccgagcctcgagagcccaaaatccgcaagcatggagaaccaccacaacaccaacaacaactgcaacaataacatgaagagtaataataataataataataataataacgggtaccatcccataattccagtagagatgggcacggacaatgaagggacattcacaacgcaccaggtgagtggtggtgacccaaacaacaacaacaacaacagcaacattgttcatccattggaggtaggatcaggtggtggaggcctcaccaactgggctgcgctggaccgtttagttgcatctcaactcaatggccaaaccgatgcctctaggcaactaggatgtgctttcaacgaccccaccatgtattgcaccagcgtcgaccatcatgatcttcatcatcaaatccccaccctccgatcctcatcaacgtccgctaacacacgaccttcccctgcacccgcattcatcaaccccccaacacaggacttcaccagcgagattgacctttggaacttctcccgatccacgtcctcactgttggcatcctccgaaccactgtgccacgtgtccaacacgtcagtgtag

SEQ ID NO: 48752 - DNA, 429 bp, Glycine max
  Peptide Sequence Number=SeqID_140437
atgcactcctctttgtcccataaatctattgaaaatgtcatgaaaaaatgtttctcccgtggacacctccctcccatacatggggtcctcaatgagagaaacattgacgttgaggaaattgagcagggccatttcggcattgtgaaagtgagggtgggagtgaaggtcgtgggaaagaaactcaggggagtgtatttttctggatattttagaggaaaaggtttaaaggggagtgtattaaaggaaggtgcaaataacaaccttctcattttagtaatactagtgtatagtccagtagcatcaccagcccaacgcaagcctggacttgcattcacccgccattcaactccatggcatttacttcttgcatgcccatacctgcttcctgcactgcccaattttttcaatatctctaaactacccttctga

SEQ ID NO: 48753 - DNA, 600 bp, Glycine max
  Peptide Sequence Number=SeqID_140438
atgggaaactgcgtgttcagaggtttgaaccacggcgtgtccgaagacatgatggtgaaggttgttacctcaaacggaggcatcatggaactcttctctcccataaccgtggagtgcataaccaacgagttccccggccaaggcatcttccggagccgccgcgacatgttctccgaaccgctcccgaaaaacgaggagctccacggcggagaagtctactacctcctccctctcaacccttcttcttctcgcaagagcttgacaagacaattctccgacaccgcggccacgttaacaccataccgaatgtccacgttcgagaaaaataacaataacaataacaacaatgtgtactcggaaccacccgagttgatttcgagatacaacagtagtggggtgtggaaggtgaagttggtgataagccccgagaagctgtcggagattttgtcacaggagtcgcggacggaggcgttgatagagagcgtgaggacggtggcgaagtgcggcaacggtgcgccgtcgtcggtggcgaactccgaccagtggagtgtggcaagcagttggaaaggttctatgtcggagaagatgggtttacaatag

SEQ ID NO: 48754 - DNA, 330 bp, Glycine max
  Peptide Sequence Number=SeqID_140439
atgccgaggagcacctcctccaccaatccgtccgcaatgacagtctcccactcggagcttgaggacgtcctcgcgcttcttgttgatcccagcctaagcggcgctgatggagttggtgtgataggtgaagagtggggttggagaatcgagattggaggccagggtggtggcacgatgacgaggcactgtgggtggggagtcgaggcagaggttggtgaagtactgatcggtggcaacaccaaaagtgaggggggacttgacggagaggtagtggagatgttaaaagtgatcgaagccaccgttgggtggattgacattcgtgagtggtag

SEQ ID NO: 48755 - DNA, 1479 bp, Glycine max
  Peptide Sequence Number=SeqID_140440
atggagctcgacctccgttcgttccttcactctcccacctcctccgacgacgctcctcaccgcaccatcgatgatattctcaacgactgtgacacttcctcttcctcaccctcccctccttcttctccctctcactcactctccaacaattcccatcctcaaaactccacactccaacccgcacccgattcgttttctcggttcaaacccactgaattctccgaccgtgcacgcgtttcgcgcccgttctcctctctactccacagcgtcaggtccaatgccaagcccggcgcggcgctcgccgcggcggcggcggcatctcgatccgttcctacgccgcacgcggcggcgatcatctcccggaggaaatccgcggccgcgatcagcgtcgaatcgagtttaatcgctgccaacggcgatgattcttccgctgtttctgccaaaggcgaattgggcgagcctagcgagaaattcgatccagtgccgccgatgattcctccgcctagtgaaagtgcttctgctattggtgaacgttttgagagtgatgtggaaattgccactgatttgaaggctggcagtgatgacattcaggtgcacagtgataataatattaatgctaatgttaatgatgatgatgatgatgaaaatgataatgattcttctatcgtgagtgaggagaagagggacttagataaagttgactgtgatcatgagaaggatatgaattctgcaccgtttgatgaagatgatgatcgtgggtttgatggaaatgatgatgatgatgagagaatcacagctacgtatgcagctgtggaaacagaagaagaagaagaagaagaagaagtagtgaataatggtagtagttctatggaagatgttaggaatgaggtgagtgttggtggtggtgatgatgatggtagttcattaggtgatgttgctgagctagtggaagagaggctcgaggaattggaaaacagaagggctgctaagagagccgagaagaaacgagagtctttgatgaagcctcttgaattggctgaggaactggagaagaagcgtgcttcaactggtttgcatttggaagagggtgctgctgcccagcccatgaggcttgaggacgttcggagagggtccatgacgttgggatactttgatgttgatgccgataatgcgttcacgagggcaatttcgtcccaaacattcaggcgtgagcaaggttccgcccgaaccttggcagttcatgctaattacattgcagtgggaatgtcaaaagggctcattgttgtgtttcccagtaaatattccattcaccatgctgacaactctgatggaaaggttgccgctatagtgatttgcattgcggaattcctcagattcgcaatcttgactccatctgctattgcggctgctatgggtgtcgaggttgtggcatgggtcctgcatcctcttgtcatctctggcaagtctcaagccaattaa

SEQ ID NO: 48756 - DNA, 738 bp, Glycine max
  Peptide Sequence Number=SeqID_140441
atgccacctaacagtaacactctctttcacactcacgccttcgttgttacaccctcttcttcttactcttccgtgcacaccctgaaactgcaaaaacctcaagtgaaacgattcgttttgctgttcgcatacccaaggcgttcgcgcacgtttctagaaccttctacttcttcttcttctttctctcctgtgaggaaaactaaggaagtggctgaagaatatgtttaccctcccgaaaacgatgacgttttggaggacgaagaagaacgagagaagaggcttggaaaagcgtgtgaagtgtacgtgtgcaacctgccccgaagctgtgacgcagcatacttacttgatatgttcaggccttatggaaccattctatctatcgaggtttgccggaatgctgagaataatgaaagtaaggggtgtagctatgtgacactgggatccatacactcagcaagaaatgcagttgctgcattggatggatcagatgttggtgggtgcgaattgcgggttagattttcaattgagatgaattctagaaggaggagttttaacaaaatgaactcttcaaccaagagaatttcatattatgaatctcctcataagctgtatgttggcaatcttgcaaagactgttagacccgaacagttgagagatctcttttgcagatttggaaatatagaattttatggtcgtacactaatcgttaaagagggtgtagagaggagtgaggactga

SEQ ID NO: 48757 - DNA, 1089 bp, Glycine max
  Peptide Sequence Number=SeqID_140442
atggtgaatgtgtcaaaagagttctttggtttgccggagagtgagaggctgaagaattactctgatgacccaaccaagaccacaagactctccaccagtttcaatgtcaagactgagaaagtttccaactggagagacttcttgagacttcactgccacccccttgaggattacattcaagaatggcctggcaaccctccatctttcagggaagatgtggcggagtatagtagaaagatgaggggtttatcactgaagttgcttgaggcaatctcagagagtttggggttggaaaaggattatatagacaaagcattggggaaacatgggcagcacatggccataaactactaccctccatgtcctgagccagagttaacatatggtttgccagctcatgctgacccaaatgcaattactattctgctccaaaatcaagtccctggcttgcaagtcctccatgatggcaagtggctaaccgtcaatcctgttcctaacaccttcattgtcaatattgctgaccaaattcaggtgataagcaacgataggtacaagagtgtgctgcatcgagcattggtgaattgtgagaaggagagaatgtccattccaacattctattgcccttcacctgatgcattgataaaaccagcaccacaactcgtagacaaggaacatcctgcgcagtacacaaacttcacatacagagaatactacgacaagcttgctaaaacgaaagcttctgtgtccataattcaaaggtaccaactgaaagatgcaattctggaaggaggtagtccattcaacaggatccatggcaaacacgtgtttgaggatttcaacatgaactcaagcttcaatcagcttttcatggcaacaatgaccaaccatgcgactttaattatgaacaagattgttgaatcctacaaggggtttgagaacatcaataagctggtggacgttggaggtggtcttggggtcactcttaacataatcacttctaaataccctcatattaagggtatcaattttgacttgcctcacgccatagaacacgcctctccctctcctcgtacgatctctaattcatag

SEQ ID NO: 48758 - DNA, 324 bp, Glycine max
  Peptide Sequence Number=SeqID_140443
atggacgcatactcctccggcgaagaagtggttgttaagactagaaaaccatatacaatcactaagcaaagggaacgatggacagaggaggagcataataggtttctagaagctttgaaactacacgggcgagcatggcagcgcatagaaggttacatgatgattggttttggaggagagttgttcccatcactagttgctagtgtctttagggaaaatgatgactttgaagggggaaaggtaatggggacatacattaggggaggtagtggtatagttgtggagtctgagttaggtgtggatggtgaagacacacaaatgtaa

SEQ ID NO: 48759 - DNA, 1509 bp, Glycine max
  Peptide Sequence Number=SeqID_140444
atgcagaatttactgttggcaactactgcagctacaccagttatgaaaataggggattttggttttgcaaggtctctcacaccccagggattggctgatacgctatgtggttcaccctattacatggctccagagataattgaaaaccagaagtatgatgccaaggctgatttatggagtgttggggcaatattgtatcaactagtgattgggaggccaccatttgacggaaatagtcaattgcagctttttcaaaatattttggcatctactgaactgcactttccgccagatgcattaaaagtgctacattctgattgcttggatctttgcagaaaccttttacgtcgaaacccagatgagaggttaacattcaaggcattcttcaatcacaatttcctacgggaacctaggcctaccgtgaatgttgagcagtttcaattacatcaatcagaaagattgacagatcatcaattaggtgtctctgcctccgagaagatttctcaatcacattctaagtatcatgttgtagataatccagtggtagtcagttcagctgctgatgaaaccatgctgttgcaaagaaaggatggcaagattacagctggtactaagagtgctaaagggtcaactccaactattgcaagtgataagctggggaaggctgttgatgctggtgctcatttgtcaaaccaacccctaggtttaattgtctctggatactgtgtagcattttcccatttaatggagtccattgagaaagattatgtctttgtcaattcccatttcgcatcattcgaagctttctctgactactttgaagcatctgtgcaaaatatttcctcacataggatttctctgttttcttctaagaggactaatatggaggttggacatgcaaaacaaacaaaggatctgcccttttcctccactgaagtattagaaaatttaaaaagcaataaacaggaggcatgtgtggcttcctgtgaatttgctgccttaaggaaagagaatggaatttcctcactgctcccttcaaacagattacagctgttgcatcagtatgtgcggatccttgctgaactttcacaagaaaagtataatacaggattgtatctagagtcgcttgcagttgagttggtggttttagctatatggaaaaagactctagaaatttgtagcttttggatggcctcaattacaaagagggcagctgagatgccagatgcaatggaaattatattccaaaaagctctcttaattgggacaagtggtgctgtagatgaatatatggagatcagagatagggctgctgcatcttactcaaaagcgatgcttctactttcatttatcgtgacagaagcagagaaccttccactgaacccaccattttcacttgtatccactaataaggagcgaatcttacaatatattcacagcttgcagtctcgtaaaaaatcttcagcggagtcctcttcagagaaagcacatacacttttatcaaagtaa

SEQ ID NO: 48760 - DNA, 1179 bp, Glycine max
  Peptide Sequence Number=SeqID_140445
atggggggaaagaggaggaagagcgatgatgatgatgacgtggaagctgaggcttcagcttcaggttggaagaagaaaacgagaacgacggagaaggaggagaaggagaagaaggagccattgcgtccttcgatgataaagaacaaggagaagcgatcggagctgcacgccaagctgaagcagcagaagaagctcgacaagcgcgccaaggccaaggctcgagacgctgctctcaagagagctctcgacctcggcgaggagcctccggagaagaaggttcctcgcaccatcgagaacacgagggaactcgacgagaccgtttgcaagcccgacgatgatgagttatttgctggaaatgatgctgatgaattcggttcaattttgaatcaacaacaaactcccaagatattaatcaccacttgccgcttccattctacttcctatgaagcacggacaccgcagtcccttgccgtgtccggtgtccgacacgcgtccatgtcagtgtccgacaccgacatgacacccaggggacctgcctttatatcggagttgctttcagttataccaaatgcacattacttcaagagaggaacatatgatctgaaaaagattgtagaatatgcaaagaagaaggacttcacctctgttatagttgttcacaccaatcgtagggaaccagatgctcttttaattattggtgtacccgatgggccgactgctcatttcaagctctcaaagcttgttttgcgcaaggatatcaagaatcatggaaatccaaccggtcacaagcctgagcttgtattgaataacttcacaacacgtctagggcatcgagttggaaggttgatacagtcactttttccacaagatccagaatttaaaggccggcgagtagtcactttccacaaccagagagacttcatattcttccggcatcatcggtacatttttgaaaccaaagaagttaaaaaaacagagtctaaaggtaaaaaggacaaagaaggcaagagtgagaatgttcccgaacagaaaacaattgcccgacttcaggaatgtggccctcgtttcacattaaagttgattagcctgcagcatggaacatttgacactaagggtggggaatatgagtgggttcacaagccggaaatggacacaagccgaaggaggttcttcctatga

SEQ ID NO: 48761 - DNA, 1332 bp, Glycine max
  Peptide Sequence Number=SeqID_140446
atgggtatagatttcatggttttggtgttatcagtgtcatggttttgtttgactagtatatgtgtctctgctacaaaacaagcatacccgccaacaccacaaccgaaccagaacttaaggtttgaccaaaatggagaattcaagatattgcaggtggcagatatgcactatgcaaatggcaagaccacaccttgcttggatgtgcttccttcccagaatttctcttgctctgacctcaacaccactgtctttcttaacagaatgatcaaagctgagaagcctaatcttattgtcttcactggagataatatatttgggtttgattcctcggattcagctaaatcattggatgctgcatttgctcctgcaattgcatcaaacattccttgggtggctgttttggggaaccatgaccaggaaggaaccctctctagggcaggggtgatgaaccatattgttgggatgaaaaacaccttatctaaattcaatcctccagaagttcatataattgatggttttgggaactataacttggatgttggaggagtacaaggcactgattttgaaaataaatcagtgctcaacctgtactttctcgatagtggagattattcccaagtttctactatttttggttatgattggatcaagccctcccaacagctttggttccaacgaacatctgcaaagcttaagaaagcatacataagtaaaccagtgcctcagaaagatgctgctcctggtcttgcatatttccacatccctctgccagaatatgctagttttgactcatcaaacatgactggtgtgaaacaggaaccggatggcaatggcattagctctccttctgtgaactccggcttcttcacaaccttacttgcagcaggagatgtgaaggcagttttcactggccatgatcacatcaatgacttctgcggcaatctaatgaatatacaactttgttatggtgggggatttggataccatgcgtatggaaaggcagggtggcctaggagagcaagggtggtggtagctagcttggagaaaacggggaaaggaagttggggagatgtcaagtcaattaaaacatggaaacgccttgatgatcaacatcttactggaattgatggtgaggtcctgtggagcaagagcactggtgctcaagagacaagggggttagtagatatggaagaatatcgtgctgtccacagaaagattttcaaggagcttaggaaaacagtattagaagtacaatctgagtttaaaagcatattactgtggcaaagtaaactatatacttggaagaagatgaatgtaaagaagagatgctaa

SEQ ID NO: 48762 - DNA, 69 bp, Glycine max
  Peptide Sequence Number=SeqID_140447
atggaagaaggagaaggaggaagagggggacataagggggtgaggaaccaatatgtatgctttgtttaa

SEQ ID NO: 48763 - DNA, 726 bp, Glycine max
  Peptide Sequence Number=SeqID_140448
atggcggagaaatcatgcatcaagcgccttcagaaggaatatagagccctttgtaaagagccagtttctcatgttgtggctcgtccttcaccgagtgatattcttgagtggcattatgtgttggagggaagtgaaggaacaccttttgcaggtggatattactatggaaaaatcaagtttcctcctgaatatccatataaacctcctggaatcagcatgactacacctaatggacggttcatgacacagaaaaagatctgtttgtctatgagtgactttcatccagaaagttggaatcccatgtggtctgtatcaagctttatactgatgttttcaatttccgaatgcagcatattaacagggcttctttcattcatgatggacaacagtccaaccactggcagtgtaaacaccaccactgctgagaagcagcgtctagcaaaatcttccctttctttcaactgtaagaatgctacattcaggaagatcttccctgagtatgtggagaagtacaaccagcaacagctttctgagcaggctgctccagagagggtctcattggatacgtctcccgacaagagttcaaggccagttttggaaaagaaattagaatccaatggagaagacatgaaaagagtagatgggttgaaggaagtcaccctgcacgtgctgcttgggtacattatgctttttagaatgggtaaattatatcagatcaaaccataa

SEQ ID NO: 48764 - DNA, 1599 bp, Glycine max
  Peptide Sequence Number=SeqID_140449
atgagagagcccagagatggagccaataacaagccctctaaagccgccgccgccgccgccgcatcaccgcctcagtccttccctctcattctcgacgtcgacgatttcaagggagacttctcgttcgacgcgttgttcgggaacctcgtcaacgagcttcttccgacgttcaaattggaggaatctgaatcggacggcggagatgctctcccgaacggccatctccgcgtgccatccaccgatgggtccaagtactcgcaggggattgtgagtccgttgtttcctgaggtcgagaagctcctgtcgttgttcaaggattcttgtaaggagctgcttgagcttcgtaaacagattgatgggagactctacaatctcaagaaagatgtttcggttcaagactctaagcatcggaagacacttgctgagctagagaaaggtgtggatggattgtttgacagctttgcgaggttggattcacgaatttcaagtgttggtcagacagcagcaaagataggtgatcatctccagagtgcagatgctcagcgagaaactgccagtcaaacaattgagttgataaaatacttaatggaattcaatagcagcccaggcgacctgatggagctttcacctcttttttctgatgatagccgtgttgctgatgctgcttcgattgcccagaaattacggtcatttgctgaagaagatataggaagacatggaatacctgtcccatcagctatgggaaatgcaactgctagcagaggattagaagtagcagttgctaatttacaggactactgcaatgaactggagaatagattgctttctcggtttgatgcagcatcacagaaaagagaattgaccacaatggcagaatgtgccaaaattttgtctcagtttaacaggggtacaagtgccatgcaacattatgtggcaacacgtccaatgtttattgatgtggaaataatgaatgcagacactaagctggttcttggtgaccaggctgcccaagctagtcctagtaatgttgctcgtgggctttcctccttgtacaaagaaatcacagatactgttcgtaaggaagctgcaacaatcacggccgtattcccttcaccaagtgaagttatgtcaattttagttcagagagttttagagcagcgaatcactgcccttttggacaaactgttagagaaaccatctcttgtcaatttaccttccgtggaggaaggtgggctcctattatatcttcgaatgctggcagtggcgtatgaaaagacccaagagctagcaagagatctacaagctgtaggatgtggtgacttggatgttgagggtaatgaattaactttaaatatgcctgtttttcttcattgcatattggtgaactcatctctaaaaggaacattggtttggaacatagatgcaaatggtctaacagagtccctattttcaagtcacaaggatgaataccctgaatatgagcaggcatctcttaggcaattatataaagtgaagaaaagttgtgatgattcaaagagtacaacaaagatcgccatttatagttatacagctttgatcataaaaactatgctagaataa

SEQ ID NO: 48765 - DNA, 627 bp, Glycine max
  Peptide Sequence Number=SeqID_140450
atggataaatactacaagcagcaaacaagaaacaacacatcatgtcaatccacgaagcaaccagatccatctaataaagcaatagataaacaaacaagagaaaacggtacctggaacaaaccttgcacgttgaagcgaaactccaaagatggaagggctatgattggaggcattgtaatagaaattcataatcaacgccttgacgaactcatagtaaagcggcgaaacctccaagtcatcctccacgacgaaagcgaactcgtgatcggaattgggccaccaggcctccagccactaggcctgcaggcccacattggccgttctgtaatgcacaaccttatccccaaacttccaatcgaagccatcgacgaactccagaattcgatgcgcttggaggagcttggggtcgacgtgggaagcgttgtcgggggcgaaatggtcaatgtggagatggaggtggacgcggtcggcgaggtagtcggcggcggcgagggagcggaggcagcgggagagcgaggcgaggcggttgaaggcgaggagcttgatgaggaaagtgaaaggaatagggttgggaaaagtggaggattgaggaagggagagaggagtggtggaaggtgtagaagatga

SEQ ID NO: 48766 - DNA, 2076 bp, Glycine max
  Peptide Sequence Number=SeqID_140451
atgttgaagggagaggtgcaagaaaacgtggaaaaggtgcagcagcaagcaccaaatgagccaccaccaccatcaccaccaccaccaccaccaccaccaccaccaggagacaacaagtcattccgttgctggtattgtaatgccaagttggattctaacaacgccgtgcgcagacatatgaaattccaccaggaacaaatagaagcagaaatgatgcgaattcatattgaagggggtggatcatctcatcaacaacctttggtttcttattctgaagcatcatcatcaagttcgaggtctctgccacatcctggaaaccaagcttatggtgaatcaacatcacctcagactcctcagttcctaagtgtaatggctcatcaagtgatcagtggatcttctcatcaacctttggtttcttattctgttgggaatcatggccaagaaagaatcaatacttcaatattatctcaggctcggaatactgccatgcatcagttccaaagtttatcggatcaagaatttggcccagaaaattcttcaatatggcacctggctcggaatattgccatacatcatcggcttcagcttttcagggctcaacggaatactggatcatctcatcaacctttggtttcttattcatctcagaattttggccaagaaaccagcagcaatgcttcaatattacctcagactcagaatatttccatgcgtcagttccaaagtttaatggctcaagggatcagtggatcatctcatcaacctttgctttctaattctgcagtgccagttagagtacaaggacttccaagttcaaggtcacatcctaatgggaattttggccaagaaagcagcaacaatgcttcaatattacctcagactcagaatatttccatgcatgagttccaaagtttaatggctagaggtatcagtggaccatctcatcaaccttttctttctaattctgcagtgccagttagagtacaaggacttccaagttcaaggtcacatcctgatgggaattttggccaagaaagcagaaacaatgcttcaacgttacctcagactcagaatatttccatgcatgagttccaaagtttaatggctagaggtatcagtggaccatctcatcaaccttttctttataattctgcagtgccagttagagtacaaggacttccaagttcaaggtcacatcctaatgggaattttggccaagaaagcagcaacaatgcttcaatattacctcagactcagaatatttccatgcatgagttccaaagtttaatggctagaggtatcagtggaccatctcgtcaaccttttctttctaattctgcagtgccagttagagtacaaggacttccaagttcaaggtcacatcctaatgggaattttggccaagaaagcagaatttcttcaataagacctcagattgcaagcatagggagtgcatctcatcaacagtaccacaactcacatcaacctttggttacatcaagttcaaggtcacatcctagtttatcttatgaggggagttctggacaggaaagcgattcttcagcaataaggcctcagaatgcaagcatagagtggaggtgtgataagaggaaatttggccaagagagaagccctgctgattcgaatgccgacaagcgactcaagcctttatgtgatgatagggaatttgaccaaataagaagttcttcagtaatagtacctcagaatgaaatcactgagggagaggggcctgattatgatttgaatgtcaagccttcatgtaatgatgagaattctgcattggaatttggtcaagaaagcagcaattcttcaatctgcagagagagaaaccctgctgatttgaatgtcaagctactcaagcctttatgtgatgagagaaaatttgaccaagcaagcaattcttcagtaacacctcagaatgcaatcattgaggggcttgatttgaatgtcaagccttcatgtgatgatcaaaattctgatcaacaagtcagttcttcttcaacgcctttgaacgaagaagaggaagagaagcttgatttgaatctcaagctttga

SEQ ID NO: 48767 - DNA, 525 bp, Glycine max
  Peptide Sequence Number=SeqID_140452
atgggccagtgctacggcaaaaccaatctcgcgccggaaaatgacgccaccgccgccaccacagacgagaccaccgcggttgtcgcccgatccggcgaagtcccgccctctccgctgccgggaaagggcacgcccccgcgggacagcctctggtctagtccctaccctcacggcggcggcggagtgacgccgtcacctgcgaggggcacgccgaggaggtttttccggcggccgttcccgccgccgtctcccgcgaagcacataagggcgtcgctggcgaagcggctcgggcacgcgaaggcggcgccgaaggaggggccgatcccggaggaggaagcggcggcggccgcggcagagcggtcgctggataagagctttgggtatggcaaaaattttggggcaaaattcgaaattgggaaagaagtggggcgagggcatttcggtcatacttgctatgctaaggggaagaagggtgaactcaaagatcaacctgttgctattaaaatcattccaaggccaaggtag

SEQ ID NO: 48768 - DNA, 138 bp, Glycine max
  Peptide Sequence Number=SeqID_140453
atggaagaaggaagaacttggattggtgatcaaggaggtggtggatatgatatgttgagaaagggagagaggagagagaaattggtggttttgacgcttattcatgaggtggcgttaactggggtggaaagcagttga

SEQ ID NO: 48769 - DNA, 360 bp, Glycine max
  Peptide Sequence Number=SeqID_140454
atggagcagtatttacggcatttggttcgccagcaggcagccaaccaccgggcacatgtgcagacccatgattgtctataccagatgagcctcagcatgcagagccagggcttcacttctttttcatgccctactccagaccagtttagggcagaggtcgcatggcccggggattggcctgaggcccaagcaggagaggcgcccccggaagttcccggcgatggagaggaggcccacgaggacgaggagatgaccgatttgcttgacttcttgggagggagtggagcttcatggctgggagatccccggattcatgtttttctttcatatttcttttatcatttttatgttatgacttga

SEQ ID NO: 48770 - DNA, 2235 bp, Glycine max
  Peptide Sequence Number=SeqID_140455
gcggcgttctccagcgtgaacgatcaaacgcaggagagtctgaccagcatccgcatgatcaaagcctttggcctggaagatcatcagtcgagccagtttgccgatatcgccagcgacaccggccgcaaaaatctgcacgtggcgcgcgtcgatgcgcgcttcgacccgatcatttacatcgccgtcggcttctctaacctgctggcgattggcggtggcggctggatggtgtggcacggctctctgacgctcgggcagctcaccagtttcgtcatgtacttagggctgatgatttggccgatgctggcgctggcgtggatgattaacatcgttgagcgcggcagcgcggcgtggagccgcattcgcgcgctgctggcggaagcgccggcggtagaggacggcaatcagctactgccagcggaagcgggcgtgctgcaggtggcgatccgcgccttccactatccggcgagcagcgcgccggtgctgagcaacgtgcatttccagctacaaccggggcagatgcttgggctgtgcgggcctaccggctgcggcaaaagcacgctgctgagcctgattcagcgccattttgatatcgatcagggcgagatttgctatcacgccattccgctgccgcagctgcggctggacagctggcgcagccggctggcggtggtcagccagacgccgttcctgttttccgataccgttgcgaataacctggcgctgggccgcccggaggcaacgcaggaagagattgagcgcgtggcgcagatggcctgcgtgcacgatgacattactgcgtctgccgcagggaaacagcgcatcgccattgcgcgtgcgctgttgctcaacgcggagattctgatcctcgacgacgcgctgtcggcggttgatggccgtaccgaacatgaaatcctgcataacctgcgcctggcgcagtggtacagcgcggcgatcacgatacgctggcggcgcagccgggctggtatcgcgatatgtatcgctatcagcagctggaagccgcgctggatgaggacgagtcagaacagggagccgaccatggctaaatcgcaacgcttatggccaacgctgaaacgcctgctggcctacggtaaaccgtggcgcaaatcgctgtggctggccgttggcatgctgtggatcgctgccgctgctgaagtcaccggtccggtgctggtgagttattttatcgacaacctggtggcaaaacaccagatgccgtggggcatcgtggccgggctgctggtgggctttgtgctgctacagctgctggcagcgggtctgcactatttccaggcgctgctgtttaaccgcgcggcgattggtgtcgtgcagcagctgcgcgtcgacgtgatgaatgcggcgctgcgccagccgctcagtgccttcgacacccagccggtggggcagattatttcgcgtgtcaccaacgacaccgaagtgatcaaagatctttacgtcacggtggtggccactgtgctgcgcagcgctgcgctgattggcgcgatgctggtggcgatgtttgcactcgactggcgtatggcgctggtggcgctggtgattttcccgctggtgttgacggtgatgatgatctatcagcgctttagcacgccgattgcgcgtcgcgtacgtagctatctggcggaaatcaacaacggcttcaatgaagtgatcaacggcatgagcgtgatccagcagttccgccagcaggcgcgctttggtgaacgcatgggcgaagccagccgttcacactatctggcgcgtatggaaacgctgcggctggatggctttttgttgcgcccgttgttgagtctgttttcggccatgattctgtgcggtttgctgatgctgttcagcttcgccacgccgggcgtgtttgaagtcggtgtgctgtatgcctttattacctatcttggccgcctcaatgaaccgctgattgaactcaccacgcagcagtcgatgctgcaacaggcggtggtgtccggcgagcgtatcttcgaactgatggatgcggagcagcaaggttacggcagcgatagtctgccgctggcctccggcagcatctcgctgcgggatgtgagctttgcctatcgcgataatcgcgatgtgctcagccacatcaatctcgaagtgccggcgcgtcattttgttgcgctggtggggcacaccggcagcgggaaaagcacgctggcgaatctgctgatgggctattacccg

SEQ ID NO: 48771 - DNA, 192 bp, Glycine max
  Peptide Sequence Number=SeqID_140456
tcctgtggcatgcggagacacccgacggtaacccgcacacaccctttgctatccaacgacccgagagtctggtagcatgcgaagacaccttacggttatccgcacctcgtcatttggagaccccaagtccgattgacaagcagagaccaatgtggtcatctacaccctttcttgagatgtcagcatcttccg

SEQ ID NO: 48772 - DNA, 381 bp, Glycine max
  Peptide Sequence Number=SeqID_140457
atggaggggcagaacaaaattaagggagtgaaactcaatgtacctccttttgaaggcaggagtgacccaggcacctaccttgactgggagatgaagattgcgcatgtattctcctgcaatgattatactgaagagcagaaggcagtctgggttgaacagcagttgaaaaggaaaattgcaacaagaaggaactcatccaataatttcaaccagaactggaccgacagatccaacaaggagggaggcaactcgtccagcccccatggaaagtcaacagttttcagtgctaaaaccaagcataattctgcttcatcatccaacaccagtaccagaaacataaaatgcttcaaatgcttaggcagaggacatattgctttctga

SEQ ID NO: 48773 - DNA, 345 bp, Glycine max
  Peptide Sequence Number=SeqID_140458
atggggggtgaacttatcaaaatgagggtgcaaatagaaattttcaaattttcgaatctggcccattccagaatattttcgaagttgggcaagctaggcggcaacctcctccccttttttcctataaataggcgaaaggaggctgttccaaatatccctcaacccccttggctatgcattttagctattttgggtgtaaaaaattatttccgtgaggaaaattcaagccgaggtgcttttgtaaagcttctgagacgtttccgggagcaaatccgtgaaggttttccgtctttcttcactgttcttcatccgttctttgttcgttcttcgtttttcaatgggtag

SEQ ID NO: 48774 - DNA, 177 bp, Glycine max
  Peptide Sequence Number=SeqID_140459
atggcttgtcttgattttaggtattgtcatcatcaaaaagggggagattgtagacaaaggatcaagctgaaagttttgatgatgccaaaggattacatgaatcatatgcttctcaaagatttactcaagacaaagcaattagagttaatcaagatggatgatcaagacagtctatag

SEQ ID NO: 48775 - DNA, 468 bp, Glycine max
  Peptide Sequence Number=SeqID_140460
atggctccaaaaaaactctccacgaagaggtctagaagagatgccacaggagaaggatccagtgctgcctcagagtttgatagtcatcactttcggagtgccgagcaccagcggcgcttcgaggccatcaggggatggtcattccacagggagaggcgtgtccaactcagggaggatgagtatacggacttccaggaggagatagctcacagacgttggacaccgctagtgactcccatggcaaagttcgaccctgagatagtcctagagttctatgctagcgcctggcccacgaaggagggagttcgggacatgtactcgtgggtaaggggtcagtggattccctttgacgcagatgccctcagccagttcctgggcgacccggtagttttggaggaaggccagcagtgtgagttcagccagaggaggagcagggccgacggtttcgatgaggaagccatctcctag

SEQ ID NO: 48776 - DNA, 432 bp, Glycine max
  Peptide Sequence Number=SeqID_140461
atgggggatcccatcagtagactctccttccctggtagacgcattgtttgtcactcaaaaaaggcatatgctgctctaatcagttggaatatttgtctctttgctaaagcatgtttgcattttagtggagaaaacaccgagactttttcaagtctcacaagttatccagaactacgtaggtctgagttcctcattggaggatacgtaggagcaagagcctcgcttttgtcgaccacaccgccttttgttgccatgacccaagagctggtagcccgcggaggcaccttacggttatccgcacctcgtcattcagtcaccccaagtgtgattgacgagcagaggccaatatgggtcatctgcgccctttccggagatgtcagcattttccgatggagacttttcaagtctcacaaattatctagaactacgtag

SEQ ID NO: 48777 - DNA, 432 bp, Glycine max
  Peptide Sequence Number=SeqID_140462
atgaatacaaaccaggtttttgttgaaggtcaaagcctgacttattctgaatttgtaactaagttcgtgtataaccagaaacagagatgttggcaacttaggaaaaagggttatactactggcagacttcaatgggttcctccaactacaggggaattattttatttgaggatgatgctgactgtctgtagaggaccaatctcatttgaaaatatcagaacagttgatggtgttgaatattctacatatagagaagcatgttttgctatgggtttttcacaggatgatagagaattcattgttgcaatccaggaagcaaaagactggggctcagcaccttatctaaggaatctttttgtattattacttttgacaggattacatattgatgactccaatatgatgaatctggtattgcttgaagttgaatag

SEQ ID NO: 48778 - DNA, 117 bp, Glycine max
  Peptide Sequence Number=SeqID_140463
atggctgtgtgtgtgtgtgtgggtttctggctgtgtgtgtgtgtgtttttgtgtgtgtgtgtgtctggaagcatgatcaaattggatactactcaacaaaaagcggatatgacttga

SEQ ID NO: 48779 - DNA, 300 bp, Glycine max
  Peptide Sequence Number=SeqID_140464
atggctctaaggactccaaacctgcaaaacaaattagatctaacaaaatccacaacatcagcatctagttctggtgggtttggcttccacccttttgaaacagtaattcaacagcaaggagaatataaacacaataacataagtaccaaggaaagcctagaagaaatttctcaacagacaatcaacatcgctcacaaactcattctctgtggtatattgaatttgctggtagctccacaagctggaagcgtagtagatcacccagcctgctcttttgacaaggtcaaccccaagtgctaa

SEQ ID NO: 48780 - DNA, 177 bp, Glycine max
  Peptide Sequence Number=SeqID_140465
atgtttcaacatatctgttatacagttgtggattctcaaaacaggccagacaactatcttaaaggaagaattaacagtgctttgaaaggacttgatgatactccacaacctaaatccaaggctagtgttaggtggattgttgttaaggaagtttcaggaataattgggaaacgctaa

SEQ ID NO: 48781 - DNA, 297 bp, Glycine max
  Peptide Sequence Number=SeqID_140466
atggagattacaatttacaagctcagggttgaagtcaatcaatcaaattttcagctcagtaagggtgcaagggataattcattcatgaacaagaaaataaatgaaaatcctatcaataatcatcctgagctggtgtttgctcatcctgggctggtgcaggctcgccatgagcctctagagtggcctcatgaggtacctccggctgtggttgaggctcctgggctgcggaagcctcacctcccccccccccccccaaaggagaaggttggactcctagccaggccacctgagaattga

SEQ ID NO: 48782 - DNA, 339 bp, Glycine max
  Peptide Sequence Number=SeqID_140467
atgagaatctgtccttcaaataggctttgcaatttggcatttgaagtttgggagctcttagaagatgggtctgctaaagctggaggtggggctgaagtagaagatgcaaggatgccagctattggtgcaaaggaagaggggacatcagctactctgagcttggtcttgctgggggaagcaaagcttcatggtgaatcaaagaaatcaagtcaaaaagttcaagatagaatcaagaagaattcaagactcaagaagaaagttaagagtcaagaatcaaagattcaaggttcaagatctcaagaatcaatatcaagattcaagaatcaagagaaggcttaa

SEQ ID NO: 48783 - DNA, 420 bp, Glycine max
  Peptide Sequence Number=SeqID_140468
atgttgagtcaacatcccaatatgttaaactacactgactctgtgatgaagagagaatcgcctctatccctgcattacaaattgtttgaggggacacatgtcccagacattgtctcgacatcagggaaagctgctgcttcaggtgctgtgtccaaggatgccttgattgctgaactcaaggacacatgcaaggtgctggaagcaaccatcaaagccaccacagaaaagaagatggagctagaacggctgatcacaaggctctcagaaagtggcattgatgatgaagaagcagctgaagaagaggaagaggcagctgaggaagacaaagaagcagctgaagaagaagaagaagctgctgaggaagaggaagatacagcagaagagacagaatcagatgatgattctgaagccaccccatga

SEQ ID NO: 48784 - DNA, 126 bp, Glycine max
  Peptide Sequence Number=SeqID_140469
atggggacctctaagggggggaagagggtggtggttgccgcccagctcgcccaggcaagctgggatgcttccaccagaaggcaccgccttctgttggaagatcctagaaggcccaagtgggcctga

SEQ ID NO: 48785 - DNA, 533 bp, Glycine max
  Peptide Sequence Number=SeqID_140470
aggacatactaatgagttgtccgtcttctatgccttatgttgaagctgcggaggggtcactagaaatattgtttcaagcattggaatttgtgaataatgcttatatggagtctcctccgatacaaccacgtttgtctggtgcctctttgatggtagctcaagttatgctaaaagatggttatgagcctagaatgggtttgggccggaacaatgatggcacaacaagcttgctgaagtttgctgaaaaccatgggaggtttagtctgggttataagcctacaaatgctgacaagaggaggatttctttggaaaggaaagaaagaagcttagctcgtctgcaagggcgaggaccacaagtggagagggtccctatttgtcacatcaacgagagctttgtcagcacaggatccgacaatgagttctgtgaaagcagtgatactgaggactcggatgttgactttgaacggccagtaaatcaagccaaggaggaagaaaataaggattggggacttcccccggatttgaggagaatg

SEQ ID NO: 48786 - DNA, 387 bp, Glycine max
  Peptide Sequence Number=SeqID_140471
atgtttggctgtttcttgtccctgccccattttgctgtttttgctttgcctgcccagacctttcttgttgcccttgcatcctttgttgctgctgatttctgcatttctcttttgaggaacaattgcctgtcatttgctgagttcatatcttccttacccttcaaggaatatactgatcctcacaaaggttctcttaaccttgctgtgaagttgcctaatggttctctaaagccagacctggggccaaaaacatatattgcttatggatttcctcaggagcttggacgtggtgattcagtgactaagctccattgtgatatgtctgatgcagtatgctctatttgcctatttctttcctgggctgttattttcaaggatttcttctaa

SEQ ID NO: 48787 - DNA, 801 bp, Glycine max
  Peptide Sequence Number=SeqID_140472
ggacacgctttacgacgcccttaccgaactcgtgctggagctagagtaatgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatccggcctcaagcaaatgaatcatccaacctcaaatatggtaggcaaagatttaggaagtacgggcggcccccatgatgtgcaaattcaaaacgagcacgccttcccgtcatatggcttgcctctcaactatacgccacccaaagtggcgtacactcccaataagaatgtcaataactccactcctatacccattgagagccaacaaccccaaactgatcatgcacatggcaagcagttggtggtatacccctacaaaaccctttggagggccctcagtatcacccacaactgcacctcttgcattccacagcggttaaaaaccctcatgactatggcaggaatgggaaaagttggatcatctagaggaaggctcagggccattgaaggaggtgaagattatgcctttgctaacctagaagagttgttcctaatacccaaacatggtcattcccaaagttcaaggtgccggactttggcaagtacaaggggactactcgctccaaagaaccatctaaagatgtactgtcggaagatgggggcatacgcaaaagatgagaaactgctgatacatttttcctga

SEQ ID NO: 48788 - DNA, 486 bp, Glycine max
  Peptide Sequence Number=SeqID_140473
atgggtaaagcagagaaggtgcaagagaaggtgaaggccgacatggaggccataaaagagaaaatggccacaatgatggaggccatgatgagcatgaggaagataatggaagccaatgcagttgcagttgccgctaccagcactgttgctaaggtgaacccgatgcccccatctggcctcaaccaaatgaatcatccaacctcagctatgatttgggaaacacatgaaattccccaccacaatctagccgacttcgagccttgcctcggatatgccactgaagggcaagcggttggtggtatacccctgcaaaacacttcggagggccctcagtatcacccacaaccacacccctcacattccatagcaagtaaaaaccctcatgttgtggcagaaatgggaaagttggatcatctagaggaaaggctcagggccattgaaggaggtgaagattatgcctttgctaacctagaagagttgttccta

SEQ ID NO: 48789 - DNA, 76 bp, Glycine max
  Peptide Sequence Number=SeqID_140474
acgtcacttcaaggagaagatgagtcaagaacaagctcaccaccataagaagccgtggaaaaaagctggaaggtag

SEQ ID NO: 48790 - DNA, 366 bp, Glycine max
  Peptide Sequence Number=SeqID_140475
atgaagagggtgagaatgaaggagaaacccatgctgcgattaccgttcctacatggaaacttcccaccagccaaacaatgtcattactcagccaatatcagcccttctcactacccaccacccagtcatccacaaaggccatccctaaatcaaccacaaagcctatctaccacacttccaatcatgaacaccaccttttgcacgaaccaaaacaccaacgaaggaaggaatttcgcagcgaaaaagcctatagaattcaccctaattccggtgtcctatgatgacttgctcccatatccactcgataattcaatgatagccataaccccaaccaaggttcctcaacctccgtttttccaaggatag

SEQ ID NO: 48791 - DNA, 275 bp, Glycine max
  Peptide Sequence Number=SeqID_140476
acttcacactttatgcttcggggtcatacaatgctcaatggaatgccccagggctcctccacgataagcacatgttgcgttcgagtcgtatcctcagaaaagtggaggttgaggaaccttggttggggtggtcttcgtcattggaagtgcgtaatgacattgttgggtttggtgggaaacttggccgtataggaatggcagtcacagcatgggtttctccctctttctcaccctcttcatttgccccagttttctcagtcgtcctagtaggatga

SEQ ID NO: 48792 - DNA, 252 bp, Glycine max
  Peptide Sequence Number=SeqID_140477
acttatcaaggtaatccttgtggcttctatcctgacttatcttccttcactggaagtggtgtctatcctgacttatcttccttcactggaagtggcgtctaccgtgacttatcttccttcaccggaagtggcgtctgcccagacttatcttccttcactggaagtggcgtcatccaaatctccgtagcctgtatcaaacgatctgcgccccgtaaggttcacatcatctggtatcagagcttcggctcttga

SEQ ID NO: 48793 - DNA, 291 bp, Glycine max
  Peptide Sequence Number=SeqID_140478
atgttgtttcttctctcttctcccaaaaccctctctttttcccgcaggccacctaacctgtctcagaaaaatgacgatcccggactcgttcactgttggatcgtcgtgaaatttgagcaccacgttcgcaacccaattacgaagagaaatacccctcgcattgtagcattttcctttcccgcagaaacccagagctatctcggaattctatcggagcagatagaggaaaaaaattggaagaatctcagagaaccgctagagatgctgctatcgctggctgaagacacgtga

SEQ ID NO: 48794 - DNA, 418 bp, Glycine max
  Peptide Sequence Number=SeqID_140479
cgctgaacaccagcagcgcttcgaggccatcaagggatggtcatttctccgggagcgacgcgtccagctcagggacgacgagtataccgatttccaagaggagatagttcgccggcggtgggcatcactggttacccccatggccaagttcgatccagacatagtcctcgaattttatgccaatgcttggcctacagaggaaggcgtgcgagatatgaggtcctgggtgaggggtcagtggatcccgtttgatgcagatgctatcggccagctcctgggatatcctttagtgctggaagagggattttgcccggactgctgccaggagacgggtgcggatcatgcgcaccaacatgaccaccctgactcagatctggatgactttgctgctcagcaacatctagctcaacgaccataa

SEQ ID NO: 48795 - DNA, 327 bp, Glycine max
  Peptide Sequence Number=SeqID_140480
atggctgataaaacacgtttgaaagagctttctacgaacatgtctagggttttggaaatgctggaggctgatcggaaagacaaaaaagctcgatttgagtccttggaagttgtggtagagtcattattgaaacaaaattctggttccagtgagaaccacaatctgccacatccaccgttccaggcggagcagtttttttactactacaatactctagaccctcagcgtctcatgattgctataattcacatggagaaagagggtgttactagtgaggctctgattgattgttttattggaggactcaaacctgatattcaacatgat

SEQ ID NO: 48796 - DNA, 342 bp, Glycine max
  Peptide Sequence Number=SeqID_140481
atgttgggacatggatacgagcccagaatgggtttaggccggaacgacaatggcatggcgagtttggtagagttcacagggaaccgcggaaggttcggactgggatatgagcctacgcacatcgacgtgagaaggattgccctagaaaggagggtaagaagcatgggccaacggcaaaggctgcaagtgaaaggggttcccttgtgtcacatcaacgagagctttgtcagcatgggttggatgtgcaagggatgggtcaccatgatacacaaagaaaccccgcaagagcaaccaaattgggtgcggccgtgtcctctagagttcgaattggggaactggtga

SEQ ID NO: 48797 - DNA, 132 bp, Glycine max
  Peptide Sequence Number=SeqID_140482
atggctaagacaatgataaagattaacagaaaacaagaggaaatgttcaacacagttcatattaagaatcaggtcctttgctctaagatggagcgatcaactagagcatacttgacgtctgctagacagtaa

SEQ ID NO: 48798 - DNA, 513 bp, Glycine max
  Peptide Sequence Number=SeqID_140483
tccaacatggccctgggatttctcgccttgatcacaggactctgccagtcgttcggcgttcccgtcacacctagcaaggtgattcggccgcccatcacccgagcttttattgagaagtactgcacgcagagacagatccagggtgatgcaccacaggccgcggacgcgccaccacctcatcaggctggcccagccggattgtttgatacagagcagtatttgcggcatttggttcgccagcaggcggccaaccaccgggcacatgtacagactcatgattgtctttatcagatgagtctcagcctgcagagccagggctttacttcttttctgtgccctactccggaccagttcagggcagaggtcacatggcctggagattggcccgaggcccaggcaggagaggcaccagcaggggcaccagcagaggctcccaacgaggcagacgaggcccgcgaggacgaagagatgaccgatttacttgacttcttaggagggagcggagccacatga

SEQ ID NO: 48799 - DNA, 408 bp, Glycine max
  Peptide Sequence Number=SeqID_140484
atgtcagtatttacacgcgattctccccaaatttcagccagcccgcatcaattagaccttgcaccttacgcttcagagccctacaatgctcaatggaacgccctggggcttctccgtgacaagcacacgttgcgttcgagtcgtattcttggagaaatggaggttgatgaaccttggctagggttatggctaccattgaaattatcaagtagatatgggagcaaggattgcctatgtgggataactgggcggtggggtaaggagaaggtttgttattggctgagtaatgacattgttgggtttggtgggaaacttggccgtataggaatggcagtcacagcatgggtttctccctctttctcaccctcttcatttgccccagttttctcagtcgtcctagtaggatga

SEQ ID NO: 48800 - DNA, 575 bp, Glycine max
  Peptide Sequence Number=SeqID_140485
ggcgcggcggtcgctgcaaaacccagggcgcgagcccgggcggagcggtcgtcggtgcagatcttggggggacgggggaagcccgtctgatagcgctctgtgcccgtactccgaaagggaatcggcctgcccaccctggaaaacggctcagccgggaggttagggtccagcggctggaaagagcaccgcacgtcgcgtggtgtccgggtgcgccccccggcggccctttgaaaaatccggaggaccgagtgcctccccacgcccgggtcgtactcataaccgcatcagggtctccaaaggtgaacagccttcttggggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 48801 - DNA, 789 bp, Glycine max
  Peptide Sequence Number=SeqID_140486
atggctacctcaccaaaagaaacttcatctcctggttcaccctctgtaccatcatctccatcatccaccaaagcaccatcaaaccaggaacaacctgaattcaatatccaacccatacaaatgattcctggtccagcccctgttcctgagaaactggtccccaaaagacaacagggagtgaagacttctgaaaaccctagccttgcaacaagtcctagggaagtagacacggagatggataagaagatccgcactgataaagatgtcccaacatcttccaccccaaatgtttctgtgcctgatgctgataaagatgttccaacatcttccactccaaatactgaagtcctcccttcacccagtgaagaggaatcaacagaggaagaggatcaagccacagaggagacccctgcaccaagggcaccagaacctgctccaggtgacctcattgacctagaagaagtagaatctgatgaggaacccattgccaacaagttggcacctggcattgcagaaagattacaaagcagaaagggaaaaacccccatcactaggtctggacgaatcaaaactatggcacagaagaagagcactccaatcactcctaccacatccagatggagcaaagttgcaatcccttccaagaagaggaaagaaatttcctcatctgattctgactatgatgtcgaactagatgttcccgacatcaagagggccaagaaatcagggaaaaaggcttgctttagaaagagaactgggaagaatgccttggttgcaaggagatcatga

SEQ ID NO: 48802 - DNA, 98 bp, Glycine max
  Peptide Sequence Number=SeqID_140487
ggaacgacagaaacttgagacttaccatccccctggttatacagaattgtttggtaaaatcagcatgaagaagtctccgttgttagacacgcacaatg

SEQ ID NO: 48803 - DNA, 372 bp, Glycine max
  Peptide Sequence Number=SeqID_140488
atggaggaatccaatcgggaaaataacaaagatcacgtttcccagtcaagggggtccgctgttgacggtgtagaacacattggagaatggataaatccaatcgggaaaataacaaagatcacatttcccagtcaagagggttccgttcttggcggtgaagaacacattggagaatggaggaatccaatcgggaaaataacaaatatcacatttcccagtcaaaagggtccgctcttggcggtgaagaacacattggagaatggaggaatcaatcgggaaaataacaaagatcacgtttcccagtcaagagggtccacttttgatggtgaagaacacattggagaatggaggaatcccaatcggggaaaataa

SEQ ID NO: 48804 - DNA, 252 bp, Glycine max
  Peptide Sequence Number=SeqID_140489
atggaactaatgagactgaatcagcatgaggagaatgataagaaaaagaaaggaatcacacttaaagcttcatcctcaattcaagaaggaagtgataaagaagatttgaatgaaatagacgaagatgatgatttcagtttctttgtaaaaaggttcaacaaatttctaagaaacaaaggaaatcaaagaaaagagcagaagattcatcctctcttccaaaatgttatgaatgcaatcaaccaagacatctaa

SEQ ID NO: 48805 - DNA, 423 bp, Glycine max
  Peptide Sequence Number=SeqID_140490
atggccccaaggaagcttgtctcaaagagatccaggaaggataaagcggctgaaggaaccagagggcgtgcgagatatgtgatcctgggtgaagggtcagtggatcccgttcgatgcggatgctctcagccagttcctgggataccctttagtgctggaggagggccaggaatgcgagtatggccagaggaggaaccggtccgacgggattttgcctggactgctgctggaagacgggtgcggatcatgcgcaccaacatgaccaccctgacccagatctggatgactctgctgctcagcaacatccagcccagcgatcataattccgacctccccctgccgaagtatcagctggtatggcgcctaccaggcagcctctggacccggataagtccagcagggcccttggatttcccgccttga

SEQ ID NO: 48806 - DNA, 762 bp, Glycine max
  Peptide Sequence Number=SeqID_140491
gacgcgataggacagatttacttcattgaccgtatcgcggcgattggaacaacggtgacggcaacatgcacaggcctcgtcggaacggttataccggctaacagtattgcgcaggataccagcggttaccggtctcggcgcgcagcacgcgcacgaagaggggatctacagcgcgccgaagctggtggacaaggagcggtaaggccacggtcagccgtcttgataccaaccgtatcagcgattccgtcagcggtcaacgtggggtattccgcgatgaccaaaaacgaaaaaatcgcctggaaaatgtcggcgacggcggataacccaaccaccaacatttaccacaacaccggcgtcgcgatgccggacagctccaatttcaacggctctggcggcaaatacagcgatccgctgaccagcgggcgcacccgcactcagggctggctgctgagtgataccctgggcgtgctggatgacaagctgctgtttaccgctggtgcacgtcatcagaaagtggtcattcgcgggtacaacaaaattaccggtgcggaaaacgacgcggacggttttgacggcagccgctggatgccaacctacggtgtggtttataaaccgtgggaggaaatctcgctctacgctaaccacaccgaagcgctgcagccgggtaaaaccgcgcccaacacggccaccaactacggccagagcaccggtatcgttcactctaagcagaatgaagtgggcgtgaaggcggactttggtcgt

SEQ ID NO: 48807 - DNA, 688 bp, Glycine max
  Peptide Sequence Number=SeqID_140492
atgagaggagaagagcaatctgtagtcaatgagcaacttgaagcttatgtagcaaacatttataatagaccccctcagcagcaaaaccaacaacaacagaataattatgatctttcaagcaaaaaatacaatccaggttggaggaatcatccaaatctgagatggacaagtcctccacaacaacaacagcctgtccctcccttccagaatgctgctggtccaagcaagccatatgttcctcctccaatgcagcaacaacaaagacaacaagcaactgaggctcctcctcaaacttccttagaagagttactgaggcaaatgaccatccagaatatgcaatttcagcaagagacaagagcctccattcagagtctgacaaatcaaatggggcagatggctactcagttgaaccaagctcagtcccaaaattctgacaaattgccttcacagactgtgtttggcaaccaaattcaagtgcctccaccagtagcaacacctgcacctgaacctgtcaagcttcattctacacctgaaaaagaggatgagctagctgcacaaaagagaaagcttcctgatcatgagggagctaacacaaattttcatgcaggagatcttggagaccttcagaaagtagaggtgaacatatcttctgctagatgtccatcaagcagattccaagatatgccaa

SEQ ID NO: 48808 - DNA, 792 bp, Glycine max
  Peptide Sequence Number=SeqID_140493
atgccctctccttcagagggctgcacgccctcgccttcagagggctgcacgccctcacctttagagggctacacaccctcgccttcaaagggatgcacgccctcgcttcagagggctgcacgcctcgccttcaaagggctgctcgccctcgccttcaaagggcttcacatcctcgcctttagaaggctacacgccctctcctttagagagctacacccccttgacttcagaagacttcacgtcctcgcctgtagaaggctacacgtcctcgccttcagagggctacacgtcctttccttgggagggctacacgtcctagccttcagaggacttcacctcctcgccttcaaagggctacacatccttgcctttggagggatacatgtcctcgccttcagagggctacacgccctcgccttcagagggctgcacgctctcgacgttagaggacttcatgtcctcaccttcagagggccacacgtcctcgcctttggagggctacacatcctggactttagaggactacacatcatcgacttcagagggctacacgtcctcaccttaagagggctgcacgtcctcacctttagagggctgcacaccctcgccttcagaggactgcatgtcctcgcctttaaagggctccaggtcctcgccttcagagggctgcacgccctcgccttcaaaggactgcatgtcctcacctttagtgtgctgcacgtcttcaccttcagagggctacatgccctcgcctttagaggactgcacgtcctcgccttcagaaggctccag

SEQ ID NO: 48809 - DNA, 144 bp, Glycine max
  Peptide Sequence Number=SeqID_140494
atgatgcaatcctaccccgcaagggaattggatagaagactccaagtagattgggtcagagatccaagggaaggccctagggttctcatgagccttaagctaagctctagcttctcatctcaaggaggtgagcttagctattag

SEQ ID NO: 48810 - DNA, 321 bp, Glycine max
  Peptide Sequence Number=SeqID_140495
atgtcagaattcacaagtggttctcctcaaatttcagccagcccacatcaattagactttgcaccttatgctttagggtcatacaatgctcaatggaatgccctggaactcctccatgataagcacatgttgcgctcgagtcgtatcctcagaaaaaaggaggttgaggaaccttggctggggttatggctaccattgaattatcgagtagatatgggagcaaggtggtgtttggcattgggtgtgcggcaggcgagctttgtggctgatttagggatggcctttgtggatgactgggtggtgggtaatgagaagggctga

SEQ ID NO: 48811 - DNA, 689 bp, Glycine max
  Peptide Sequence Number=SeqID_140496
aaagggaaaaacccccaaaactagggctggacgaatcaaaactactgcacagaagaagagcacaccaatcactcctaccacatccagatggagcaaagttgcattcccttccaagaagaggaaagaaatttcctcatctgattctgatgatgatgtcgaactagatgttcccgacatcaagagagccaagaaatcagggaaaaaggtgcctggaaatgtccctgatgccccattggacaacatttcattccactccattggcaatgttgaaagagatgccttggattgcaaggagatcatggacctcatcaaggctgctggactgctgaaaactgtcaccaagttgggagattgttatgaaagtctagtcagggaattcattgtcaacattccctctgacataacaaacagaaagagtgatgagtatcagaaagtgtttgtcagaggaaaatgtattagattctcccctgctgtaatcaacaagtacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattggcactgccaactgggtacccaccaatcatacttccactgttgccacag

SEQ ID NO: 48812 - DNA, 534 bp, Glycine max
  Peptide Sequence Number=SeqID_140497
atgactaggggcaatccatctgacttacaaccctttgatcctgagatagataggacatttcatagattagttaggcattattttgtaccttttgagcatcctgagcattctattattggtgagtctgagcattttgtggttgataatttcgagcatcctgattttgagcattatagttttgaacattctgagaatatggcacaacctccaccccgtgagaggactctaagggaaatggctacacctgatttcacctacaaaagcttgtgcatccaataccctgatgaggatgtcccatatgttcttaaaactggactgatgcatttgcttccaaagtttcatggccttgcaggtgaagacccgcacaaacatctgaaagaattccatattgtctgctccaccatgaaacccccagatgtccagaaggatcacatatttctgaaggcctttcctcattctttagagggagtgacaaaggactggctttattaccttgctccacagtccatcacgagttgggatgacgtcaaaaga

SEQ ID NO: 48813 - DNA, 360 bp, Glycine max
  Peptide Sequence Number=SeqID_140498
atgaaactggccaaatacaggctaaaggcccaagtggagaaggacaaagccccggagaagggtgaaggtaatccttgtggcgtctaccttgacttatcttccttcactggaagtggcgtctacccggacttatcttccttcaccggaagtggcgtctaccctgacttatcttccttcaccggaagtggcgtcatccaaatatccgtagcctgtatcaagcgatccgccccgctaaagacccaagtggagaaggacgaaagcctaagtggagaaggacaaagcccccgagtggagaaggatgaaggcccagaggcagagacactatcaagacaattaattgttgctaaaggcccaaactaa

SEQ ID NO: 48814 - DNA, 566 bp, Glycine max
  Peptide Sequence Number=SeqID_140499
tcaaggtgcaccttttgagggcaccattgttgatgactggaaatttgattattctagtcatgatgctcgccatatggtctgcaatgaccaggctgaaatgaccgcacaagcctctaaggaggatttgattctgatgtgggctttccttatcggtcgtcagatcgactgggcccacttggttcggtaccgaatgcttaaggcattacgggccaatgcacctctcccttacccacaattgataactttgtttctgcgtcattttcaaattccgcttgatgatgaaccatttgttcaagtcaagcgttcttttgcaattggtgctggtgtagtgacttcctttggttaccgtaaggatcggaatggtcaatggctgaagaaagacgcactccctcctcaagatgagcgtactccttcacctcctcctcagcgagatgattcagcactcatgaatgaagtccttaccgaattacgaggtcttcgttcttatgttggtgaacgttttgactcattggataaacgttttgccggcatggatattcgcctcacacagcttgaagaggatgtgg

SEQ ID NO: 48815 - DNA, 152 bp, Glycine max
  Peptide Sequence Number=SeqID_140500
atggaggagccccggggcattccattgagcattgtagggcctgaagctggaatatgggtgcaagccattggtttgtttgctcaagcgacctacgctcctgagtttggacttccaagaccattcaatcagaaattactcgtgctacacatttg

SEQ ID NO: 48816 - DNA, 326 bp, Glycine max
  Peptide Sequence Number=SeqID_140501
gtggaggacacatgaacgaaaacacaattcatggggctccgaaaaaggggttgagaatggagaattgcactaagcaatcactacgcatggctcctaacacgaagatggaggacatattaatgaaaacgcaattcatggggctccgaaaaggggttatgaatggagaattgcacagagcaatcactacggatggctccaaactcgaaggtggaggacacatgaacgaaaacgcaattcatggggctccgaaaaaggggttgagaatggagaattgcactaagcaatcactacgcatggctccaaacccaaaggtggaggacacttga

SEQ ID NO: 48817 - DNA, 486 bp, Glycine max
  Peptide Sequence Number=SeqID_140502
atgaccatgattacgccaagctcgaaattaaccctcactaaagggaacaaaagctggtaccgggccccccctcgagctcctcctgctacttggacttccttagcattaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 48818 - DNA, 372 bp, Glycine max
  Peptide Sequence Number=SeqID_140503
atggataaattagatatctttgtccctcatcctctcacaaatgcatctttgcttattcaactttcaccgagatgtgggtgcaagccattggtctgtttgctcaagcgacctgcactcttgagtatggacttccaagaccgttcaatcagaaattactcgtgctacacatttggtgagggtgccggtggacccttgggtactagtaccctcaccttccgaggactacacgtcctcaccttcagaaggctacacgccctcaccttcagagggctgcatgccctcgccttcaggggactacacgtcctcgccttcagaggactacacgtcctcgccatcagaggagaacacgttctcgccttcagaggactacac

SEQ ID NO: 48819 - DNA, 691 bp, Glycine max
  Peptide Sequence Number=SeqID_140504
cgaagagagttttgaggcaccggaggaggacgaagaagtccaagctctcaaaagtgagttaggaaaggcgagacttgccaaggagaagttcaagttggccgctacacacatccggaaggaatgtgccagattacgggaagagaatgcaactaccgcgagagcccttgaacaagagaccaagagggctcgcaaggaagagtatggccggaataaatttcgcggagctctgtggggtagcaatagtgaactcaagctgcgaagggaagagagggaccagtcgcgagcacatagcatggttctgaaagaggagttagttgcttgttcaaggtccaaaagaagtttgtctcagcgtttatgcgagacggagaccgacatgctagctatcatcgccaagtaccaagaagagttaggtctagccacggcccacgagcataggatcgcggacgagtatgctcaaatatacgcggaaaaagaggctagaggaagggtgatcgactctttacaccaagaggcaaccatgtggatggatcggtttgctcttaccttgaacgagagtcaagaacttccccgcttgttagccaaggccaaggcgatggcggacacctactccgcccccgaagagattcatgggcttctcggctattgtcagcatatgatagacttaatggcccacataattagaaatcgttag

SEQ ID NO: 48820 - DNA, 159 bp, Glycine max
  Peptide Sequence Number=SeqID_140505
atgagggcgtgtagccctctcaaggcgaggacgtgtagccctttgaagattgactgtccttttgaaagaggtgatagtccatgcaaccttatcctatcttttgcaaatctctccgagaactccctcagagtgtgtgttctgtttgatttagtcatttga

SEQ ID NO: 48821 - DNA, 281 bp, Glycine max
  Peptide Sequence Number=SeqID_140506
gaagagtttatgagggatccatagcggttcacaacatccctttgtttcatggccaagtgaaggttggtgttgaggaggttaaagatgcagaggctcccgttcctatacccactgaggaggtagctatgtcttcagcaaaacctccagataagccagatcatgaggtcgatgatcccctacatttgatgacattgaccattccacagctttttttgaagcctctccaagttatgtgggatgctaccatgttcggggtgtttaatgaacacttccttttgtaa

SEQ ID NO: 48822 - DNA, 120 bp, Glycine max
  Peptide Sequence Number=SeqID_140507
atggctctctacgggtcggtgtttgcttactcgaacccactcaaggatactaggctgcttcccagcggcgctttccgcttgtccagagctgggcatgggatgacgatctatcggtcatga

SEQ ID NO: 48823 - DNA, 441 bp, Glycine max
  Peptide Sequence Number=SeqID_140508
atgactagaggcaatccatctgacttacaaccctttgatcctgagcattttgttattggtgattttgagcattattgttttgaacattatgattttgaacattttgagaacatggcacaacctccaccccgtgagaggactctaagggaaatggctgcacctgatttcacctgcgaaagcttgtgcatccaataccctgatgaggatgtcccatatgttcttaaaactagactgatccatttgcttccaaagtttcatggccttgcagaaggagtggcaaaggactggtttcattaccttgctccaaggtctatcacgagctgggatgacctcaagacagtattcttagaaaaaaatttccctgcttccaggaccacgaccatcagaaaagatatttcaagaattaggcaactcaatggagagagcttatatgaatattga

SEQ ID NO: 48824 - DNA, 608 bp, Glycine max
  Peptide Sequence Number=SeqID_140509
gctgcgcaactgttgggaagggcgatcggtgcgggcctcttcgctattacgccagctggcgaaagggggatgtgctgcaaggcgattaagttgggtaacgccagggttttcccaggcgaattggagctccacagcggtggcggccgctctagaactagtggatcccccgggctgcaggaattcgatcctctgacaactgtgccccatccacatgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48825 - DNA, 315 bp, Glycine max
  Peptide Sequence Number=SeqID_140510
atgcggagacaaaatttggtcattccgcacccctttgccattcagacacagtcgtgtccgatggcgcgcagagacaaaatttggtcattctgcaccctttgtcatccagaggcggcgggcccgatgacatgcggagacaaaatttggtcattccgcacccctttgccattcagacacagtccgtgtccgatggcgcgcagagacaaaattggtcattctgcaccctttgtcatcgtaggcggcgggcccgatgacacgcagagacaaatttggtcatcttccgcacccctgttcacaagatccgtgtcatactag

SEQ ID NO: 48826 - DNA, 207 bp, Glycine max
  Peptide Sequence Number=SeqID_140511
atggtgggacgaggaagggatgcattggggaataccaatagcccgcatttgggttacacccgaagtgcttacccctacagtctaccctctaactttacggcacctgccatggaagagaacatggaccatgccattccctttaccttcaaagggcagcctccccagcctgtagggggcgcccgcgaaaagcctcaggagcgtgcctaa

SEQ ID NO: 48827 - DNA, 585 bp, Glycine max
  Peptide Sequence Number=SeqID_140512
atgaacacattggagaatggaggaatccattctgggaaaataacaaagatcgcatttccctgtcaagagggtccgctcttgacggtgaagaacacattggagaaggaaatccatgggaaaataacaaatataacatttcccagtcaagagggtccggtctttacggtgaagaacacattggagaatggagaatccattcgggaaaataacaaagattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcaacacatccccctttcgccagctggcgtaatagcgaagaggcccgcaccgatcgcccttcccgacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 48828 - DNA, 252 bp, Glycine max
  Peptide Sequence Number=SeqID_140513
atgctgaaatcatgcctcggtttgcatgccgtttctctggttccagtccctcgcgtttctctgcacccgtcggggcctgttttcgaaatccccagtggagttgccaactgtcgcaacctacccttcggcgggagggcgacgcgagggctcacgggtgcgtcttccatgggaggaagatgcgcggagtcgccaccaacgtttattcgagaaaaacgtcagaaaaaccggaaaggtgtggtctacgaactttaa

SEQ ID NO: 48829 - DNA, 228 bp, Glycine max
  Peptide Sequence Number=SeqID_140514
atgagtttgaaggatgatgacaagtgtagtagtgacaaaaactcaaagaagggccccccagcgaagacgatgcaaaagaccttacatgacatgcaaatgagagaaactgtgatggaatgctccagcatcttgctgattcctgccagtggaaaaagattgattgtttgtatccaaatttcgacaaagaggcgagaaatcttagtcttggacttgccattgatggaatga

SEQ ID NO: 48830 - DNA, 399 bp, Glycine max
  Peptide Sequence Number=SeqID_140515
atggttaaggaggagtgtaaggaggtaagtgtctcctccaagaggttagctaagaaggaaattcattttgcaataaagacaaacattaaagaaacttcccttcttagacaacctccacatcttctcctttgtaaaaggacacttcttagcactgtcacacctcttaaacttaaggttattcctcaagtaaaggagttgttggatgaggatttggttcgtaagagcttaaatccttgtgctttgttggtgcccaaaatatgtattatgaggcaccaaatccctaagataggtggtgttgagggaagaagtccagagtttcaaaaacctctagatttgaggtcaaatccttttcaaggggcatgggatgatgcaatcatacaccccaagggcattggatag

SEQ ID NO: 48831 - DNA, 432 bp, Glycine max
  Peptide Sequence Number=SeqID_140516
ccgtagagatgcttcacgtttggggacttccaaatggtaccgattgttgaataatttgaggagatatttggatgccctcttgggggaagaaaaccgtatctttttctccaggtttctttcctccttgagcaagattgcagctgtggtcagagatttggcgagagagttggatcatatgaagcaaactcgaaacggcgtagtgggcctaccatggaaatacttggaaggcaaggcaagggatatggcaagtcaagaaaagtgggtctcgtttgcggatatactagctttgctaatctttggggttgtcctctttccgaacgtggacagtttggtggacctagccgcaattgatgctttccttgcatatcaccatagcaaggagagcccagtggtggctattttggcagacttatttgatacatttgaccgaag

SEQ ID NO: 48832 - DNA, 975 bp, Glycine max
  Peptide Sequence Number=SeqID_140517
atgcgagtacgaaagatcggtggacagctcccaggccggggtcggtcgcaggatcaggttcaggccacccccggtgtattcctcgccacgccagtagcggttggaggtggagtcgatcgaggtgctgccatgcaggtggcgcacgatgccgtctgcgtccacgtcgcgctgggtgatgccgcgacgtgcgttggacaggctcagatcgctgcggttctcgtcccagttgcgctcggtgtgttcgaagtcgagattcacttcaaccacgtcattgggccgccactgcagggcagcgaactcgctctggcggtcgttgcgctcctgcttgagccggtagatgcggctgctgggcaccaggtagtaaggtgcgccgttggcgatggcctgcgcggacacttcattgcagttggcattgcccacgttctgcgtgccatcgcaggcataccaggtggaaccgctggtgatgctctcttccggatcggtgccgtccaggcgctggaaacccagcgaaatgcccagcttctgcccgttgccgaactcgaactggtcgatgtagctggcggtgccgcggtagccgatgccgtcgtcgtcgcggtacttcttgtcatactcggcccagctgccacgcagatcgatctgcgccgcccgcttgccgtactccagtgggcgcactgtttccaggccgatggtgccggccacgccgccttcgatgatgtcggcgcgctgggtcttgtagatggcgaccgtattgatcagctcggcggggaacatgttgaagttcaccgagcggtcgccactgccgttggtgatctcgcggccattgaagttggtgctgctgaggaaggcgcccaggccacggatggagatttccgaggccccggtcttgtcgcgggtcgaggcggcgccggtcagggtctcgatcgcgtcggccagcgagggcgccggcaggtcgccgatgtcatcggccgagagcac

SEQ ID NO: 48833 - DNA, 660 bp, Glycine max
  Peptide Sequence Number=SeqID_140518
ggtggacccttgggtactagtaccctcaccctcagagggctacgcgccctcgccatcagagggctacgcgccctcaccttcagaggaatacacatcctcaccttcagaggactacacgtcctaaccttcagagggctacacgtcctccccttcagagggctgcacgccctcaccttcagaggactacacgtcctcgccattagagggctgcacgccctcaccttcagaggactacatgtcctcgccttcagagggctgcacacccttaccttcagaggactacacgtcctcgccaccagaggaatgcatgccctcaccttcaaaggactacacgtcctcgccttcagagggctgcacgacctcaccttcagaggactgctcgccctcaccttgagaggactacacgtcctcgccttcaaaggactatacgtcctcaccttcagggggctacacgccctcaccttcaaaggactacacgtcctcgccatcagagggctacacacccttaccttcagaggactacacgtcctcgcctttagaggactacacgtcctcaccttcagaggactatacgtcctcgccttcatagggctacacgccctcaccttcaaaggactacatgtcctcgccatcagaggggctgcacgccctcacctttag

SEQ ID NO: 48834 - DNA, 252 bp, Glycine max
  Peptide Sequence Number=SeqID_140519
atggtccttatgaaaacccgtctttatagtcttatttaccaacaacgacgggtgctcgagccaccgtcgttgaaacctcaaagaacaatgacggtgtcctcaccaccgacgttgacatactaccaaacaacgtcggtgccactgacgttgtattcttgcattacaaagacaggtcctaggatgaccgatgttgttgttgtcgacaaaaaaaaagacatctggaaccccccccccccccagggcccgtcgtag

SEQ ID NO: 48835 - DNA, 480 bp, Glycine max
  Peptide Sequence Number=SeqID_140520
atgtgggatgctaccatattcggggtgtttaatcaaaacttcttgttgtatataaagcacgaagatctctctgaaattgcacacggtggtcaatgtctcagcatatctgttatacagttttggattcttcatctgactgagacaagtgtgcgagcggggaattctgatgtgtatggattcctcgagccacagtccattcagagatctgggcaatcacaatttgaatccgaaagttacatcaagagttggatacagagttcaaaacgagatgtttaccttggagcctacctgaatggacaaaaaggaatcactgaatgtggctactacgtgatgcactggatgtccacgataatcttaggatctttcaggaatagttgggagacgtattttaatgaagttagaccattggaagcagagagattcaaggcacttcgcatacagtgggcacagtattatctaaaagttagaaatcaaacatag

SEQ ID NO: 48836 - DNA, 114 bp, Glycine max
  Peptide Sequence Number=SeqID_140521
atggacatgctcttgaatcgacatcgtttgttctgttccaataggacttattgttttggggacgggaaagcagttgatgatgggcaagtatctaaggttagtaaaaatttataa

SEQ ID NO: 48837 - DNA, 784 bp, Glycine max
  Peptide Sequence Number=SeqID_140522
gctgccgtcccttgggacgggcgtgtggggtgctaataccttccccgtgcgtaaatacaactcccgaacctttcaccaaaaagttcgtagatcgcgtcttttccggtttttccgacgttttcctcaaataaacgttggtggcgactccgcgcgtattcctttcgtggaacacgcatcccgcgagtctcgcgtcgccctcccgccgaagggtaggttgcgacaaggcccaaatgttaaaaccaacccgctagctagtcatggaggtgctagcgtgaacgccgtcgtagaggacgggccatcacggacaaagaggttgggagacgtggctacttctagatgcttcatctatcaatcactgcaagcggcgtgcatggtctcccgagatggagatgaaagggatgaatgtttgtttcacctcggggagtcgcatgacatggaaacctgtcccgtggtggaagaattgcttcagcggctcatggattgcgggcagcttgaagtgttcataggagggaaggaagaaccacaaatttgcatgcagtcggaagagaagaagggaaccggctccacacccatatacccgcgggcggcgcccaagccaacgccatttgcatatcaaagtaataaggccgttccgtggaagtacactcctcccacgtccagcgaaagagttgtaaccgaagttgactccctatcagctaaggtaaccaacatcaccggcctcagtggcgtaacccgtagtggtcgggtgttcgcttcctctcacccggcggaattgccctcgtaa

SEQ ID NO: 48838 - DNA, 444 bp, Glycine max
  Peptide Sequence Number=SeqID_140523
atgaccccgcgggaaaatatcttttgcgagctccgccagcttcaatgccgtaagcggagtgatttccgaaggtttaaagagaaggccagcatgttccagcccgccagcagcgggccgaacccagattcaggccgcagcatccactcaacggataggtttgccacgcctgttgcgccaagtccattgagtgcttccactacagactccatgatggatcgcggcggatcaatcgggcaatgtccggctttgaagccgtcaatagcgaccgacatcggtaatcaatgccggcattacgtcatgatcgaacacaacagcagcggtttaccggcagttcttacaaaaagactcccagtttcgcccagcgtttgcatgttcggtaataacgtcagcgcattttcagtaaacattcggcgcgagttttcggcgttgtctggctccagctga

SEQ ID NO: 48839 - DNA, 651 bp, Glycine max
  Peptide Sequence Number=SeqID_140524
atgacgaattcgatttatcagcctatcaccctcaacgatccgcggttgttgcaatttgccgaacagttgaatcctggcgccagtccgatctatctcccggtcattgataaaccggggcccgagggaaacgcctactggaacgtcagcgcggcgattgaacaggtcggtggaaaaatgctgctgggctgggaaataaactactggcctggctgttttctggtcgcaacacatcatgccgccttacaggccgacgatggtggtgtctatgatgtgactcaacgttcgcaagccgcggcggtgcctaccgttaatctgtttattcccgacgactcaattgctattgacctcgataaaacgccggccgtgaaatcacgattttatatattacattccgccgcccaaattacggactatctcagggcctatgacaatctcaacgctttcgagaaaaagctaagcgataagctttatgagatcggctatcgctgtgaaacaaataaagcgttggcgagcggcatcgtcggcacaacgcctgccttcgtggaaggcagttcggtcgatattgacgaaataaaaatgaatatttctgagttaagctggatattaaaagataaaattaaaaagctaaaacaatattctgacgcactacag

SEQ ID NO: 48840 - DNA, 204 bp, Glycine max
  Peptide Sequence Number=SeqID_140525
atggtgcctttcattgcccagtgtagggctttgaggattcacaagcgactctcctcaatttcagccaacccgcatcaattagactttgcaccttacgcttcagggccttacaatgctcagtggaatgccccggggctcctccatgataagcacatgttgcgtccgagttgtatcctcagaaaaatggaggttgaggaaacctag

SEQ ID NO: 48841 - DNA, 300 bp, Glycine max
  Peptide Sequence Number=SeqID_140526
atggctgggacgccacagccgggccataccctatccacccgaagtcttgacggcacattcctcctccccggcatcccgggttcataccctaatccatatttgtatggatttcccttgatatcgaccatgtcggcattcctgaggccgtccttacctagacccattctgggctcaaatccgttcctgagcataacccgcgtcaccattatggccgcgttggagagagaaggtagcaacggactttggttccacaaaggcgcagctcaccacctcgaaggattggaaagccgtttccaatga

SEQ ID NO: 48842 - DNA, 108 bp, Glycine max
  Peptide Sequence Number=SeqID_140527
atgccaatccaacaaggacctaacatattccagagaactactaagctggaggagaccttgactcagtttatgcagaatagaatcccaaggaggaatgcaaaactgtga

SEQ ID NO: 48843 - DNA, 258 bp, Glycine max
  Peptide Sequence Number=SeqID_140528
atggcctctggtaatcgattaccaagggtaggttttcacatcctgaagctatgtaattcgagtttggcctctggtaatcgattaccaatgaggtgtaatcgattaccaaagatgaaaagccttgagatatcccttttacttgcatgtagtggtcatgggacgcattgtgttgctaccgcagttagatctctcgtgaaagagtctacctctttccttttctttcttgtagatcgcgatggcggcgcaaaaaatccatga

SEQ ID NO: 48844 - DNA, 273 bp, Glycine max
  Peptide Sequence Number=SeqID_140529
atggtgaaagttggaacctctacgtgccgatcaacgtctcatttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 48845 - DNA, 426 bp, Glycine max
  Peptide Sequence Number=SeqID_140530
atggagctcatcgagaacatggcggccagtgatcaagcaatccttcgtgatcgaagctatgtgcctacaaaaagaagccttttggaacttggcacgcaagacgcgacattggcacagaataagctgttgacgaggcagattgaagcccttactgaaaccctcagcaaaccacctcaacagttacaagcggtagaaggatgccccacatgcggaggaacccatgagcctggacagtgtgtaagccaacaggatacttctcgagaagtaaactatatgggcgtaccaaatcgcggataccagggttacaaccaggggaactcatctggatttcaccaagggggagcaggattcaatcatggaccaccaggattcaatcagggtaggaacttcacgcaaggttcaagtggaggaagtgggatcctctag

SEQ ID NO: 48846 - DNA, 624 bp, Glycine max
  Peptide Sequence Number=SeqID_140531
atgaggctactactttaccctcctctagtaaaagtgaagaagcaaaagggggaagaatctagtgaagagatctacccccaagaagaaggacaaccactaatggttaaggaggagtgtaaggaggtaagtgtctcctccaagaggttagctatgaaggaaagacattttgaaataaagacaaatattaaagaaatttcctttcttagacaacctccacattttctcctttgtaaaaagacacttgttagcattgccacatctcttaggcttgagtttattcctcaagtaaaggagttgttggatgagggtttggttcgcaagagattaaatccttgtgctttgttggtgcccaaaataggtattattaggcaccaaatccctaaaataggtggtgtgatgaatgctttgggtggtgcaacactcttttgtaaaatcactcgtgcacccaacatcttcatgatttgtgtacatagggactcattaggtaggaataatcaacatgaaaatacagaaaaaggtatgttctattgctttacttttcttaattttttaaattgtgagcaaggggttcccatgaaccctaagagaataaatgtcattcctgagtggcccgctccaccaagt

SEQ ID NO: 48847 - DNA, 354 bp, Glycine max
  Peptide Sequence Number=SeqID_140532
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgtacgatcacatcaggcgtatgctcttgatatgccgctaa

SEQ ID NO: 48848 - DNA, 207 bp, Glycine max
  Peptide Sequence Number=SeqID_140533
atggaggttgaggaaccttggttggggttatggctaccattgaattatcgagtggatatgggatcaagtttagcatatgacaacggaatttggggctttgtggttgatttagggatggcctttgtggataactgggtggtgggtaaggaggtttgttattggttgagtaatgacattgttgggttggtgggaaacttggccgtatag

SEQ ID NO: 48849 - DNA, 93 bp, Glycine max
  Peptide Sequence Number=SeqID_140534
atgactgggacgccacagaggagacgccacttcaaggagaagatgagtctagaagaagctcaccaccataggaggccatggataagagcttga

SEQ ID NO: 48850 - DNA, 432 bp, Glycine max
  Peptide Sequence Number=SeqID_140535
atggaagggttagtggacctagcagcgattgacgctttcctcgcctttcatcatggcaaggaaagcccgcttggctaccccatgagaggagcgccattagacgaaagcatcacgcctttcatcgcacggggttttagtgaccacaacgcgagggacaaagagcttaggggaagcagtaataggatcatcagcagctatcataagtggctgagagtccgaacacaaggattggattggctcccaaatctaaagactgtgagggacgatgaggttaaagcttcggaagaaagtgatgaggtacaagccctaaaggcagagcttgaaagagcccgagtagtcgaagagaagttcaagtccatagccatcaaaggcagcaatagcaaactcaagctccgaagaggtgaaaggaatcatcacaggtcaaaggcatga

SEQ ID NO: 48851 - DNA, 399 bp, Glycine max
  Peptide Sequence Number=SeqID_140536
atggtgagggaaggcataggtcacatcttaaaaactcactcccatagaagagaaaaggaaagaaagcctcaagaggctaacattaacctcccatacttccatgggaaggacaatgtagaggctaacttagtttgggaaataagggtagagcaacaacttaaaaagaagtctacatcaaaatcttatggctctcactcttatccaaaaaaggaccaaggtcaaggcatcttaggggtgacaccttctaagcccaaagatgataaggggaagacaatagaaaagcaagcccctaaggctagtatgcaagagaaaactagctctataaagtgctttaaatgtcttggaagaggccctagggttctcatgagccttagggtagatttcgagcccatgggctaa

SEQ ID NO: 48852 - DNA, 429 bp, Glycine max
  Peptide Sequence Number=SeqID_140537
atggcacaacctccaccccgtgagatgactctaagggaaatggctgcacctgatttcacctacgaaagcttgtgcatccaataccctgatgaggatgtcccatatgttcttaaaactggactgatccatttgcttccaaagtttcatggccttgtaggtgaagacccacacaagcatctgaaagaattccatattgtttgctccaccatgaaaccactagatgtccaggaggatcacatatttctgaaggcctttaatcattctttagagggagtggcaaaggactggctatattaccttgctccaaggactcataacatggaaagaagtatgatagatgctgccagtggtggagcccttggagacatgacccctgctgaagccagaaatttaattgagaaagatggcttcaagctcccaacaatttaa

SEQ ID NO: 48853 - DNA, 723 bp, Glycine max
  Peptide Sequence Number=SeqID_140538
cgaccctgcccgatacaatcttcagttccaggcccacccgcaaattaaccgttctgcgccattaaaggtcagagtgttagtgctgaaatccgatgcggaattcatgtccgccgatttctactccttacaaaataacgcgcaaaaagttctcgccggcaacttgctgaacagcgatgaatttttcctgatgccggggcaactggcaaaaaaactcagcgggcaaagctcgccggaggcgcgttatatcggagtgatggcggaataccaatctctggatggtaaaaagtggcgcatttctcttcctctgccaacgcctggcgaaacccctttctggcagttctggaaactgtcggcagatcaactgcaagccaatttatatcttgacgttaacgggatccgcgtccgctcctggctgtggggttttcttgagattgaacttgatgatgcaatgctgcgtcaggggtgcattgccctgagctatgccagcggcctgctgccggatggaactttcttccagtttcgcgatgctcgtcagggcccggcgccgttgcaaatcccggataacgtcacgggcgaaaaagtcgtattggccttgccggttcgtcgcggcggtcgggaagaggttatcttcagcgaggaaaaagactcgctggcgcgatttaccgcgtttgaacaggatgtggaagatgacaatgcgctgtcggttggcgatgccaccgtgcg

SEQ ID NO: 48854 - DNA, 282 bp, Glycine max
  Peptide Sequence Number=SeqID_140539
atgggattgaggagcagaatcgtcttaggcgatggtcaaatgccgggccaaatccaaagacagagacaaatcaaggtaaatggtaacgcggccacagtttgctgcgcaatgtcatttcctgctctcaggtacttagggacagatgcgagtagaggctacgcccatgatcgatggatcatcgtcccatgcccagcttcggacaagcgggaagcgcagctgggaggcaacctagtatcctttaaattcccagttattattactgtagtatctttaagggaatag

SEQ ID NO: 48855 - DNA, 120 bp, Glycine max
  Peptide Sequence Number=SeqID_140540
aactcctctgaaggtgagggcgtgcagccctctgaaggtgaggacgttcagtcctctgagggcgagccaataggtcaagtaccaaaggactttaaccttagggaagcaagaaaggaagag

SEQ ID NO: 48856 - DNA, 81 bp, Glycine max
  Peptide Sequence Number=SeqID_140541
atggtggaatcggtccaaccgaatgtgccttatgatcatgaagcactctattccagaggcgtttcggggctctatttctga

SEQ ID NO: 48857 - DNA, 591 bp, Glycine max
  Peptide Sequence Number=SeqID_140542
gactacacgtcctcgccttgagaggactacacgtcctcaccatcagagggttgcacgccctcaccgtcagaggggtacactccctcaccttgaaaggactacacgtcctcgccagcagagggctgcatgccctcatctccagaggattgcacctcctcgccttgagagggctgcacgccctcacctttagagggctacgtgtcctcattttcagggccagtagtttccttttaacggttcctgggccaccccctgatattggaggagggccaactgtgcgagcacaaccagagagggaggctatcacacagctactatgcataccggggcaagatttcacccgtgcctgcaaagagacgaatatagatgacattgctacttcgcaacattctgcccagcgaccgcaatgccaatctccccctgcaaaagtatcagttggtctgtgtcgtcccaacatggggatcgcacccaagagacacccagtggacccggaaaagtccaacagggccctggggtttccagctttggttacgggcctctatcagtcctacagggtgctcgtacccccccgacaaggtcacatcatcatag

SEQ ID NO: 48858 - DNA, 330 bp, Glycine max
  Peptide Sequence Number=SeqID_140543
gggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaagatggagctggaacggctgatcaaaaggctctcagaaagtggcattgatgatggagaagcagctgagcaagaagatgaagcagctgaggaagaggtagaagcagccgaggaagaagaagaagctgctgaggaagaggaagatgcagcagaggatactgaatcagatgatgattctgaagccaccccatga

SEQ ID NO: 48859 - DNA, 264 bp, Glycine max
  Peptide Sequence Number=SeqID_140544
gatgccttgattgctgaactcaaggacacatgcaaggtgctggaggcaaccatcaaagccaccacagagaagaaaatggagctggaacggctgattgaaagactcacagacagtggcattgatgatggtgaaacagctgaggaagaagaagatccagctgaggaagaagaagcagctgtggaagaagaagaagcagctgaggaagaggaagatgcagcagaggatacagaatcagatgatgatgattctcaagccaccccatga

SEQ ID NO: 48860 - DNA, 577 bp, Glycine max
  Peptide Sequence Number=SeqID_140545
atgttggtgcgcgtgatccgcactcgtctctttgcagctgcacgggtgaaatcttgccccggtatgcatagtagctgtgtgatagcctccctctctggttgtgctcgcacagttggccctcctccaatatcagggggtggctcaggaaccgtgtggatatggagcccactgaaagtgaggacgcgtagtcttctaaaggcgagggcgtgtagccctctgaagttcaggacgtgtcgcctttcgaaggcgagggagtgtagtcctatgatggcaaggacgtgcaatcctctaaaggtaagggcgtgtagccccacaaaggtgaaggcacatgaccctttgacggcgaggacatgtagtcctctgaagttgaaggtacatgaccctttgaaggcgaggacgtgtagtcctctgaaggtgaaggtaagggcgtgcagccctctgatggtgaggacgtgtagtcctctcaaggcgaggacgtgtagtcctctgacggtgagggtgagggcgtgcagccctctgatggtgaggacgtgtagtcctctcaaggcgaggacgtgtagtcctctcaacggtgagg

SEQ ID NO: 48861 - DNA, 249 bp, Glycine max
  Peptide Sequence Number=SeqID_140546
atggataagagcttgaaggtaggagaatatgagtggggggagagggagagaaagagcaagaaattttgtgcctcaaataaggttattttgatgatgccaaagaatcaagagttaagcaaagtttcaagcaaagattcaagaatcaagaataatcaagatcaagattcaagactcaatattcaagaatcaagagaagactcaatcaagataagtactaaaaagtttttcaaaacattgagtaatacatga

SEQ ID NO: 48862 - DNA, 143 bp, Glycine max
  Peptide Sequence Number=SeqID_140547
gacttcatttatcgtgcaacaaaggacgccaagtacctcaaagcggctaaccaaaggttgcatgtcatcaaaggcttcgcgcttgacaatggacgacacatgaacagcgctaggcaaaaacattcatggggctccgaaaaagg

SEQ ID NO: 48863 - DNA, 198 bp, Glycine max
  Peptide Sequence Number=SeqID_140548
atgatgcatgcacctgactcaacactcagatgcaatgtgggaactgtgctgagtttgtcgagaccacccggttgtgcacgtaacagcccccctcccataggtgatcagcctgggagccccaaaggtgttcccctactaggtagccccctagtacaaagtacacttggccacagttactctatttcctgtgtcgtatga

SEQ ID NO: 48864 - DNA, 180 bp, Glycine max
  Peptide Sequence Number=SeqID_140549
atgaaggattgcagaaatacaagtagtggggatgtctcctccacctctagaacctcccaatcactcacaaaggatcaagccgatgttttgatgatgccaaaagatcacatgcgtctcaaagctttattcaagacaaagcaattaaagatattcaagatagatgatcaagacagtctatag

SEQ ID NO: 48865 - DNA, 73 bp, Glycine max
  Peptide Sequence Number=SeqID_140550
atgtccgattgtgtcccgtggtatatcgagacgatcaagcttatcgataccgtcgacctcgagggggggcccg

SEQ ID NO: 48866 - DNA, 165 bp, Glycine max
  Peptide Sequence Number=SeqID_140551
atgtggaccaccacgggggaggtggttgccgcccagctcgcccaggcgagctcagctcgcccaggcgagccaggttgcttcctccagaagcaacagccttctggaggaaatattctggagggcccaagtgggcctgggtgctatttgcacccccatttttactaa

SEQ ID NO: 48867 - DNA, 673 bp, Glycine max
  Peptide Sequence Number=SeqID_140552
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcagatcatcaggcattagattctgataagaagcacacaacctggatccctcacatgctgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48868 - DNA, 468 bp, Glycine max
  Peptide Sequence Number=SeqID_140553
atgggtcaaaagagacacttaagcttgtgtcagaatcacggatctttggttcgttgggactccaacaagtctgagcaagcggaaattgtttttcctgattctgagttttcatatttcagggtgatcaaaattcatgctgtatgtaaattgggccacctcaagtcttggaaagctgatttgaaagagaattccacttatgttatgcataatttcaaagttgtcaagaatgatgtgccgattgttagagaagctgatttgcatgaactgccttttaaggaatttagatttgttgaatttgcaaatgtcgttgctggcaatttcatggctggcctgttggttgtggtgaaattttatcttgcacactttgggagaattactataagttttggcgttgctgtttttggcatttacaggaagttatccagcttcagtgagcaattccttcaaggcgtcaaaactattgattaa

SEQ ID NO: 48869 - DNA, 192 bp, Glycine max
  Peptide Sequence Number=SeqID_140554
atgatttttagggggttggacctgaatcagggaggggagggggccctgatggactcttcggagtgtaggccttgggggtcacccgggtttgagtgctcctttaagcctatgctgatcccatatggttggagcattctcgcaaaacatcgtgaccctgactggtctccctatgatcttacttttagcgtgtga

SEQ ID NO: 48870 - DNA, 360 bp, Glycine max
  Peptide Sequence Number=SeqID_140555
atggatcgtgttacatcgctgcttcgtctactaccaaacacatttaggactgtcgatgtccctgttacttccagtttcaccttgacgaagatgtcatgcaccataaaagaacacgctttacggtgcccttaccaaactcgtgcaatagctagagtaatgggtgaagtagaggaggtacaagagaagatgaaggccgacatggaggccatgaaagagcaaatggccacgatgatggaggccatgatgatcatgaagaagataatggaagccagtgcggttgcagttgccgctaccagcactgttgctaaggtgaacccgatgcccccatctggcctcaaccaaatgaatcatccaacctga

SEQ ID NO: 48871 - DNA, 331 bp, Glycine max
  Peptide Sequence Number=SeqID_140556
atggcttcgaaaaaactttctgcgaagagatctaggagggacgccgtggctgaagggaccagtgccgcccccgagtttgatagtcaccgtttccagagcgccgcgcatcagcagcacttcgaggccatcaaaggatggtcgttccaccgagagagatgcgtccagctcagggacgatgagtacaccgattttcaggaggagataactcgcagacattggacgtcgctggctactctcatggctaagtttgaccctgaggtagtcctggagttttacgctaatgcttggcccacagcccagggagtgcaggacatacggtcatgggtgaggg

SEQ ID NO: 48872 - DNA, 423 bp, Glycine max
  Peptide Sequence Number=SeqID_140557
atgcaacaacctggaacaattgagcagctcaaagcttatgctgcaaatatttacaatagacctcctcaacctcagcagcaaaatcaaccactaacaattatgatctctccagcaacagatacaaccctggatggaagaatcaccctaatctcagatggtctagcccttacaagaagcaacatatcacctctcttccttccaaaatgttgttggctccaagcagaccatacattcctccacacaatcaacaacatggcaacgaggccccgaaagccacacttaaatcaggaagtgaaagaattacatggtagaaagtgcttctccgcattgattggtaaatctgttccccaaatccctgaaaaatgtaaggatccaggaaggatttctcaaggacattcccatcattctagagcagacttttaa

SEQ ID NO: 48873 - DNA, 435 bp, Glycine max
  Peptide Sequence Number=SeqID_140558
atgcatgaaaatctcactttttttatttataggtgtggccctatcccatttaggaaaactgtcttttatgttagcttcaatcgtcaaggttaccattatttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcaacctgaatggcgaatgggacgcgccctgtagcggcgcattaagcgcggcgggtgtggtggttacgcgcagcgtgaccgctacacttgccagcgctgat

SEQ ID NO: 48874 - DNA, 460 bp, Glycine max
  Peptide Sequence Number=SeqID_140559
atggctacctcaccaaaagaaacttcagcttctggttcaccctctgtaccctcatctccgcaccaggaacaacctgaattcaacatccaacccatacaaataattcctggttcagcccctgttcctgagaaactggtccctagaagacaacagggaatgaagacctctgaaaaccctagccttgcaacaagtcctagggaagtagacatggagatggataagaagatccgcagtattgtgagtagaattttgaaagatgcctctgtccctgatgctgataaagatgttccaacatctggcaccccaaatgtttctgtgcctgatgctgataaagatgttccaacatcttccgctccaaatgctgaagccctctcttcacccagtgaagaggaatcaacagaagaagaggatcaagcctcagaggagacccctgcaccacgggcaccagaacctgctccag

SEQ ID NO: 48875 - DNA, 282 bp, Glycine max
  Peptide Sequence Number=SeqID_140560
atggtgaagaaaccaactcgcgtgggtgagctcattgctttagcactaaatttcagctcgcctgggcgagctgcctttgccccaagtgctcattttcctataaataggcatgctagggaggctgaggaagggttccaagggtcagaaggtgagggaattgagagaagagagaaagaagaagaagaaagaagaggaaacgaggccgaggcgctaccaaatcgcgaccacgatcattctttacttcatttcttgttctgcgttctttgtgcgaccgtcgattag

SEQ ID NO: 48876 - DNA, 75 bp, Glycine max
  Peptide Sequence Number=SeqID_140561
atggagttccttgagcttaaacaagggagtatgacggtggcagagggaaagctggggagaggtccaaatgcgtga

SEQ ID NO: 48877 - DNA, 588 bp, Glycine max
  Peptide Sequence Number=SeqID_140562
ggcggtgggcccgatgacatgcagagacaaattatggtcattccgcacacttcgccattcagacacagtcgtgttcgatggcacgtagagactaacgtcatcttctgtgccttttgtcatccagaggcggcggacccgatgacatgcggagacaaattatggtcattccgcacacttcaccattcagacacagtaatgtccgatggcacaggcggcggacccgatgacatgcagagacaaattatggtcattccgcacactttttcgccattcagacacaatcgtgtccgatggaacgcagagactaacgtcgttttctgcgccttttatcatccagaggcggcgagcccgatgacatgcgggaaccatttggtcccgcactttttacttttgtcatccagaggcggcgggctcgatgacaggagcaacaagttgagtgataaacgtgcagagacaaattatggtcattctgcgccctttgtcattcagggacggtacatggcacccatcgttaggcgattcatgaagctccgtgacatgccggaagtcaaaagaaagcattgttgcacaatccgtaaagttccgtaa

SEQ ID NO: 48878 - DNA, 128 bp, Glycine max
  Peptide Sequence Number=SeqID_140563
tggagaatgggagaattggcgaacagcgctacgcaatgacttcgcggggctccgaactcgaaggtggaggacacatgaacagcgctagactcgaaggtggaggacacatgaacagcgctaggcactaa

SEQ ID NO: 48879 - DNA, 363 bp, Glycine max
  Peptide Sequence Number=SeqID_140564
atggaacttatgagacttcatcaccatgaagagaatgatataaagagaaaaggaataacactcagaacctcatcatcttttattcaagaagaaagtgacaaagaggacttgactgaaacagaagaagatgatgatgatttcagactctttgtgaaaaggttcaataaatttctgagaaacaaaagaaataaaagaaaatcaaacatcaatacaaagaagaaagaagaagactctttcttagccccatcatgctatgaaagtaatcaaccttggcacatgagatccgattatcttgtctttgaaagaagaattgaaaaatccgacaagaggaatctcaaagaaaagaaagaaaagaaagcatag

SEQ ID NO: 48880 - DNA, 699 bp, Glycine max
  Peptide Sequence Number=SeqID_140565
atgcgatcatgggtgaggggtcagtggattccctttgatgcagacgccctcagccaattcctgggtgacccgctggtgttagaagaaggccaggagtgtgagtttagtcagataaggaacagggccgacgggtttgacgaagaggccattgcccagctattatgtataccgggtcaggattttacccggaccgctgctgggaggcgggtgcggatcatgcgcaccagtataaccaccttgacacagatgtggatgacgttgctgctcagcaatgtcctacccagtgatcataactccgaccttcctctgccgaagtgtatgccacccaccaggcaccctctagacccggataagtctaacagggccctggggtttccagagttgatcacgggcctctgccagttattcggggttcccgtcacacctagtaaggtgatccggccgccgatcacccgagccttcattgagaagtattgcacgcctaggcaggtgcagggtgatgcaccacaggccgcagatgcaccgccgccacctcatcaggctgatcccgctgggtcattaggcatggagtggtatctacagcacttggttcgccaacaggcggccaaccaccgggggcaggtgcaaatacatgaatgtctctaccagctcagcctcagtcagcagggctgccctactctagatcagtttagggctgag

SEQ ID NO: 48881 - DNA, 187 bp, Glycine max
  Peptide Sequence Number=SeqID_140566
atggttgaatcggaaagactcaactacatcaggaacaaccaaaagaaacttagagttgacaagtattgttgcttacaaaattcactggatgctgggacaagccaaggtttaaataaacgcaagagagtaattttgcctcctacctttgttggcagcccccgctacatggatcagctatactttgatg

SEQ ID NO: 48882 - DNA, 612 bp, Glycine max
  Peptide Sequence Number=SeqID_140567
atggcaagacacaaggtcacacgcacacacacacacacacactcacgcaggcacaagggggaggaggggcttggtcgtccgtccgcccgggcacacacctatttagcaccaggcaggcaaaatgagagagagccgacgaacggtagcctcttttggccaaacatagtagaagaagaaagggataccggattgattggttttttgggggggacagggtttgttggtgatttggaggggagggacgaatcaaagcgacaagggctgaatctcagtggatcgtggcagcaaggccactctgccacttacaatacccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 48883 - DNA, 261 bp, Glycine max
  Peptide Sequence Number=SeqID_140568
atgcaaagcttattgctgattccagcttttccaaggggaaaacacaccgaactcaatttttttgcttttgatgtccaccccaaccgcactatctttattgcagaagcaaaggagacactctcttgttttgttactgccttttctctcactctgctttgtcacggcttagatgccaatgctggtccactcacaaattttgaggtccttgatttcttacgatctaaaggagcttcaaaggatccaacaagtgttattgccaaa

SEQ ID NO: 48884 - DNA, 210 bp, Glycine max
  Peptide Sequence Number=SeqID_140569
atgggtgatcaagccacaagcatgtttcagcaaaactccccaaccgagaggcttagccttcgattacaactaccttccttctatcttgatgcaatcctccctaggaagggaccaatcactagaaccatgagcaagaggctccaagaagactgggctagagctgctgaagaaggccctagggttctcatgaaccttagggtagatttctga

SEQ ID NO: 48885 - DNA, 357 bp, Glycine max
  Peptide Sequence Number=SeqID_140570
atggcggctaagtccaccaaaccgtccacgttcggaaagaggacaaccccaaaaatcaacaaagctaatatatccgcaaacgggccccacttctcttggctcgccatatctcttgccttgccttccaggtgtttccgtggcaggcctactacgccgttgcgagtttgcttcatgcgatccaattcttttgccgaatccccgaccacagctgcaatcttgctcaaggagggaagaaacccggagaaaagatacggttttcttccctcaagagggcatcctagtatttcctcaaactcttcaatagtcggtaccatttggaagtccccaagcatgaagcacctcaacggctggtcatag

SEQ ID NO: 48886 - DNA, 216 bp, Glycine max
  Peptide Sequence Number=SeqID_140571
atggcttatggggatatctctgctatggtcaaatctaagatctttccgtatgtcttgcggaaggcttgcatttggagaggtcccatcaactgccccaactccttgatgctgcatgtctgcttcgtgcccgtattcaagggacctagatgggagagagctaaaagggtttttagtgataatccccaaggtggtcatatctctcttgatggtctctag

SEQ ID NO: 48887 - DNA, 132 bp, Glycine max
  Peptide Sequence Number=SeqID_140572
atgagcaagaggctccaagaagattgggctagagctgctgaagaaggccatagggttctcacgaaccttagggtagggtaccctagaaatataggatttttcagcccttgtattttagggcacctagactag

SEQ ID NO: 48888 - DNA, 80 bp, Glycine max
  Peptide Sequence Number=SeqID_140573
ttggggtcatttagagatggctgagttctggacaaagctcggatatgctatattccgttgtacaaatttttgtaccgagg

SEQ ID NO: 48889 - DNA, 165 bp, Glycine max
  Peptide Sequence Number=SeqID_140574
atggcctcattcttgcttataatgggagaggttggaaggtttatgatgcaatcctaccccccaagggcattggatagaagactccaagaagattgggccaaagatgcaagagaaggccctcgggttctcatgagccttagggtagattttcggcccatgggctaa

SEQ ID NO: 48890 - DNA, 513 bp, Glycine max
  Peptide Sequence Number=SeqID_140575
atgatcgaaagttttcaccaacaagatcaaatgtcagttttggaattatacatagaaaaggatgtggctgatggttttatgtttcattctgcaaattctcttacatcatgtgaaaataatttatctgataatgaggcggaaccgccaagaaatgtaagcaatttacatggtgatgaagatgatgatgattatcttatgtctaactcatacgttgaagagtctttagacgaagatgatagtgttgtcggtatatctgatacagacgatgaagtcaccaacatgattcaaccagtaagaattgttcacccagcacaaggtgtagaacaaattcaaaatccattttggaatgatgctttgcattataacaatatcaactggagttatcctgatgaggaggacatttacgggttggagatgccatcgagttttaatgttggacaagaatcatatgttggcatggattttgatagtaacgatacggtcaaaaatgcactgaaacaatatgttatgaag

SEQ ID NO: 48891 - DNA, 927 bp, Glycine max
  Peptide Sequence Number=SeqID_140576
aggactacatgtcctcgccttcaaagggttgcacgctctcgccttcagagggctacacaccctcgccttcagaggactggacgtcctctccttcagagggctacacgccctcaccttcagaggactatacttcctcaccttaaaaggactgcacgtcctcatattcaaagggctgcttaccctcgactacagaggactacgcgtcctcaccttcagagggctacacgtcctcaccttcagaggactacacgtcctcaccttcaagggctgcacgccctcgcttttagaggactagacgtcctcaccttcagagggctacacgccctcaccttcagaggactatacgtcctcaccttaaaaggactgcacgtcctcaggactacgcgtcctcaccttcagagggctacacgtcctcaccttcagaggactacacatcctcaccttcaagggctgcacgccctcgcctttagaggactagacgtcctcaccatcagagggctacacgccctcaccttcagaggactacacgtcctccctttcagagggctacacgcccttgcctttagaggactacatgtcctcaccttcaaagggctgcacgccctcgccttcaaagggcttcacgccctcgcgatcagagggctgcacggcctcaccttcagaggactgcacgtcctcaccttcagatggctgcacgccctcgccttcagagggttgcacgtcctcgccttcaaagggcgacacgtcctaaacttcagagggttgcatactctcgccttcagagggctgcacacccttgccttcaaagggcgacgcgccctaaacttcagagggctgcacgccctcgcctttagagggctacgcgtcctcactttcagtgggctccatatccacaccttaagaggatttaaggtcctctacccttaa

SEQ ID NO: 48892 - DNA, 1254 bp, Glycine max
  Peptide Sequence Number=SeqID_140577
catcttccaccccaaatgtttctgtgcctgatgttgataaagatgttccaacatcttccgccccaaatgatgaagtcctctcttcctccagcaaagagagatcagcagaagaagatgatcaagccacagaggagacccctgctccacgggcaccagaacctgctccaggtgacctcattgacctagaagaagtagaatctgatgaggaacccattgccaacaagttggcacctggcattgcagaaagattacaaagccgaaaaggaaaaaccaccattaagaggtctggacgaatcaagactatggcacagaagaagagcactccaatcactcctacctcatccagacgaagcaaagtcgcaattccctccaagaagaggaaagaaatttcctcatctgattctgattatgatgtcgaactagatgttcccgacatcaagaggaccaagacatcagggaaaaaggtgcctgataacgtccctgatgcaccattggacaacatctcattccactccattggcaatgctgaaaggtggaaattcgtgtatcaacgcagacttgccttggaaagagaactgggaagagctgccttggattgcaaggagatcatggacctcatcaaggctgctggactgctgaaaactgtcagcaagttgggagattgctatgaaggcttagtcagggaattcattgtcaacattccctctgacataacaaacagaaaagaacctactgatggagtgatagatattgatgtttctgagcatcaaattgccaaggaaatcactgccaaacgagtccagcattggccaaagaaagggaagctttcagcagggaagctaagtgtgaagtatgcaattctacacaggattggagctgcaaactgggttcccaccaatcatacttccactgttgccacagaatcttttgctgtcaaattacccattgccttccctactgtattgtgtggcattatgttgagtcagcatcccaatatgttaaactacactgactctgtgatgaagagagaatctcctctatccctgcattacaaactgtttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagaga

SEQ ID NO: 48893 - DNA, 450 bp, Glycine max
  Peptide Sequence Number=SeqID_140578
atgacacagtcagacattcacagagatgaacatcagataccaactaacaccacacaggatgatcaatttgtcggcgatgacaactcagattccaccgataatgatgtaaatatgacacaggaaaacattaatatagaatactcatcaaatgacccaacaatagatgatcttgatgattatgatgaacaaacttttctatctgcctcatctgcataccaaaatacaggtggtacttacattgatattggagatcctatatgggaatgcccacattgtaaagctatgatgtggtatgatgaaaagataaataaagacaaacaaacgaacaaaccaaggttttcattatgttgttctgatggaaaaatacaattgcctttgttgcatgaaccaccccatccattgaatcacttacttttcaataaccaggatcctaaagctaagaatttctag

SEQ ID NO: 48894 - DNA, 994 bp, Glycine max
  Peptide Sequence Number=SeqID_140579
atggtagaagtctccatagagtccattgcctccctcgcccagtattatgatcagccgttgaggtgcttcacttttggggacttccagctatcacccatggtggaagaattcgaagaaatcctaggatgtcctctagggggaaggaaaccacacctcttctcagggttctatccctcattagctagaatttctaaaattgtccaaatctcggcgcatgaattagaccgccaaaagaaagtcgaaaatggggtggttggaataccgagaaaatatttggaggcaaaagcaagaatcttggcaggtaaagacgagtgggccccgttcatagatattctcacactattgatcttcggaggagtcctcttttcgaatgtggatgggttggcagacctagcagcgatcgacgcttttctcgcctatcataaccacaaggaaagcccggttgtcgctatgttagccgacctatatgacaccttcgaccgaagatgtgagaagagcagtacgaggattttttgctgtactccaactctttatgtatggttggtttcacacctttttcgccaagaggtgaggcatgcttgcccactagaaagccaccgttcatgcacagagaaaggaggggtgaattgggaccaactcttagcaagcaaagaaagagcatatgtcaactggttccctcgatggaaggaaggaagaaccagagttcttatttcatgcggaggatttccaaatgtttccttgatggggacgaagggttgcatcagctacaatcccgttcttgctataaggcaacttggctaccctatgagaggggcgccactagaggaagagctcacacctgtcatttcacgagggttcagtgagaccaacgtggagacacttcggaaggtccgcaaagcatgggaagtggtgcaaaagaaggacaaagagctcaaaggcagcaacaatgggcccattggtggctaccgtaagtggttgaaagcccacgtgcaag

SEQ ID NO: 48895 - DNA, 537 bp, Glycine max
  Peptide Sequence Number=SeqID_140580
atgacatggaaatacgatttgttgattgatgttggaaatgcattggcatgtgcatgttgtgtatgttcgtggggggcactatgcactgacctttcagggtctttggcactagcttttggccacgttcatacgttggatgttgtccgcacacctttccgccatccaaagacgatcgagtcctatgggacgcagacacaaattatggtcattttgcaccttttgtcatccagaggcagcgagcccaatgacatgtggagacaaattgtggtcatccgtgcaccttttcgccattcagacacgatcgagtccgatggcacgcagagacaaattatggtcattctgcaccttttgtcatctagaggcgagacaatcaagttcgatagcacgcggagacaaattctggtcatccgcacgcttttgctatctggacagcgagtcgggtggtgggcggagataccttatggtcatccgcacctttcatcgaccgagaggaacgaattcagcagtatcaggatgatgttggtcgttcagtgctga

SEQ ID NO: 48896 - DNA, 747 bp, Glycine max
  Peptide Sequence Number=SeqID_140581
atgagtcatcattcatctagtgttaatggcaagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaaataagagaggaagaaagaagaaaagtaatgaaagaaatgaaaagagaaaaatatgcctcctatagtagtcataactcttgcaaaagcctaagtgaagaacttcgtgactattacgaaggaaggcataggtcacatcttagacctcacttccatagaagagaaaaggaaagaaagcctcaagaggctaacattaaactctcatacttccatgggaaggacaatgtagaggctaacttagattgggaaataagggtagagcaacaacttaaaaagaagtctacctcaaaatcttatggctctcactcttatccaaagaaagaccaaggtcaaggcatcttaggggtgacaccttctaagcccaaagatgataaggggaagacaatagaaaagcaagcccctaaggctaaggacactttagttctcaatgccccaccacagaaaaccatgattatgaggggcaagacatttatagtagccaagatgaggctactacttcaccttcctctagtgaaagtgaagaagcaaaaggggaagaatccagtgaagaaatctacccctgagaagaaggacaacctttaa

SEQ ID NO: 48897 - DNA, 1050 bp, Glycine max
  Peptide Sequence Number=SeqID_140582
atgctggcgcgaatgggcggggatgaatttgccatgaccattggcggagataacgcggaggcccgggccgccgcgtttgccgtttcggtgctggacgcgttcgccaccccgattcagctgggggaacgcacaatccatatgggggccagcatcggtatcgccagcggaaccctgattgaatgcaccagctccgagctgtttcgtcgcgccgatattgccatgtatcattccaaaatgagcgggaaagggcggattacccactacgacgccgaactgaacagcgcccgtgaacgcaagctggcgattgagaatcagatccgtaacggcctggagcgtgatgagttcgaggtctggtatcagccgattattgacgcccacagccagaaaatgagcagcgtcgaggcgctggtccgttggccacgacgtccggaagggcccctgggcccggatacctttatcaccatcgcggagaccagtggcctgatttacaaactggggcagtttgtgttgcagcgggcctgtcaggatctgcagccgtacagtgacttaacgctctcggttaatatctcccccgcacaatttcgcgatcctgccttcgaagaaaaagtggccagcgtgctggagatcaccgattttccggccaaccgactgcagcttgaggtcaccgagtcctatgtgctggaaaacccggagcgtgcccgcatggcaatagccaacctgaaagcgttgggcatcgcggtagcgctggatgactttggcaccggttattcaagcattggctatttacggcgtttcaacttcgacaccatcaagattgataaatcgctggccgggctggtggacaacgatgaacaggcggccgcgctggtaagcggcacggtgcggatcgccaacgcgctggggatggcggtggtcgccgaaggggtcgagaccgaaagacaaatgaaactgctgcggctggctggctgcgatcaactgcagggtttttggttcagccagccgatgccgattgagtcaatcagggcattacatcaggtcagacgatgctga

SEQ ID NO: 48898 - DNA, 440 bp, Glycine max
  Peptide Sequence Number=SeqID_140583
atgaacacagtcaaaaatacaaatacctacacaagatgtgtacaagtagccatcaagcctttaattgatatgagcatagatgctacagtattaatgtgccttagagacattagacataacaaatttgaagattccttaataggaacagtagaaacaagcctaggacaaggtctagtttattttaattgttacccaaacaaaatagtgagtctgatggatagaaacattcttgactctctgttcctaaacatccactttcatgggcttgacatgaaagaaggatcaattctagcagcattaatctataggattcaatacaaggtcatgaatacttatgcatcaagagtccttctaaaaccacaaagaggagagacaaccttgtttatcaccgatatgacaaaggccaatgtttctcttccaagaaccataaatgggatgag

SEQ ID NO: 48899 - DNA, 225 bp, Glycine max
  Peptide Sequence Number=SeqID_140584
aggactacacgtcctcgccttgagaggactacacgtcctcaccttcagagggctgacgtcctcacctccagaggactacacgtcctcgccttcagagggctacacgtcctcgccatgagagggttgtacgccctcgcctttagaggactacacgtcctcaccttcagagggcttcacgtgatgcatcctaccccgcaagggcattggctagaagactccaagtag

SEQ ID NO: 48900 - DNA, 1461 bp, Glycine max
  Peptide Sequence Number=SeqID_140585
accaccattacccgcatcggccagagcgcagctgacgcgttaagcgaccagatgctgatcaccttccgcgaaggggcgcctgcggatatcgaagagttttgttttattcactgccacggcgagctgaagggcgagctgaaggccggaagccagctggagctgggcgaagcgcgctatgccgtgaccgccgtcggcgacgtggctgagcaaaacctgcgcgagctgggccacatcaccctgcgttttgatggtcagccgcaggcggagtatcccggcacggttcacgttgatggtccggagatagacatgagtcaggttgccgttgtcattggtgggggacaaaccttaggcgagttcctcagccgtgggcttgccgcagaaggttaccgcgtggcggtagtggacattcagagtgaaaaagccgcccgcgtggcggatagcatcaataccgagtttggcgaaggaatggcgtacggctttggtgccgacgccaccagcgagcagagcgtgatggcgctggcccgcggcgtggatgagatttttggtcgtaccgacctgctggtctacagcgcgggaatcgcaaaagccgcgtttatcagcgatttcgaactgggggattttgaccgctcgctgcaggtgaacctggtgggctatttcctctgcgcccgcgagttttcccgtctgatgatccgcgacggcattcaggggcgcatcattcagatcaactcaaaatcagggaaagtgggcagtaagcacaactccggctacagcgcggcgaagtttggcggcgtggggctgacgcagtccctggcgctggatctggccgaatacgggatcaccgttcactcgctgatgctgggcaacctgcttaaatcgccgatgttccagtccctgctgccgcagtacgccaccaagcttggcatcaaagaggaagaggtggagcagtattacatcgataaagtgccgctgaagcgcgggtgcgactatcaggacgtgctgaacatgctgctgttttacgccagcccgaaagcctcgtactgcaccgggcagtcgattaacgtcaccggcggacagggagagggaatacaacaaggagccgatatggtcaccgcactcattaccgtcgccgccctcgcctggatctgccagatggcgtttggcggctggcaaatccaccagtttaaccgcgcgtttgacgccctgtgccagaaaggtcgcgtgggcgtcgggcggtccggcggacgtttcaaaccgcgggtcgtcgtcgcggttgcgctggatgaaaacaataacgtctgcgattccctgatcatgcgcgggatgaccgtcttcgcgcggccggtgaaaatccaggcaatcaacggcatttcgttgcaggaattgcggcctgatgtgatctttccccatgatccactctgtcagaatgcactatcattagcgcttaatctgaaacatggataa

SEQ ID NO: 48901 - DNA, 294 bp, Glycine max
  Peptide Sequence Number=SeqID_140586
atggatcgagttacaatgctgcttcatctactgccaaacacatttaggactgttgatgtccttgttacttccagtttcaccttgaccaagatgtcacgaaccataaaagaacacactttacagcgcccttgccgaactcatgctagagctaaagtaatgagtgaagtagaggaggtgcaagaacagatgaaggctgacatgaaggccatgaaagagaaaatggccacaatgatggaggccaatatgagcatgaaggagataatggaggtcaattcggctgcattgctaaggtga

SEQ ID NO: 48902 - DNA, 171 bp, Glycine max
  Peptide Sequence Number=SeqID_140587
atgaaacaaagctaccaaagtgcttttgggttgacgctaaattctttggaagatgaagatgcaggttttcatgataaggatactgcacttgaagatgaaaccaaagttgaagagcttgaacaaagcaaagaaatcattgtcacacctcctaaagacctcccaagagaatga

SEQ ID NO: 48903 - DNA, 189 bp, Glycine max
  Peptide Sequence Number=SeqID_140588
atgaaaataaaaaaaagtgatcaagggcttcccgtggaccttaagagaataaaggtcattcctgagtggcctactccaccaagtgttgaggacagaatccatgagtttcaagaaactctggattcgaggtcaaatccttttcaagggggagggaatgatgcaatcctaccccccaagggcattgaatag

SEQ ID NO: 48904 - DNA, 291 bp, Glycine max
  Peptide Sequence Number=SeqID_140589
atggaagggttagtggacctagcagcgattgacgctttcctcgcctttcatcatggcaaggaaagcccggaaggaagaatcaagattctatcttcatgcgaaggatttccaaatgttcccttaatgggaacaaggggttgtataaattataatcttgtcctcgccataagacagcttggctaccccatgagaggagcgccattagacgaaagcatcacgcctttcattacacggggtttcagtgaccccaatgcaaaggtactccaaggagttcgtaaggcatgtgatgcg

SEQ ID NO: 48905 - DNA, 123 bp, Glycine max
  Peptide Sequence Number=SeqID_140590
atggcctccatcattgcggccatttgctctttcatggcctccatgtcggcctccatctactcttgtacctcctccgctttaccctttactctagctctagcacgggtttggacatggggttga

SEQ ID NO: 48906 - DNA, 511 bp, Glycine max
  Peptide Sequence Number=SeqID_140591
gtgatctcccgttcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggttaccttcaaaagggtcataaggaagaaaagcactgaggagttttcatgcatgccttacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 48907 - DNA, 264 bp, Glycine max
  Peptide Sequence Number=SeqID_140592
atgaccaaacttggtctctgcttgtcatcgggcccgccgcctctggatgacaaaagggtgcggataactgtaagaatgaccaaacttggtctctgcttgtcatcgggcccgccgcctctggatgacaaaagggtgcggataaccgtcacatctccgcgtatgcaaagattatgggtgccaagaatgacaaacttggtctctgctcgggcccgccgcctccaatgggatgacaaaaggggctacgtagttctggataacttgtga

SEQ ID NO: 48908 - DNA, 231 bp, Glycine max
  Peptide Sequence Number=SeqID_140593
atggtagtcgatgtcggtcagaaagatgacctatccaggtctaaaaagaagaatcaccggaagacgacgatcgaacatttcctaatagacatcgtccaaatattatcgggggatggaatagaaaaaaacaatagcagacattggtcgttaatagccccgattgatatttatctatcgacattgtggaatttcatttccaaacgctggccgataatattttttacggtatag

SEQ ID NO: 48909 - DNA, 312 bp, Glycine max
  Peptide Sequence Number=SeqID_140594
atggttgaggaggagcctcagttgtttgttgtcttggttgtgactgctgttgttgtattggaggaggaacatatggcttgcttggaccagcagcattctaaaaaggagggacaggctgttgttgttgtggaggacttgtccatctcagatttggatgattcctccaacctggattgtatctattgcttgaaaggccataattattctgttgttgttgattttgctgttgaggagattgctacaaagaaggacagagatctgtatggtgatctacagaagaacatagaccacagactcttgcaacaggtgtag

SEQ ID NO: 48910 - DNA, 554 bp, Glycine max
  Peptide Sequence Number=SeqID_140595
gaggtagggggtgcagagacaaccaggaggtttgccctagaagcagccccccttgaaagaatgcgtaatagctcactgatcgggcggttcttgcgccgaaagatgaacggggctaagcgatctgccgaagctggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcgg

SEQ ID NO: 48911 - DNA, 732 bp, Glycine max
  Peptide Sequence Number=SeqID_140596
tgatggaaaggttgaatatataggcggagaatttgacgtttgggaggatatgtctgcagattgcctgaatgcatttatcttatatgatctggtgaaagcttgtaagaagtatagcaatataggagaatgtttttggttgattgataaggacttagattttaatcatgggttacggagttgtacaactgatggagatatattacacttagtcagggatgcttttgaaaatgagaatgagataaatgtttattttcatcatgaagtagatccaattttagaaggagtcccacagatgttgtacttggaatgtgatccaattccagaagttgttgagaatgaggatgatttagatgatgtacctattgctggccatgaggaagatgctggtgagcagagggatgctgatgctggtgagcagagagatggtggtgagcaaagggatgctgatgttggtgagcagagagatggtggtggtgaagagagagatgttggtgatagtgaggaggaaaaggaagttgacagtgatgagtggtttacaaatttctcttgtatgatgaatgaagttgaagctgaagttgagacaaatgatgaggatgttgaagtttatcctcaatatagtcaaagtagtggagttggtgaacagaagttggaattagggatggagtttgatactctagatgaatttaaatctgccttaagggagtatagcatattgatgggcagggagttcaa

SEQ ID NO: 48912 - DNA, 660 bp, Glycine max
  Peptide Sequence Number=SeqID_140597
atggctacctcaccaaaagaaacttcagctcctggttcaccctctgtaccatcatccaccaaagcaccatcaatccaggaacaacctgaattccatatccaacccatacagatgattcctggtcaagcccctgttcctgaaaaactggttcccagaagacaacagggagtgaagattgctgaaaaccctagccttgcaacaagtcctagggaagtagacacggagatggacaagaaaatccgcagtattgtgagtagcattttgaaagacgcctctgttcctgaagctgatgaagatgtcccaacatcttccaccccgaatgtttctatgcctgatgttgagaaagatgttccaacatcttccggcccaaatgatgaagtactctcttcccccagcaaagagagatcaacagaggaagatgatcaagccgcagaggagacccctgcaccaagggcaccagaacctgctccaggtgacctcattgacttagaagaagtcgaatctgatgaagaacccattgccaacaggttggcacctggcattgcagaaaggttacaaagccgaaagggaaaaactcccatcaagaggtctggacgaatcaagactatggcccagaagaagagcactccagtcactcctgccacatccagaagaagcaag

SEQ ID NO: 48913 - DNA, 291 bp, Glycine max
  Peptide Sequence Number=SeqID_140598
atgaaggagacaacaaaggaagaaagttttgtgaacccgagattgggtttgggtgcacatgagaaaagaaaggtttccgcaaaggaaatcaaagctcaacaaaggggagatggccatttcaagtgcttgaaagaactcaatgaatgcttacaaattgattcccggagtataatttatccaccttcaactctggattttgttttggggctgccaaaaacaagcaatggtagagattccatttttgtggttgttgataggttttctaaaaatgtctcattttattccatgtaa

SEQ ID NO: 48914 - DNA, 627 bp, Glycine max
  Peptide Sequence Number=SeqID_140599
atggtctcccgtggcggaggcgaaagggacgaatgtttgtttcacctcggggagtcgcacgacattgaaacctgtcccgcggtagaagaattgcttcagcggttcatggactgggggcagctcgaagtgtccataggagggagggaagaaccacaaatttgcttgcagtcggaagagaagaaggttcctctaacccccaaggccctagtgatatgttttactagaaaagggaccggctccacacccatatacccctgggcggcgcccaagccaacgccatttgcatatcagagtaataaggccattccgtggaagtatatccctcccgcatccagcgaaagagttgcaatcgaagttgactccctatcagctaaggtaaccaacatcaccggcctcagtggcgtaacccgtagtggtcgggtgttcgtttcccctcacccggcggaattgccctccaaagggaaagcgcccatggtccaagagcccacagacatagccaccccctcgaaagaagtagatcctccagtggcaagaggggctgaaaagaaagaaggtcttcaaggaaaaacagtgactttggaagaggcccatgagttcctccgcctcatccaacaaagcgagtttaag

SEQ ID NO: 48915 - DNA, 237 bp, Glycine max
  Peptide Sequence Number=SeqID_140600
atgccactcactgttgtcgcaaccctacccctttcgcgggcgagcgaggcaagactcacgggtgcgtcttccaaaggaggaaaatgcgcggagtcgccaccaacgtttatttgtggaaaatgtcggaaaaaccgaaggaaaccggtcatgaagaatattccagattcgggagttgtatttacgtttgaggaaggtactaacacctctcatgtttgtcccaaaggacaacaaccttaa

SEQ ID NO: 48916 - DNA, 573 bp, Glycine max
  Peptide Sequence Number=SeqID_140601
atggtcattgatgctgaagtttggaaagcaatagcaggaacaaacatgagtggagtccacaaatttgaagaatctgcagatggctacaataagatgcaggcttatagaggtatgctccttgaccaaacaaggattttaagaaacaaacttggtgttagtggtctgacagctgaggacaaaatgtcggtatatatcattacatatattttggcaccaagatccaacaatcatgctcaagttattgatggtgacttgcagattatatatggattgaaatcagatattatgttgaaaagccttcgactagtggattatgaatttccatatgctgtcttagcttctagattcattgattatttcaatatcaatttttctaacgagatagtagactttaccaaagcctctaatgagataattgaaaggcatctcaagaagcttggcatgacatatgttgatcatgaatggatcatggccggagagcaaccatcaacagcaaacgacaatcagatggaagaagaagctcagcaagagccaactcaacaacgaaacccttttgagtctcttatgatttag

SEQ ID NO: 48917 - DNA, 366 bp, Glycine max
  Peptide Sequence Number=SeqID_140602
atggaaaatcctaaaaaaaaatcaaaaataacgtgctacaattgtggaaaacaaggtcacattagtaaatattgtagactaaaaaagaagttaagaaaccttaacctagaacccgcaattgaagagcaaataaacaatttgctcatagaaacctcggaggaagaaacagaaacttcatcctccgtgctctctgacgaagacctaaacctaatccaacaagatgaccaattatcatcaacagatgatgatgatgggcaaatcaatactctaacaagagaacaagatctcttgtttgaagcaatcaattccatacctgacccccaggaaaagaaggtttttctggaaaaacttaagaaaacattagag

SEQ ID NO: 48918 - DNA, 132 bp, Glycine max
  Peptide Sequence Number=SeqID_140603
atggcaagtcccagtagctttggcatttttgaaagtgagggggaagttttgggtgaagaaaacggaagacacaagtatgcgctctctacgggtcggtgttcgcttactcgaaccccctttagggtagatgag

SEQ ID NO: 48919 - DNA, 477 bp, Glycine max
  Peptide Sequence Number=SeqID_140604
atggctcacgaaatggttctccgaattgaaagtggatgctctggatctcgaaatggaagctgctctactacctttgctgctagaggatttggaactaggccttatgctgctggtggaggtagtggtggggaagctggttctagatctacttttgctgaatcgacagaatctactgctcggtcgactgactcaaccatgtctttcttcattgactgctttcatcaacagaatcgccggaatcaaccggctctactgaagcaactactcactctggatctgctactggaagatatgaatataggcataggtaaagatacattggttattgatatggatgagactgatctccctaacgcgctacaccatcactacactatagataggtatataggcagcgggaacactggtagaacgttcccatcaggcaacaacggaagggagcctctaacttgcctgaccaaaggagaagaggagtag

SEQ ID NO: 48920 - DNA, 273 bp, Glycine max
  Peptide Sequence Number=SeqID_140605
atggtgagggagggcgacgcgagggctcacgagtgcgtcttccaagggaggaagacgcgcggagtcgccaccaacgtttattcgaggaaaacgtcggaaaaactggaaaggtgtggtctacgaactttaatcgtgaaaggttcgagagttgtttttacgcacgggaaagggggagaaatgttaaggcgttggaccattaacgatctcttggggcggtcgacaaaagcggtaaagttacatgttgattttatgcttttgaaaggtccaggttaa

SEQ ID NO: 48921 - DNA, 189 bp, Glycine max
  Peptide Sequence Number=SeqID_140606
atgaaaatattccaaattccccgggagtgtatttatgatttaaggaaggtcgacaaaagcggggctcttgctcttactccactcccattgaagccaggaaatcagacctacgtagttctttctaaagggcgaatcaacgcgattcttttacttggaaggtggtcttttaaggccaagttaggaccttaa

SEQ ID NO: 48922 - DNA, 153 bp, Glycine max
  Peptide Sequence Number=SeqID_140607
atgacaacaatccctcatgtaaggctaagtgatgcaatcctccctaggaagggaccagtcactagagccatgagcaagaggctcaaagaggattgggctagagctgctgaagaaggctctagggttctcatgagtctcagggtagatttctaa

SEQ ID NO: 48923 - DNA, 257 bp, Glycine max
  Peptide Sequence Number=SeqID_140608
atgacggaacgggcgatgaggcgggctttgctattacgccacggcgaaagggggatgtgtatactggcttactatgttggtcactgtgagggtgttccagtgaagtgcttcatgtggcaggagaaaaaggctgcaccggactcactatgtccgcattccgctctgactcgctaccgctcggtcgtcgactgcggcgagcgtgaaatggcttaccccaacggggcggaattcgattctgctgaaaagatactaacagg

SEQ ID NO: 48924 - DNA, 91 bp, Glycine max
  Peptide Sequence Number=SeqID_140609
atggaaacccagcataattcagcaagttccaagttgctagtgaaaggactcaaaaacgctagagaagaagccacgtacaccaccaacagaa

SEQ ID NO: 48925 - DNA, 410 bp, Glycine max
  Peptide Sequence Number=SeqID_140610
gcacatagcgtgtttgcttcgtgcccctatttcagggacataatgggaggaactaaaaggcttttagtgataactcccaaggtggtcatatctctcttgatggtttctagaggtatcatccccttcgaaaaacatattgcggcagtagggactaccagcaataatatgttatcaaagagaaaaactctagatgagggttcattgttatcaagcaagttggagacccagcatgaccacaaattcacctccactccttatgttcccatggacccggtggagtcgccaaccgtcgcaacctacccttcggcgggagggcgatgcggggctcatgggtgcgtcttccatgggaggaaaatgcgcggagtcaccaccaacgtttattcgagaaaaacttcgaaaaacccggaaag

SEQ ID NO: 48926 - DNA, 481 bp, Glycine max
  Peptide Sequence Number=SeqID_140611
atgagcgtccacgtgggccaggtgattgctgatgccacttatttgtttgcatgtatggtgcctactaggcaccctttggacccaaataagtccaacagggccctgggatttccggcgctgatcacaggcctctaccagtcctacggagtttctgtcacccccagtaaggtaatccggccaccaatcacccgagccttcatcgagaagtactgcacgcctaggcaggcacagggtgacgcacatcaagccgcaggcgcaccgccaccacctcggcaggccgatcctactgggccattgggcatggagcgttatctgcagcatttgggttccgccccttttgtatgccctactccggagcagtttggggctgaggtcgcatggcctagagactggcctgatgcccaggcaggggaggagcctgcaggatcccccggtgaggcggatgaatcccatatggatgaagatatgactgacctgctcg

SEQ ID NO: 48927 - DNA, 237 bp, Glycine max
  Peptide Sequence Number=SeqID_140612
atgaaaattcccaatcgaagagtgggagaaagcaaaaaaggaaaagaaggaaaattcccaatcaaagagtgggagaaagcaaaaaaagaaggaaagcaagctcccgatcaaggatcgaaagaaaacagaagaaatgtgcagaaaggaaatgatttgcaaagtcaagtcgtgacatatctatggttcagaattagggatgaaacacttacctgtgcgaggttgatacactctgagtga

SEQ ID NO: 48928 - DNA, 222 bp, Glycine max
  Peptide Sequence Number=SeqID_140613
atggcccaggtggtggaaggtaaggtcgaagctcaacacccaaaattcggacagacccaggtggtggtgggaggctcctccatgatggacaagaggtcaagtgtcacccgagatgacctgggtcgcaacaacagtcgtgatggtgatggtgacaacattgagagttgtaaggtgtgtgaaacattgcggtggagatggactgttagtctctcatactactag

SEQ ID NO: 48929 - DNA, 369 bp, Glycine max
  Peptide Sequence Number=SeqID_140614
atggtgcaaaaagggtttcagaaaattaagcaaggtaaaagtccattggctaggcatcaagaaccccccataaattgccttgcatcttcctgggcaaatatgcatggaatcaaagcaacaagaatcaagccaagggtattggcaaagcagagacaatacggggaaaacattcaccaaatatttctcatgatgatggatggcatcaggaattctcacgaaaggaaactcatcactttcaaattggagctttcaaaactatctatgacagtagaggagaatcggaaaagatttcaagtcacaaaattcatgaaaatcttttattttcaaaagcaattacccatttcatggcaaaatatcataattcactga

SEQ ID NO: 48930 - DNA, 386 bp, Glycine max
  Peptide Sequence Number=SeqID_140615
atgaattttgcagcgacaaagcctgtagaattcaccccaattccagtgtcctatgctgacttgctcccatatctacttgataattcaatggtagccataaccctagccaaggttcatcaacctccatttctccgagaatacaactcgaacacaacgtgtgcttgtcacggagaagccccggggcgttccattgagcattgtagggctctgaagcgtaaggtgcaaggtctaattgatatgggctggctgaaatttgaggagaatcgcgtgattttcaactttcaccggaattgggtgcaagccattggtctatttgctcaagcgacctgtgctcctgagtttggacttccaagaccgttcaatcagagatactcgcatgcacattg

SEQ ID NO: 48931 - DNA, 180 bp, Glycine max
  Peptide Sequence Number=SeqID_140616
atgaagaacggtggaaaagctttgcgaaatcgcccacagaaacgtctcggaagcgttacggaagcgcctcgggaaaagagggaggtggttgccacccatctcgcccaggcgagccgggttgcttccaccaaaaggcaccgccttctgttggaagaccttggaaggcccaagtgggtctga

SEQ ID NO: 48932 - DNA, 360 bp, Glycine max
  Peptide Sequence Number=SeqID_140617
atgccggaacccgtagttgtaccaatgttggtagtggacaacaaacccaaggttcgtcctttagtcttcttggcaactcggtgggactctacttcttctgcggtgaaacaacaagtcctagttcaatggactggattagcccagaagacacctcatgggaggactggaggtgatgaggacaaggcaaggaataaggacaaggaacctttagaaggacttggaggacctatggcaagggctagaacaaagaaggccaatgaagctcttcaacaagtgttaaccatgctatttgaatttaggcctaagttacaagtggagaagcttcagattgttaattgcaccatgttccaagaagagtag

SEQ ID NO: 48933 - DNA, 280 bp, Glycine max
  Peptide Sequence Number=SeqID_140618
atggatattgactatgctataaggaaggatgagccaccgactattaaaactagcgaacctgatgctgttgacctttatgaaaagtggaagagatctaatcgtctctccaatatgttcataaaaaccaacatatccgcttgtattcggggttcagttgaccagcatgataaggtcagagatctgttgaaagccattgatgaacagtttacaacctctgagaagtcacttgctagcacactcagtatgcaattctcttccattaagcttactggaacgagag

SEQ ID NO: 48934 - DNA, 168 bp, Glycine max
  Peptide Sequence Number=SeqID_140619
atgacgacgactttaaagacgtggtgcgtcaaacttgatggtggtttggttggtgaaggtggtgatgcagttgagaggttggtggtgttgattaggtggagcattgatgatgtgatggaggttaaaggtggcgacgctgggatatgttatttttaccatatcctgtga

SEQ ID NO: 48935 - DNA, 516 bp, Glycine max
  Peptide Sequence Number=SeqID_140620
atgattgtgtgtctttgcatgcgcctcagatccaccggatccataactttggggtctagatccttcggtgatgaaggctcgagaggcgatgcaacgcctaagagtgaaggtgatgagagtgatgagcgtgaacagggaaggacacttattaggctccttcgtggcggttgtaggagaggatggtggggcaaagtcgtggaggttagtgaggtggaggacaatgagggctttcgggacaaagttgaggtgggagagggatttcacaacaagggtcggggaggatgcggcaaggaagtgggaggtgcggtagagcttgaagtggacgaggatgtggagggcgaggcacttgtaatgtggcgtgaagaagaagttgtgggcctggggttgggcttgggcctagttgaagaagttgaggagggtgcgttggtcggattgggaattgaggagaacgtaagaagctgcttcaggagtgaagtgaggagagagggatacgagtctttgagggtggcgttttag

SEQ ID NO: 48936 - DNA, 417 bp, Glycine max
  Peptide Sequence Number=SeqID_140621
atgggttctcctactcaggagtcaactaccaaggtagttctatcggttgaaactaaactcaggacaatgttgctgacttgtgtggaggtagaggctgctgctgtcagagtaaatgagaattggggagttgatgcactggagaactggcagaaaagccactacacaatgcttaaccacttaacagaagcaaacacacttaaccaactaaaaggtagaatcaaaccaaagcttaaccatcaagagaagaagctaaacatggggttcttgaccagattgaaccccagggactgcaactacttcaaggacaaagacaaggaagaagttgctggacaacaggatcaacaaatgacttataatagggtccttgaccagatcgaacccctaggactgttagacaagtggcctcagatatcttaa

SEQ ID NO: 48937 - DNA, 808 bp, Glycine max
  Peptide Sequence Number=SeqID_140622
atggtgtatgttgtgtatgtacatggaggtgcagtgaccatgatggatatctctagtgggggaaatacagtgggaaatacttgtacttgggggcatgtcactcggtttggaactcccttgagagttaggttgatcaccatggggagagttgtttctgtacaacaagatgacatcgacacttgctacctagttttcctaagtaagagtgtcgtgtggacacggttaggctattttctaacgaatggtaccacattgcatttgagagttgagctcaaagggtacgatcccgttctgactgtctccatttgtcgtcgctgtccgctggccgccgccgtcaaattttctggcaaaaccagggtttgcgcctcgtttctagcacgtgaaggccacgcgccgccttcccgccctcgcaacctcgccagaccacattcagtcacttcgtcagctagtcatgggtacggtccaatcgttggcacatttcagtccctattttctggtattgacagcttgatcatttcaaaccttgcgttcccttctccttctccgttagggcttcgtctccttgatcagaaatggcctctactgattatgcgttctccttctttaatgtcagccactattccactgtttctgctgcttctcgttgtctaccattgtcagccaccgtcgttagccgctcaaacctctccttttagcccttcttctttgtctacagaactatggcatgctctagtcctatttaaggccccgtctggtttcttggctctctcttgtgttataaacaacaacattgttaccaagctagagg

SEQ ID NO: 48938 - DNA, 372 bp, Glycine max
  Peptide Sequence Number=SeqID_140623
atgtcagattttgcaagtaccttcaacaactaccatttgaacatcttccatggttgtgtatcaatccaatttggcaaattccaagaggttaaatggagatacttattcaaaggtaacatggcccgtccgagagcccgctttatcctttggatggcttgtcatgagagaatggcaactaaagatagattaatgcgatttggaatgctcaatgatgatacttgttgttactgtaaagaaaaagagaccattcaacatattttcttccaatgtaatgtgttgagtcaattttggaaacacacccttaaatggctagaggttccacattctccgggtgtttggaatgaggagttggattggattattaagaagtga

SEQ ID NO: 48939 - DNA, 558 bp, Glycine max
  Peptide Sequence Number=SeqID_140624
atggaacaagaagaaagtgaacacctagaggatgcaaaatccatggaacacgaaggaaatccattccaagaggaagatggtgaaataaatgggacaagtaagaaaagaacacggggaccgatgcaatggatgaaaatacattcaagaaatgttcaagatcgtgaagaagtggtcttagatgatgatggagagtcgattggacccaatgcatcaaaagaagaacaaaggagaggaagtcacttgagcaaaaataaaaggcttcaagattcaactacttctgctgaacaagcatttaaattgttgcttggaaaagaaaaatttggtagagtgggttgctttggaagaattgtcacaccatcacatttaaaaagaaaagaagaaatttttgctcttaaggagcatgcaaatgagtggaataattgggctaggaggtttgaaggattggaatcacttctaatatgcttcatgaagcaaaacaaccgaaatttggatgatgaagctttggatgacatgataagaaatgttgtagctaatgaaaatagtaatgcggcaatgtga

SEQ ID NO: 48940 - DNA, 354 bp, Glycine max
  Peptide Sequence Number=SeqID_140625
atgagatgcaacaatttatcgggtatgatgacggtttatcatgccccattgtcccatctcaaggaagaagcatatcacttgctcttgctcaaagtagcacttcatactacaattcttttatggacaacaaaccatctgaaaaacaccaaagcaaacatcgtattggaaacacattccgaaacagctggggaagaaaagattctgagcacaagtctgcaaagaaaagtacctctttggcaaatgaacagaaaattttttacggacagggataattcaccatctataatgttcaactatgtcagcaaggatgaaaaaaaagagatagataaattgaatagcagcatgctttgttga

SEQ ID NO: 48941 - DNA, 558 bp, Glycine max
  Peptide Sequence Number=SeqID_140626
atgtatgtgcctacgttcacggctacactaggagaacttttatttcttgtgcataaaagcttacaaggtatggttgaatttgttgggttgattaaggttaatgtggttaaaggcactcacctagccattcgagatgtaatgactagtgacccttatgtcatcctttctttgggtcaccaatcagtaaaaacacgtgtcataaagagcaatttgaatccggtctggaatgaaagcctaatgctatcaattccagagaacattcctcctctaaaagtgcttgtgtatgacaaagatacattttcaactgatgattttatgggggaggctgaaatagacattcaacctctagttattgccgcaaaggcctacgagaaattgaatatcaatgagtccatgcagcttggaaaatttgtagcaagcaaggacaacacccttgttagggatggtatcatatctcttgatgaagggaagatcaaacaagaaatctcattgaggctacagaatattgagaggggtgagctagagcttgagcttgagtgtgttccccttactcaatag

SEQ ID NO: 48942 - DNA, 171 bp, Glycine max
  Peptide Sequence Number=SeqID_140627
atggaagcacgaacgcagaagggagaatgcgcttacctcaacgtcgatagagcagcacaactagaagaagaacacgcaagaagcaacaaccacgctgccggaagcaagaacacacaaagcccagtcgaggtcgtagaagcaagaatcacgcacagaaggaaaaagaactga

SEQ ID NO: 48943 - DNA, 1059 bp, Glycine max
  Peptide Sequence Number=SeqID_140628
atgatgtacaatgatcagcagcatcagcaccagcagcaccagtaccagcaacaacagcagcagcagcagcagcctttccaccagccgccgggtccggagttccaccgcggaccgccgccgccgtcgcatccgccgccgatgatgcggcaaggctccgcctcgtcgacgaacctcgcccccgagtttcaccatcccggccccggagggcccccgcctcctcattacgatggttcggtttcgcttcctcttcctccaattgcttctcattcttttggaaagtggaatgaaggagtggattgtgaacttgagttgtggacaggaactttggggttaaagggttttgggttaattagggaatgtattgcatatgatttgagctggatgggtgaaattgagaaatgctttagggaaatgtttggcagtaaagtagtgacaagactagaagacaagtgcagcagtgatgagaaattgagaatgctgagtgatagccatggtgcaaaaagaatacgaaagcttactcaaaggaaagctgttgattatacaagcacagttgtgcgttatatgcagcgggattcaagggataggacagtactgcaacccaccccggcagcagcaattgattggactccaacaggccggcgacttattactggttcacagactggggaatttactctttggaatggacaatcttttaattttgaaatgattcttcaggcgcatgatcaagcaatcagatccatggtctggagtcacaatgacaattggatggtctctggtgatgatggaggcgcaataaagtattggcagaacaacatgaacaatgttaaagccaacaaatctgctcataaagaatcagtccgtgatttaaggacagatttgaagttctgttcatgctctgatgataccacagttaaagtttgggattttgcacgctgtcaagaagagtgttcattatctggggctgcgggaatagaagaggatataaatgtgcctaagaaagaaggatggagagggggatgcgagaatcatgcaaaaggaggagatggagaatggtaa

SEQ ID NO: 48944 - DNA, 315 bp, Glycine max
  Peptide Sequence Number=SeqID_140629
atggctctagataccattttcgataaactgagtgaaaatgggagagaaaatgaaaaagataaagctgatattattgctcagaagaaaaaactcaatgagttagatacaacagagattatgattagaactagagatttgggtcgggctttaggaatggttatagaaagagctctatggagagaagtcagctgtgatgcagatgacgccccccaacagcaaaggcccacagcatccgcacgtaggcaacaagaagttgcacttattactaaggatgttcacgatatggatcatgcaaatgacgaggtccatgaatag

SEQ ID NO: 48945 - DNA, 195 bp, Glycine max
  Peptide Sequence Number=SeqID_140630
atgaacccaggaagaaaactcaacgaggcacttctgaagaagaggttcaaccatcatgctgctgtggctgatgatgcagatcagaaaccccacacatgttcaagcatgcatgatgctgtgatggatctcttgcatgatatttgctttcaagtctccaaaatgcaagctggaagccagatctcaaaccggtgctag

SEQ ID NO: 48946 - DNA, 714 bp, Glycine max
  Peptide Sequence Number=SeqID_140631
atggtgggtgaaactgttgtctatggtagacacaacaacaaaggaatcaactttaattggctaataagtaagatttacttactgggtatgggtgagaccttacttagccaacatttatacaaagggccaaggatcgaaggtgaatttgatttcaaggcttgggcgtgtgtttcgtatgagtttgataaggctcctgaagttcttttgggagctacttgttactcagaaggggtgtacatgtggtcaattggttgcatatttgctaaacttgttaccaaacaaacactttttaagggtgattccaatctgcaactactcgaaagtatattcaggatattgggtcctcctaatgaagatgaattgccaagcgagagttttaaatattgcaagcttgttgtgaaagtcgacgacacatttttaatagggaaatatcatgctactttattgacttccattgcacaagatgagaatcaaaacatgtttccacttgcatttgcagttgttaaagagttgagcttagctcatcagtgggctaagcgcgcatccaccgctaagcgtagcttcaacgcgcttagcgcaacaaaagaatctggcagagcatcaatatcaaggccgcgcgctaagcgcaagatcagtgcgctaagcgcagcagttgtctttagccaggctaagcgcacgactggcgctaagctcaaatccaattacttgcgctaa

SEQ ID NO: 48947 - DNA, 261 bp, Glycine max
  Peptide Sequence Number=SeqID_140632
atgcagatcaaacagcggaagctaaatagcacaagtgtacctccagccattgcagatcaaacacgaagcggcgcaagcacgaacccgtatctgccgtggatgtcttcggcaccgccgctttctccgactggaatgacagcaatgccacaccatgccagggatgtctgcacccgtgacgccagaccactagcatggcgtggcgtcgttgtcattctagtcagagaaagtggcagcgccaaaggcatccatggaggacattaa

SEQ ID NO: 48948 - DNA, 492 bp, Glycine max
  Peptide Sequence Number=SeqID_140633
atggaggatcagggaattgctcttggtgttgctactactgccatcagccatggcgagcacttgaaattttttgaggtgattttggagaatgttgtggggaatcaagtatctggtcctctaaaccagaataagtctatcaattttggtgctctcgttgttccaatggtggaatccactaggtccaaagcttcctctgacaggctggaagatgccatagccaagctcacttcccatcacctttccttgaccgaaacagtacacacaatgaccttgaaactcgacgaattaatccaaaaattagcccagcctgaggcctcctcaccatctccatccgcgtccaattccactccacctatgcccacctccacccctcatagtttgagactagatgtccctcgatttgatgggactgaaccccttggttggatctttaagatcaaccaatttttcgactaccatgatgtaatcctaccccccaaggacattggatag

SEQ ID NO: 48949 - DNA, 1419 bp, Glycine max
  Peptide Sequence Number=SeqID_140634
atgtggtgccccttctacggcaagattgctcccatcccactaccagaagcatctgtttctacggtgaaagggacttcaaagtccagaagagacaacacaggggccgtcaggtgcaacaatggaagcatagccacggaaaaaatgacagcagaaatccgccaagcccaagaagcttcgaatggcccttatggactgaggcataggccaaatgaactggcagtctacaaggacttgaaacacagttgccaagtgggacaaatgcccttcaagaatactgtatatgaggatgtcgtcgaagaagacgataacaaagcagtagaggttcaaaatgaggttgtaagtgaatgtggtggtcatgtggtctggacggcagcaaggcttggggttcatgaaagaggatgtggaattggtctaaaaggatttaaactagtgatggaagttgggggttggcactcactccctgcttccggacaatacggcggagctggggtgagtcatgataggtccaaaggtcttgagccactgcacacccaaaaccacattggcactacacaagggcaagacatgaaggttcaccacaaattgaatgcgcttgatagtaatggtgactgcttcacaaaggttatcacaatgaagctgttgaccattcccgaccatgacgcgaagcggagtagtggtgcgagtagtgaggcccaatttccacaccaatggttcctgaataaagtggtgggtgttgcctccatcaaccaggataaccaattggggcgtgacaatgtgacccaagagacgcagggtctcaggtgccaaatgacccgcgaaatagtggagtgtgatctaggcctgaggcgggttagtggcgtcggtcgcttcacaggcactagtgttgggggtttcggtggggctagaagcaagggggtagcgattgtcgacaagggtcgtggaggtggcgtagcgagagggggtgggcagacgctggtgtgcctggacttcctggcgaatcttcagggtcaaccccgagataaagaaactcaaaaggaacggtggaggcaagctgacaatctgcttcgtaagatcttcaaactccgaaaggtacttggtgattgtggatcgctgggtaagcttgcaagggcaccggaggcgatgctcagcctctcgtgctctagcgtggcatggtatgatgtaagatccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaagggagagggagagaagatcacgaaattttgtgctctaattga

SEQ ID NO: 48950 - DNA, 120 bp, Glycine max
  Peptide Sequence Number=SeqID_140635
atggtgatgtgtgtgggaagaaggagatggggaggggagagtaaacaaggggtaattgatacgggtgtggtggggaggttacatggagggaaagagggtgaagccactcaaacaatataa

SEQ ID NO: 48951 - DNA, 1110 bp, Glycine max
  Peptide Sequence Number=SeqID_140636
atggacatgtttggttgtgattcgaaaaatcaatatatgattttcattttgattgatgaatataataaaaagattttccgtgaagtggattcggccactaagaagaagtgcggagtaaacgcggaagattgtttgtcaaacgacgacagttttggcgccgacgggaatggacggcacgccgttttcaatgcgctggatactctgcttaaggacagtttagagcgtcttaagatgatgagcgagaacctatgtttggtaaagacaggtctaactataggatatgcatgtgaatccaagtatgctgaagatacagctactattaggcgtttgtgcttagatggtaagttggaagcagctgtttggcttcaggggaaaatggtgcagaaaggtgttgttcctgatgtgtttacccacagccatattgtaaatgggctttgcaaaattggtcttccggacaaggcggatttggttgttcgagagatgctagaatttggtccttgtcccaactgtgccacttataacactttaattaagggctattgcgctgttaatggcgtggatagggctttgtatctgttctccaccatggcctatgctgggattctgccaaacagggttacttgtagcatactggtgtgtgcactgtgtgagaaaggtcttctgatggaagctaaaagcatgcttgtagaaatattaaaggatgacgacgagaaaggtatacctgatttagttacctcttctatatttatggatagctactttaagaatggagcaattattcaggctctcaatctttggaatcagatgcttcaaaattgtacaaaagttgatgttgtagcttataatgttcttatcaatggattttgcaagagtcaactaatgaaccttgcatatggatatgcatgtgagatgtttaagaaagataaagtgcaagaagcagtgcaagtagatactgctttggagaaagttttggacaaagtaggagctgatcctaactccaaatctgggtacactagagcaggccatgttggagaatggaggagggagattcatgaatcctggaatgagagagagaaatggttaaatggaggaggagggggaagtaactga

SEQ ID NO: 48952 - DNA, 678 bp, Glycine max
  Peptide Sequence Number=SeqID_140637
atggaggataatgttctgcttgacaaggaagatattgttgctgaggaggaggttggcgaggaggaagcaagaccttgtcgatgtggaggcaagactttggtggtcttgtgtgaagtaaaaagcttctcctctaatgtttgtgaagttaatgtgattttcacatggttgaaggtattgccaaacagtctggtggagtgtgtaccaagggtggaccttgggtttttatgttcttgtattcctgcacagctgaaaggctcaccaagggtgaaccttgggtttaacgagccttggactgggaacgtgtttgccctgagttttgacaagcctgtagagttgcatcgaggcttaccatggacgaaccctgagttttgtgaacctgtgaaactcaccaatggtggaccttggcgcacatgccaagctatcacatacatgtcacttgtggagtggtacatattggagatgtggtgtcgtgctcttgcatacatgtcactcgtggaatggcacacactggagactaatgacacatactggagacgtggtggcatgctcttgcatgtgtcactcatggagtggcacgtattggagacgtggtggcgtgagcctggaggactcaccaaaggcaaaccttgggttttacaagccctttggagaaacaaccagaaacgtgttggtccttaa

SEQ ID NO: 48953 - DNA, 783 bp, Glycine max
  Peptide Sequence Number=SeqID_140638
atgcttaaggagcttgaggtgttgttcgtgaatataatgaggcgtgagaattgttttctgatgagaatcatgaaactggtcaaatacaggctaaagacccaagtggagaaggacgaaggcccaagtggagaaggacaaagcccccgagtggagaaggatgaaggcccaagtaatccttgtggcgtctatcctgacttatcttccttcaccggaagtggcgtctacccagacttatcttccttcactggaagtggcgtctacccagacttatcttccttcattggaagtggcgtctaccctgacttatcttccttcactgaaagtggcgtcatccaaatctctgtaacctgtatcaaacgatccgccccagctcaatgtgataggttagcaattgctattgtgactgaagaaagaaagaaagttgttgttgatgaagtgattcgtggcaaggttggacaacaaggaaatacatacggtgctagaggacatggcgcagtgagtaaagcaaatgcaacccaagcctctacattagaactagaaccaaacattatgataacagatgctgataagtctactgtaagtggacttaatggggagcaatggcaaacattggtgaatctcttaaacaatttcaaaataggacctgctgaaaagttgactagtatgcgtaattttgtacagtggatcatcgatataagtgtttcttgtcatatgaaaggaaagataaaatgcttgactgatgtgagaactgtcttggaatgtctaataggaattctggattaa

SEQ ID NO: 48954 - DNA, 525 bp, Glycine max
  Peptide Sequence Number=SeqID_140639
atggtggtgtgcttgaaagatagctcccaagtctttgaccattctcttcaagcactggaatatttaccactggccaacataggcactatcagaaatcccattggctttcaaagaaagaacaaagttgttaatagaggacctgtcctgcattcaaatgctaatgcttcacaatctaggactctccaatatacaaacacatgggtccgaaacccttataaatcttctaatggtgaattggcacttgacatcattctcgagaaggaagctgtcaagcagagtggcgatgcttggagagttgtacttgatgcctgccttcctgttcttcacttgattgataccaggcgttccatcccttacgctattaagcagattcaggaattactggggatatcatgtacttttgatcaagcgattcagaatttgagagagggaaagaacaagttctttatcctgaatattatgttctatatattgggtacaagcaaaaccaatatattggctgagcttgagctgcatgctttatga

SEQ ID NO: 48955 - DNA, 489 bp, Glycine max
  Peptide Sequence Number=SeqID_140640
atgaggacaaatctgactccacctaactctgatctgaaaaagaaaggagcttgggtctcacaactgcatgggaaccacgcaccacgttgggatgactgtggcgacgatggggaggaagtgctcgagcggccacagcggcttgaacttggcgctaatcctgcatatggtgctgttgagaataacaccgctccacagcatttcacagcggcggagaagaaacgaaggaagcaagggatcaaagcgagaacggaaattctcaaaggttgtgcagccgtccgagaagccgtggccacggtggttgagggcacaggtggcgaggccaatcttggcaaagtggatggtggtgagctggaggagccaactggacttgccggtgtagccgtgtatgacaatgagggtgaatgtggtgaaggaagggatctttggaagagtgagaagaggagaaggagaggagggagaaggggaagagggaaaaggggatttttttaa

SEQ ID NO: 48956 - DNA, 216 bp, Glycine max
  Peptide Sequence Number=SeqID_140641
atggtgtttcaaacaaccttgttcgacattaagcaaggaaatttcaagatcaataccgacattaatggaaggattctcaacagttatgttggtagactcttgaatctcactatgttcaacaaactctataatgcatgtgctttggttagttccgatatggctaagatgaagtgcattggggaggatttgatgttgatatcgggggtgaagggagag

SEQ ID NO: 48957 - DNA, 690 bp, Glycine max
  Peptide Sequence Number=SeqID_140642
atggactttgttgttctccttcacatatttgtcttttctccaatccttttctgcatcacttttctgtctctgcttcttcccaacccaacatatttttgggcttggaagtcacagttgtctcagcctgtggctgatttggttttgaggaatggggtgatatataccagcgatgattctctcccatttgcagattccatggcagtggccaatgggagggttcttcgtgttggcaaccgttcatttttccaggagctggaaggatatggaactcaagttttggaccttggtgggaaggttgtggttcctgggttccttgattcccatgtgcatttcattgatggtggattgcagatgatgcaggtgaagctgagaggtgttaataaaaaggaagaatttatcagaaggatcaaagatgctgcgcaaagcacaaaacaaggttcctggattttgggtggtggatggaacaatgatctatggggaggagatcttccagctgcctcttggatcgatgatgttactcctaataatcctgtttggctgtcaagagtggatggccacacgggcttggttaactcagtggcacttgtgttggctgggattacaaatttaacagatgatccaagagggggaactatattgaggactgctaatggagttttcttgacatggtatcaaacccactatgactaa

SEQ ID NO: 48958 - DNA, 507 bp, Glycine max
  Peptide Sequence Number=SeqID_140643
atgacgagctctaagaggtccttggaaattcaacaattgagggagcgtaagaaagagtatgacttgaagacagcaatatctttggttaaagaaacagctaaaaccaagtttggagaaacagtagaagcccatttccgcctcaacattgaccctaaatataacgatcaacaattaagagcaacagatatttgcgtgattcaaatttgtcaccatgagcaggtcaggacaaccacgggatttgaagaagatatttccgtgattcaaatttgtcaccatgagcaagtcagggaagaagatatttgcgtgattcaaatttgtcaccatgagcaggtcaagacaaccacaggatttgaagaacttggagcaaatgccatattggcagtttctcttgcagtctccagagctggtgctactatcctgaaagttcctctttataaggttcaggatccacacggaattaaatacaatggaacaattcaaggtctaaaatatatatggagaacttaa

SEQ ID NO: 48959 - DNA, 459 bp, Glycine max
  Peptide Sequence Number=SeqID_140644
atggttttcaataggtttgtcacagggcttgggaggggaatcgataaggagcgagatgcgaggtttacctctgacgaaattagggaactcagggttttggtgaagcaaattttgtgttgcgtgccaactagcgaagttgacaacgtcattgtcggaggagccaaggttgacacaaatggtgccgcggaggacgaggatggtaacgaagccgtagataatggtgatcttgatgttgttgaaagtcttctggatctgccggtcatagggaaacacgttttcgtcgtggctttgcgcgttgtaggttggcaagcccacgctagtgctgccctcacaatggagcccaacgaatccccaacgccgatgatatcgtcaggtggagtcccgaagctttcacatcctgtgcgacctgaacttcaaaggtatcctttggttgttcttacgaaagtagtcaaggtctag

SEQ ID NO: 48960 - DNA, 921 bp, Glycine max
  Peptide Sequence Number=SeqID_140645
atgattcagaggttgatgttgtcacatcctgaggtggaaaggatttggtggatggatagtgacgcttttattgctgatatggtgtttgagcttcttatgtctaagtatgatgagcacaatttggtgcttcatgttggtgttccagttgatgataagaattggcctccaattttcccaatcattcatgatgatattgccaatgagataccggtaggggcgtggccaagaaactccaggggaggatcccttggtgaaaaagtggaggatgaaacaagtgctaaagcggataggcttaaggtttcaagttgttgtaagcattacactgcttatgaccttgacaattggaaaggctttgatcgcttccattttgatgcaaaggtattgttgtatcattactctaactttggcagtgtttgttgccacataattgggcttgttgcaagtgacaaagcaagacttggaggactcgtaccaacctccgtcaatagttgtgtggtggagggccacgtgaatgggattcctacatgtgctgacccaggccttctcaaatggataattagaggccagaggggtctagaaagatatattgtttcagattgtgattcagtggaagtctattacgatgtaattcattacattgcaactcctgaagatgcaatggctcttgcactgaaagtagctttcaacatgaattggggcgattttctaaaaaaatacactgcaaatgctgttaacttgaaaaaaagtagatgtagcaactgtagactaggccttgccttggtgtacaactacatagtcctgatgagattgggcttctttgatgaccccaagtcacttccatttgcaaaccttggaacatccgatgatagcaaacatcacaaaggaagcaagtgcatacctgggagtgtgcttgatggctag

SEQ ID NO: 48961 - DNA, 1191 bp, Glycine max
  Peptide Sequence Number=SeqID_140646
atgggacgagcttcattattacttatagtttttttggttcttggttcttcctttgccacctataatgtggtaacgatgataaggcactacggatcttcagaaggtgtggctgtggatgatggtgcattgttttttgaccctattactgagatgcctgatcatgtaaagaatcggaagacatctaaagcgccctttcatgtcgcgttaacagcaacggatgctccatataacaaatggcaatgccgcgtcatgtattattggtataaacaacaaaagaagttacctgggtctgagatgggaggattcaccaggattctgcattctggaaatcctgacaacttgatgaatgaaattcctactgttgtggttgatccccttccagcaggtttggaccggggatacattgttttgaataggccatgggcctttgttcagtggctggaaaagactaaaatagaggaagaatatgtgttaatggcagagcctgatcacatatttttacgtcctctgcccaatctggcctttggaggacatccggctgcttttccatttttttacattagacctgatcagaacgaaaagaccataaggaagttttatcctgaggagctggggccagttacaaatgttgatccaattggaaattctcctgtaattataagaaaggatttgatcgcaaagattgcccccacatggatgaatatttctttgaagatgaaagaggacccagagactgataaagcttttggatgggtgctagaaataagaggtattggaactgataatttgatacattatgctaatggtttttttcttgtggaaccaaggtatgcttatgctgttgcatctgctgtgcatggtgtgaggcacattctgcggaaagacttcatgttacagcccccatgggatcttgaaactaacaagaagtacattctccattacacttatggatgtgactacaatatgaagggtgaattgacttatggcaaaattggtgagtggagatttgataaaaggtcacatctacgaggacctccaccaaaaaacttgcccttgcccccaccaggggttcctgaaagtgtgatatttccgaatgatcttctcgaagctagaacttttaagatgcctgtaaactttcttgtttccctcatctacctcatttattttttacactttcattggaggaagtga

SEQ ID NO: 48962 - DNA, 228 bp, Glycine max
  Peptide Sequence Number=SeqID_140647
atggattttgttggggttgacaataatttggatttcattgaggttttcctctataggtcttctactattgttcgccattggagaactatctatgtcgagttgaagataaagttcaaggctagtttagaggaaatgaggaaattggtcaaggctctcaatgagaaaaactcgttaatcaagaaaattgagatcattgatggtctacatcagaaaattgttgatcattag

SEQ ID NO: 48963 - DNA, 978 bp, Glycine max
  Peptide Sequence Number=SeqID_140648
atggagactaatccccgcacgatccgcagcctagtctcgaagctgagctccgtttccgaagccgcccgcgtcgacgccctctcccaactccgcctcatgtccaaacagtcccccgaaacccgccccctcatcgccgacgccggcgcaatccccttcgtcgccgaaaccctctattgctcttcgcaccccccccaagaaaacgccgctgccacactcctgaacctcagcatcacccaaaaggagcccctcatgtcgacacgtggcgtcctcgacgccatcgctcacgtgatctctcaccacaacaccacctcctcccccgcggcggtccagtccgccgccgccaccatccacagcctcctctcctccgtggactcctaccgccccgtcgtcgggtccaagcgcgagattgtctactccctcatcgacatcctccgctgccacgtctcgtctcctcctcgcaccatcaaggactcgttaaaggccttattcgccatcgcgcttcatcctcttaaccgatctactatgattaatcttggcgcggttcccgcgcttttttcgttggttgccaaggacggtagggttgggattgtggaggacgccaccgccgtcatcgcgcaggtcgccggttgcgaggacgccgccgaggccttttttaaggcctccggagtcggcgtcctcgctgacctcctcgaccttgccaccgccgccagcatgcggactaaagagaacgccgtctcggcgttgctcaatttggtgcggtgcggcggtgacaaggtcgccgccgacgtgcgcgacgccgtggcgttcggcgcgttggatggaattgcggatgttagggacggcgggagcggcaaggggaagaacaaagctgcggagttgttgaaggttttgctcggtgagaacaatggcgatgttgttgcgttgaacagtgatacttgttcttcgtttggttcctcgaggaatcatgattcggaatga

SEQ ID NO: 48964 - DNA, 603 bp, Glycine max
  Peptide Sequence Number=SeqID_140649
atggctgaagctgcaaaacctatcaacaatgtcgacacttccaaccccacgccaccgactacaacctttgccaagtcgttgcctaacatcttaaaaattgaggaacatgttcataccttgctagacatgcatggagttgtcttcgttcaggccaataaggaaaagacatcaagctacaaatcaatgaactacaagctattagaaagcttgaagactaaaaacatctctctgcctgacgagttcatttatgaacttctaattgagaggctatcgaagtccttgatagactacaaacaacagttaaagcacaggcacaaagagatgtcattgtcagatcttatcacccattttatcattgaagatacaaatagaaaggaaagtgttgctgcaaggaccaaagcaatgcctgccacggaaaacatgataaaagataaattgtttcataagggggatgtcaacaaaaatgatcataataacaagaaaaaatatagagttatgagaaatgacaatcctcctaagcttagggctaacctggttgaaggagatgacattattgttgcggtcatttctcaagtgaatgttgtcaccaatgtgaaaaaatga

SEQ ID NO: 48965 - DNA, 761 bp, Glycine max
  Peptide Sequence Number=SeqID_140650
gaggcagtggactcaacttgcggggcccatggctaaatatgatccagaaatagtcatggagttctacgccaatgcatggcccacagaggagggagtcagggataagcgctcctgggtgtggggccaatggatcccctttgatgaagataccattaatcagttcttggggcttctgttggtcttagaagaggggcaacgctgcaaattcagtcagaggaggagccaggcctcggggtttgatgaggaggccatcagtcagcagctatgtgttccaggggatcacacctcccagacacctaatggacccagaaaagtccaacagagcactggggtttctggccttgatcatgggcctctgccagttctatggggatttggcaaagcagtaaggtcaggcacaacagtagcaagaggaggaccaatgcacggacatatgcagcatgtgaccgaccagcaagcggctaatcataggggtcagatgcagctaaatgaaagcttttaccaatacaccctacatcagcagcgccaagaccccagtccttacccatggcctactcccaagcagttcggggccatggtcgcatggcctggatacaagcccaattttcaggcaagggcaggacccacagggacccccaaagatgaagatggaactcaggaggatgatgttatggctgatggtgcatccactaggttgttcaaagagaacaagggagggtacatcacttgtggatctttgcttgtaaaaggatttttacaag

SEQ ID NO: 48966 - DNA, 159 bp, Glycine max
  Peptide Sequence Number=SeqID_140651
atggcctccaatgtacaggccaattcctctactcttttgcatatgcctcctctacttccactcattactctagctctagcactgagttctggaaagaatgcaatgagcaatgcaaccgaattgaaaaggagggctgtgaatgattgcggtacagtttga

SEQ ID NO: 48967 - DNA, 189 bp, Glycine max
  Peptide Sequence Number=SeqID_140652
atgccgatctccccctgcggaagtatcagttggtctgtgccgtcccgacatagggatcgcacccacaggacacccagtggacccggaaaagtccaacagggccctggggtttccagctctgattacgggcctctatcagttctacggagtgcccgtcacccccaacaaggtcatcaggccccctactaa

SEQ ID NO: 48968 - DNA, 99 bp, Glycine max
  Peptide Sequence Number=SeqID_140653
atgtgtagggatgctggggcgttcaagctattgtgtattctgcttttgagagttgaaaaatcgcataggtttggtactcgcatgggcactggactataa

SEQ ID NO: 48969 - DNA, 519 bp, Glycine max
  Peptide Sequence Number=SeqID_140654
atgggatcgagtcaaaagccttcgcttaaaaagaggttctatcaagtcaaaatcaagagcttagaggtcactagtttacgagagttggggcaattaatgggtcaacttcaacagcaagccttccgcaaagcctatggtgtcctctttccaaatatggaagggttagtggacctagcagcggttgacgctttcctcgcctttcatcatggcaaggaaagcccggtcgtcgccattttttccatgtatgacacgttcgaccggggatgtgaaaagagcagtgcaagaattgtttgttgtgcactggctctctatgtgtggctggtttcacacctttttctccaacaaggtaggcccgtctatccactacaacgtcaccgctcgcgcgtcgaacaaggaaaggcgaattgggaccaactcttggctagcatggaggggcgtctgttaatttgttccctcgctagaaggaaggaagaatcaggattctatcttcatgcgaaggatgtccaaatgttcccttga

SEQ ID NO: 48970 - DNA, 529 bp, Glycine max
  Peptide Sequence Number=SeqID_140655
agggatacactccctcgccttcagaggactgcacgtcctcacctttagagggctacttgccctaaccatcagagggctacttgccctaaccatcagagggctacacgtcctcaccttcagagggctacacgtcctcgccttcatagggctgcacgccctcgcctttagaggactacacgtccacgccttcagaggactacacgtcctcgcctttagaggactacacgtcctcaccttcagagggctacttgccctcaccatcagagggctacacgtcctcatgttcagaggactacacgtcctcgccttcatagggctgcacgccctcgccctcagaggactacacgttcacgccttcagaggactacgcctcctcgccttcagaggactacacgtcctccccatcagagaactgcacgtcctcgccatcagagaactacacgccctcgcctacagaggactacacgtcctcgcattcatagggctgcacaccctcgccctcaaaggactacacgtcctcgccttctga

SEQ ID NO: 48971 - DNA, 327 bp, Glycine max
  Peptide Sequence Number=SeqID_140656
atgggtgccaagtacctaaaagtagtcaaacgagagtcgcatcccaaccacggatgtgaaagtgaagaagcaaaaggggaagaatctagtaaagagatttacccccaagaagaaggacaaactttaatggttaaggaggagtgtaaggaggtaagtgtctcctccaagaggttagctaagaaggaaagacattttgaaataaacacaaatattaaaaaaatttcccctcttagacaacctccacattttctcctttgtaaaaagacacttgttagcattgccacacctcttaggcttgagtttattcctcaagtaaaggagttgtag

SEQ ID NO: 48972 - DNA, 382 bp, Glycine max
  Peptide Sequence Number=SeqID_140657
atgactagaggcaatccatatgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagagggctctaagggaaatggctgcacctgatttcacctacgaaagcttgtgcatccaataccctgatgaggatgtcccatatgttcttaagactggactgattcatttgcttccaaagtttcatggccttgcag

SEQ ID NO: 48973 - DNA, 129 bp, Glycine max
  Peptide Sequence Number=SeqID_140658
atggtcactcctatgagcactgcttactatttggataaagatgaaatcggtcaatcaatagacttaaagaaatatagagatatcaatcaaatcccaaagaatctcaccttagtgtcgttaaaagaataa

SEQ ID NO: 48974 - DNA, 204 bp, Glycine max
  Peptide Sequence Number=SeqID_140659
gattcctttgaggagcagccacacagggatccttcgtcccccatggatgtcaggatgttctcaccgctgctattggacgtccagagcaccctagacgtgtccgtgctgctggagccggtgtcaccatcaagcaatactttggatcagcttcacggacgtcctgcagctcttcctccctgcctcccaaagaattgcaatagttga

SEQ ID NO: 48975 - DNA, 751 bp, Glycine max
  Peptide Sequence Number=SeqID_140660
ccgtaatcatccggaagatcctcagtacattggtattgactgcggtatcgtcggttcgctgaacaaagaagataagcgctatctggcggagaacttcattgccttcttcaaccgcgattatcgcaaagttgcggagctgcacgttgattccggctgggttcccgcggataccaacgtcgaagagttcgagtttgctattcgtaccgtctgcgagcctatctttgaaaaaccgctggcggaaatctcgtttggccacgtgttgttgaacctgtttaacaccgcgcggcgtttcaatatggaagtccaaccgcagctggttttgcttcagaagacattactttacgtagaaggggtaggtcgtcagctctatcctcagttagacttgtggaaaacggcgaagccttttctcgagtcgtggattaaggatcaggtcggtattcccgcgctggtgcgtgcgtttaaagaaaaagcgccgttctggattgaaaggatgccggaaattcctgagctggtgtaccaaagcctgcagcagagcaaacagctgcagaccagcgtcgatactatcgtgcgcgacttccaggtgcgtcacgtgcgtcaggggcagtcccgctatctgtttggtataggcgccgttttgcttttaagcggtacgctgttatttatccaccgcccggagtggggcatgatgccaggctggctgatggccggcggcgtcgtaacctggcttattggttggcgaaaaacgcgctga

SEQ ID NO: 48976 - DNA, 929 bp, Glycine max
  Peptide Sequence Number=SeqID_140661
atggaacaggttgtcattgtcgatgcaattcgcaccccgatgggccgttcaaagggcggcgcctttcgcaacgtgcgtgcggaagacctctccgcacacctgatgcgaagcctgctctcgcgtaacccgtcccttgaggcgagcgcgattgacgatatttactggggctgcgtgcaacaaacgctggagcagggtttcaacattgcgcgtaacgccgcgctgttggcggaaataccgcactcggtaccggcaacaacggttaaccgcctgtgcggttcctccatgcaggcgctgcacgatgccgcccgtatgatcatgaccggcgacgccagtgtctgcctgattggcggcgttgagcacatgggccatgtgccaatgagtcatggtgtcgatttccatccgggccttagccgtaacgtggcgaaagccgccggtatgatggggctgaccgcggaaatgctggcgcgtctacacggcattagccgtgaaatgcaggatcaattcgccgcacgttcccacgctcgcgcctgggcggcgacgcaatccggggcattcaaggcggagattatcccgaccggcggccacgatgccgatggcgtgctgaaatcctttaattatgacgaagtgatccgcccggaaaccaccgtagaagcgctggcggcgctgagaccggctttcgatccggtgaccggcacggtaacggcaggtacctcttccgcgctttccgacggcgcggcggccatgctgctgatgagcgaaagccgcgcccgcgagctggggctgaagccgcgcgctcgcgtccgttcaatggcggtggtcggctgcgatccgtccattatgggttatggcccggttccggcctcaaagatggcgctgaaaaaagcgggattatccaccagcgatatcgacgtctttgaaatgaatgaagc

SEQ ID NO: 48977 - DNA, 143 bp, Glycine max
  Peptide Sequence Number=SeqID_140662
tttctgttgctagtgctgcaaatgtatctgctcaagtgaacaatatccctatgctgaatgagacaaattttaaggtctggaaggaagccgtagaaattattctcggctggatggatttggatttgacactgagagcggaatga

SEQ ID NO: 48978 - DNA, 552 bp, Glycine max
  Peptide Sequence Number=SeqID_140663
atggacaaggcaaaagaaataattatcaagtctttcaacaacaatgaaagcaatgcttcaggatgtgaaagaaattggagtgtgtttgagcaaattcattccaaaaaaagaaataggcttgagcacaagaggttgcatgatttggtgtttgtcaaatacaaccaacaattaaggcaaagatataatgcaagagatgaaattaatccaatttctcttaatgatattgatgtgtgcaatgaatggcctgtgggagagatggatcaagatgatgataatgatgttggaaatgatttgcaaaaaacaacaagtgttgttgctgcacaaacttctaaaaaacatgcaatggttgttggatcttcatcaaggaagcaaaaagaagtccaagaaaatgatgaggatctagattttgaggagaatattaatcttgaatctgaagaagaagacatcatggtcaattttgaggcgtctgatggggaagagggagagggagatgctccattaccatatgataataacgaagatgattatgttgggattggcgaagatgattag

SEQ ID NO: 48979 - DNA, 219 bp, Glycine max
  Peptide Sequence Number=SeqID_140664
atgaagaacggtggaaaatcttcacgaaatcgctcacggaaacgtctcggaagcgttacagaagcgcctcggcttggattttcttcacggaatcaatttttctcactgatttcaagggaaaagagggaggtggttgtcgcccagctcgcccaggcgagctgggttgcttccaccagaaggcaccgccttctgttggaacaccctggaaggtccaagtgg

SEQ ID NO: 48980 - DNA, 240 bp, Glycine max
  Peptide Sequence Number=SeqID_140665
atggcttcgaagcgctgctggtgtacagcgctcctaaagcggtggctgtcgtactccggggcggaaccagttccttcggccgccttgtccttcctggacctctttgaggcaagcttcctcggggacattcctgcgaaggcaaacatttggaaagtattttccatgctacctaggtgcaaggtattcctcatggggcagccaaatttaaattctaataacaacctctcaaacatgtcctaa

SEQ ID NO: 48981 - DNA, 135 bp, Glycine max
  Peptide Sequence Number=SeqID_140666
atgggtgaccaagaggagacacaggaacagatgaaagtcgacatgtcagctttgaaagagcaaatggcttccatgatggaggccatgttaggaatgagactactcatggagaataacgtggtcatcgctgccact

SEQ ID NO: 48982 - DNA, 384 bp, Glycine max
  Peptide Sequence Number=SeqID_140667
atgcgtttacaaggcaatgctcaatcaattgatgatcaagaaactattaaatttgcaaagtggattctagatattggagatggagttattggaaatcaaaatgatggatatgctaccattgaaattcctgagtacctactgattactgaatataatgaccccattgatgctatagtcaaatcaagatttccagatttatatcaacatcaaagtaatcctgaattcttcaaatctagagcaatattagcttccaccaatgaaacagttgaagaggtcaatgattatatactttccttgattccagctgaaatcatttctagcaaaaatcttggcgataatgtttacatcccaagaatgtcaatgtcaccttcacaatcaccatga

SEQ ID NO: 48983 - DNA, 219 bp, Glycine max
  Peptide Sequence Number=SeqID_140668
aaggcggttgcttctggaggaagcaaccctgctcgcctgggcgagctgggcggcaaccacctcccctattttgctataaataggggaggaaatgaagaaggaagggccgaggcgcttccgaaacgtttccgtaacgttttccgtgaggaatctcgcaaagctttcaaccgttcttcgacgttcttcattcgttcttcatcgttcttcgatcttcaacgg

SEQ ID NO: 48984 - DNA, 786 bp, Glycine max
  Peptide Sequence Number=SeqID_140669
atggtattggaagagggccaggaatgcgagtatggccagaggaggaaccggtctgatgggttcgatgaggaggccatcgcccagctgctatgtgtaccggggcaggattttgcccggactgctgcagggaggcgagtgcgaatcatgcgcaccaatatgaccaccctgacccagatatggatgacgttgctcctcagcaacatcctgcccaccgatcataattccgacctccccatgcctaagtgccagctagtgtacgccatcctgacacggatgagcatccatgtggctcagttgatcgctgatgccatatatatttttgcaggtatggcgcccactaggcaccctttggacccagataagtccaacagggccctgggattccccgcactgatcacaggactctgccagtcgttcggagtccccgttgcacctaccaagagacaggctcagggtgatgctccacaggccgcaggcgcgccaccaccacctcatcaggctggccaggctgggtcatttgacatagagcagtatttacggcatttggttcgccagcaggcggccaaccaccgagcacatgtacggacccatgactgtctgtaccagatgagccttagcatgcagagccagggcttcgcttctttttcatgccctactccagaccagttcagggcagaggcatgcggagattggcccccagaagctcccggcgatggcgaggaggcccacgaggacgaggagatggccgatttgcttgacttcttgggagggagtggagctacatga

SEQ ID NO: 48985 - DNA, 840 bp, Glycine max
  Peptide Sequence Number=SeqID_140670
agggctgcacgcactcaccatcagaggacgtcacgtcctcaccttcagagggctacaccccctcatcttcagaggactacacgtcctcgcctacaaaaggctgcacgccctcaccttcagaggactgcgtgtcctcactttcagaggactacacgtcctcaccttcagaggactgcaagtcctcactttcagaggactacacgtcctcaccttcagaggactgcatgtcctcactttcagaggactacacgtcctcaccttcagagggcttcacgtcctcgccttcagagggttgcatgccctcaccatcagaggatgtcacgtcctcaccttcagagggctacaccccttcatcttcagaggatgtcacgtcctcaccttcagagggctacaccccctcatcttcagaggactacacgtcctcgccaacagagggctgcacgccctcaccttcagaggattacgtctcctcactttcagaggactacacgtcctcaccttcagaggactgcatgtcctcactttcagaggactacacgtcctcaccttcagaggactgcatgtcctcactttcagaggactacatgtcctcaccttcagagggatacacgccctcggctccgaagactacatgtcctcatcttaagaggactacatgtcctcgccgtcagagggctacacgccctcaccttccgaggactacatgtcctcatcttcagaggactacatgtcctcacctttagagggctacacgccctcggctctgaggactacatgtcctcatcttcagaggactacatgtcctcaccttcagagggctacacgccctcgccttcgtag

SEQ ID NO: 48986 - DNA, 132 bp, Glycine max
  Peptide Sequence Number=SeqID_140671
atggaggaaagaagacctaagaagaaagtccttgaaattgcttatccgctaagcgtaaatcttgcgctaagcgccatctcttcacacgctaagtcgagcttgctcgagctaagtgcaaagacccctgattga

SEQ ID NO: 48987 - DNA, 513 bp, Glycine max
  Peptide Sequence Number=SeqID_140672
atgacattgaccatccaagagcttttcttgaggccttatcagattagatgggatgccaccgtgttcggggtcgttaatccagatttccccctgtacataaagcacgaagacctctccgaaatcgcacacggtggtcaatgtctcagcatatcagtgttacagttgtggattctgttccactgcagcagacattggcagatggtggtcatcctgcccaaagaacacttagttgtctggttttgttcattgcataacaggccaggcaactcctttaaggggattattaatagtgctatcaagggtcttgatgatgctccacagcctaaatccatggcttctgctaggtggattgtcgtcaagtgtaatagacaaaaaggaagtactgagtgcggctactatgtgatgcactggatgtccaccatcattttaggaactattagaaataattgggaagcgtattttaacgatcctagaccattggagccagagagattaaaagcattgcagatctag

SEQ ID NO: 48988 - DNA, 492 bp, Glycine max
  Peptide Sequence Number=SeqID_140673
atggatattgactatgctataagtaaggatgagccaccggctattactgaaactagcgaacctgatgctattgatctttatgaaaagtgggagagatctaatcgtctctctgttatgttcataaaaaccaacatatcaactagtatccggggttcagttgaccaacatgataaggtcagagatatgttgaaagccattgatgaacagtttacgacctctgagaagtcacttgctagcacactcattatgcaattctcttccattaagcttactggaacgagagaagaggagagattgataatggaagagggtgagaaggaagaagctgtaggcaccaataaaggaaagattccgactcaaccaacaattaaaaaggagtcaaagtgtttcttctataaaaagaaaggacacatgaagaaggactgccccaaatttaaaagttggtttgagaagaaagggtatggaaagcctaaggaagccagtgggaagtga

SEQ ID NO: 48989 - DNA, 225 bp, Glycine max
  Peptide Sequence Number=SeqID_140674
atggagaaggacgaagaccgaagtggaaaaggacgaagtccccaagtgaagagaaggatgaaggcccaagtggagaaggacgaaggcccaagtaatccttgtggcgtctaccctgacttatcttccttcacaggaagtggcatcatccaaatctccgcagcctgtatcaagcgatccgctcctagtccggattacatcatctggtatcagagcttcagctcttga

SEQ ID NO: 48990 - DNA, 261 bp, Glycine max
  Peptide Sequence Number=SeqID_140675
atgaagttagttctattcaagtgtgattggtttgataatactccttatatagggacacgagtagataaaaagtatgagattgttgatgtaagaagaatcactaacaatatagtaagtgaaactgagcaagaggctccataccaagatgatgagcttgtagggcttcaagaagtgttagaagttgaccctgatgtcattaatgaatctcttgcagatgttgatggaggtggagaagagatagatgcagatttactcaaataa

SEQ ID NO: 48991 - DNA, 381 bp, Glycine max
  Peptide Sequence Number=SeqID_140676
atggccgaactgagagacgtaaataaagctaccaccaaagccttggaacgagagaccaaaagggctcgtagggaggaatacggccggaacaaattcgaggggctctatggggcagatgagctaaaggtttgcctaaggtccaagagaagcttgtctcagcatttatgcgagacagagaccaacatgttagccatcatcagtaggtaccaagaagaattaaatctagccacgacccacgagcagaaagtggcggacgaatatgcccgagtgtacatggaaaaagaggctagagggagggtgatcgactcgttacatcaaaaggcgacaatgtggatggaccagtttgctcttactttgaacgggagtcaagaacttccctga

SEQ ID NO: 48992 - DNA, 591 bp, Glycine max
  Peptide Sequence Number=SeqID_140677
atggtcattgcccaatcccatttctatgacttgacccaattatccagtaaaggtgtaccatttgaaggtacactaaatgatgattggaaatttgatttctctgtgcatgatgcccgtcgattggtttgcaccaaccaagcggatatgaccgaaaggcttcttcccagttcattggcttttgagagccacatccttcattatctcattgtgcaaatcttacttccaagatcttcaaaccttgcacaggtttctgaagaagatcttattgtaatgtgggcttttcataaaggccgacaaattgattgggcacacttagtccaatatcgcatgcataaggcattgcgattaaatgctccattgccatgtccacacctagtcactctcttccataaacactataacatccctcttgattatgaaccttatgtttcaatcaagagatccttcttaatcggtgctactgtgattgcatcctttgcttgtggatcaaacaagggagggtacatcccttatggatctttgcttgtaaaggattttacaaggttgaaaagaaatctcaaggactgcaggtcgcttggggactggaagtag

SEQ ID NO: 48993 - DNA, 672 bp, Glycine max
  Peptide Sequence Number=SeqID_140678
atggggacaaggggttgcatcagttacaatcccgttcttgctataaggcaacttggctaccttatgagaggggcaccgctagaggaagagctcgcgcctaaggtccccaaggcatgggaggtggtgcaaaggaaggacaaagaacttaggggcagtaacaatgggcccctcggtggctaccgaaggtggttgaaagcccacgtgcaaggtttgtattggctcccgagtttgagaaccgttaaaagggaggaagttgaggcaccggaggaagacgaagaggtgcaggcccttagggtagaactcgagcaagcccaagcagtcaaagaaaggttcaaattagcagctcttaaaatccgaaaggagaatgccgaactaagagatataaatatagctaccaccaaggccttggaacaagagaccaagagggctcgtagggaagagcacagccggaacaagttccgaggggctctctggggcagcaactgcgagcttaagctccggagagagaaaaaagaccaatcacaagtacatagcatgatcttaaaggaggagttagctgcttgctcaagatccaagaagagttttggcccaacacttagaagccacagagcaaagcatgctagctataatagggcagtacaaagaagagttaaaccagtctttgacccatga

SEQ ID NO: 48994 - DNA, 357 bp, Glycine max
  misc_feature (23)..(23): n is a, c, g, or t
  Peptide Sequence Number=SeqID_140679
atgggtttaggcaaagacaaggncggcataactagcctgataaaaacccaaggaaatcgtgggaagtatggtttaggctataagcccactcaggcagacatgaaaagaagcatcgcgggaaggaagaacagtggtcagagctcgcgttggagacaagaaagtgaaggaagcccgccctgccacataagtagaagttttataagtgcgggtctgggagacgaaggtcaagtggtcgcgatatgtgaagataatgttccaagtactttggatttggtccgaccatgccctcctgatttccaactgggaaattggcgggtggaggaacgccccggcatttacgcaacaagcataatgtaa

SEQ ID NO: 48995 - DNA, 290 bp, Glycine max
  Peptide Sequence Number=SeqID_140680
tgagaaaagctgtgatttggttggtgttttggcagagttttctgcctttgctctgttttgcttggctgtgatagctgtgctgtttgatcgttgtttttcttggatgttgtggaagcttgggaggattgatggggacccggtgttgagagaaacgaggatatgggctacgtgggagtacgtgagctcagttggaggtgggcaacaggggatggagaccttggggacgttaggtggggtgctattgcccaaaaccaagcttgaccaatcccgacccaacccgggcatagtcg

SEQ ID NO: 48996 - DNA, 309 bp, Glycine max
  Peptide Sequence Number=SeqID_140681
ttgaagcatccttccaagcttcttatccaaggctcatcttggtggcgaagctccttcttccatggcttattccctagtggatggcgcctcctctcacctcttctcctttgtcttccgctgcatctccatggtggaaaatcaccattaaaggacctcattgaagctcaaagatccatcctccatagaagccccacaagcaagcttccatcaagtggtaatcaaagcacaagagcttcaaggaattggaaggaggattggtgccatcccttgaagaatttgagtcaagaagaaaggggccaaccaccttaa

SEQ ID NO: 48997 - DNA, 318 bp, Glycine max
  Peptide Sequence Number=SeqID_140682
atggagataagttggtgtgattcaattgaagagatagtgtcttcagcagaggaaggggatgaatcagatgagaatgagataatatttcagcagctcaattgtttgaaacttgacggattaggaaagctgagaaggttctacaaagggagtttaagtttcccgtccttggaggaattcacagtaatgggttgcgggtaccgagctcgaattcgtaatcatgtcgggaaacctgtcgtgccagctgcattaatgaatcggccaacgcgcggggagaggcggtttgcgtattgggcgctcttccgcttcctcgctcactga

SEQ ID NO: 48998 - DNA, 402 bp, Glycine max
  Peptide Sequence Number=SeqID_140683
atgcggagataccttacggttatccacaccttttgtcagttagaggcaagagagcccattgacacgcagagactaacatcgtcatctgcacttttgtcatctagagacagcaagtccgatgacatgcagagataccttatggttatccgcaccttttgtcagctagagccaagcgagcccattgacacgcagagactaacatcgtcatctgcacttttgtcatccagagatggaaagtccgatgacatgcgaagataccttatggcaagcgagcctgttgacatgctaacactaacatcgtcatctgcacctttcccggagatatcagcgtctttcggccgagactgcgaaaaagtctcatttgctatccttcagactcaagggtccagtagcatgcagtga

SEQ ID NO: 48999 - DNA, 1503 bp, Glycine max
  Peptide Sequence Number=SeqID_140684
atggtgttcagcggccagccggatgtgcagcaacagcgtgcggcaggcctgctggcctcgtggttcggtagccaggcgcagtggcgcggccagtccttcccggtgctgtataaccagctgccggaaggacagcatgcggtggtgttcgccaccaacgatcgccggcctgacttcctgcaaacgctgccgccggtggacaaacccaccgtggaaatggtcagccagccggacaatccctatcagaagatgctgctgattctcggccgcgacgataacgatctgatcactgcagtagagggcattgcgcagggtgaactgctactgcgcggcgagcgcgccaccatcgacagcgtgaaactgctggccccgcgccagccgtacgatgcgccaaactgggtacgcaccgatcgccgcaccacctttggtgaactgacgcagtatcagaatcagttgcaggccgatggcctgcaacccaacccgattagcctgacgctcaacctgccgccggatctgttcctggtgcgcgcacgcggcattgatatggacctgatctatcgctacacctcaccggtgcagcaggacggctcacggctggcggtgcatctcaataaccagttcatgcaggattatccgctgaccagtaaagatggcgcgggtcagcagctgatgcgcattccgctgatgcagggcctgcaggacaacagccgtcagctgaccattccggcactgcgtctcggtgtggtgaaccagctgcgctttgattttgactacgccaatacctttatcggcggcactgccgatggccgctgtgaaaccgtcccccccgtcgcgcatcatgcggtgatcgacgatcgctccagcatcgatttctccggctatcgtcactacatcgaaatgccctcgctcggcgcgtttgccagcgctggcttcccgttcagccgcttcgccgatctggcgcaaaccctggtgctggtgccggcaaaaccggagagcggcgaagtcagtacgctgcttgacgcgctgggggcgatcggcgcccagaccggctatccggcactgcgcgtgcagatgagcgatgactggcgcaacgccaaagaccacgatgccgatctgctgctgatcggcagcattccgccggatctgcaggcggacacggcgatcaatctgctggtggatcgcacgcgcagcaccctcaacatgccatcgcgcccgggcagcgcgcccaacgtgccactgtcagccagcgagcgcactgccgaaagccagaccggcatcagttcgcgcggtccgatcggcgccctgcatcgtccgggagtccggcgtcaacagcgtgcgcgtgggcgatacctactttgtcgggcatctgccgtggtgggagcggttgtggaatctgctggccacccatccggtatggctggccgtgtgtgccgtgctggtggtgatcctgttcgccctgatggcctggcgcctgatgcgcatggtgagccgtcgtcgcctggctga

SEQ ID NO: 49000 - DNA, 136 bp, Glycine max
  Peptide Sequence Number=SeqID_140685
atggatcctgcgccctttatcattcaggaacaacaagctgagtgggaacaacaagctgagtgggaacaacaagctgagtgggtaaacgcgcagagacagattttgtgccctttatcattcaggagcagcgaggcgg

SEQ ID NO: 49001 - DNA, 315 bp, Glycine max
  Peptide Sequence Number=SeqID_140686
atgcgagcggggatttctgatctgtatggattcctcgagccacaatccatacaaaggtctaggcaatcacagtttgagactaaaagttacataaagagttggatacagagttcaaaacgagatgtctaccttggagcctacttgaatggtgctttaaaaggtcttgatgatgctccacaacataaatcaaaggttcctgctaggtggattgtcgtcaagcgtaacagacaaaaaggaagcactgagtgcggctattatgtcatgcactggatgtccaccatcattttaggaagttttaggaataactgggaagca

SEQ ID NO: 49002 - DNA, 885 bp, Glycine max
  misc_feature (808)..(808): n is a, c, g, or t
  Peptide Sequence Number=SeqID_140687
gcacagaccatccagaaacaaaacactgcccctcacgttttgtctcgtgggggttatgaatatttggagcagaagctcctagctgagaagaccaagaagaagctagaggaagctgcacaatcaggaatcgttgatggcgtcatcgacccttcatcccccgattcctttgaggagcaggcgccacagggatccttcatcccatatggacgtcaagatgttctcaccgctactataggacatccagagcaccctggacgtgtccgtgctgctggagccggtgttaccatcaagcaatactttggatcggctccacggacgtccctgctgccttatgaagaattgcagctgctgacccaacaaatcagggaccagctagaggagtcgatcactgaaaaaggacttgcactgcctcccgagcctctggttggtccctcagatcctcgagtaagcacaaaggagagttatgttgatcccttaggaaacaatcctgagacgggtgactcagacaggtgcggcttgtacattgaagcaaatcctgcccacctggttgccttgggaagagtttatgagggatccactgttgttcataacactcctttgttgcctggacaagtaaaggtgggtgtggaggaggttaaagatacagatgctctcgttcctgtacccactaatcaggtttccttagtggggcagacaattcacaccttccttgcttggtcgacacatctggtcaagtctttatcacagcaggtagatgtgtctccggcaaaaccacttcaaaagccggatccggaggtcgatgatccgntttatctaatgaccttgatcatcccagagcttttcttgaggccttaccaagttacatgggatgccaccatgttcgag

SEQ ID NO: 49003 - DNA, 255 bp, Glycine max
  Peptide Sequence Number=SeqID_140688
atgaattttccgaaaaacctgatagtggaggaagacctcctaaggataagagacatagggctaaagagagagccaaataaggatctttcgggtataatcctgcataatctcgaatgttatcagttccgctactttcgaagtaacagaaagaaaagcaacgactggagtgggagagtcagagtcgaaaagaggattcctcacttctttctctcattcaaaaccgtgcatgagactttcatctcgcacggctcctaa

SEQ ID NO: 49004 - DNA, 447 bp, Glycine max
  Peptide Sequence Number=SeqID_140689
atgttagcctggggagcacctgtcattgaggatttctgcatttacgtgccatatgtcccggtttgcacaattgtaacagaggaatggctcaccgggattattcttggcaggtggatgttgtctagcatgttggacccttggggggttcttgttgcggttggaggtatcgctcacattgcgattctgattcttaaagtttttgccaataggcttcagaactgcacctgtgttcttccttttagtgttgttgtgagacacaaccaacacttcatctttctaatctggtctgcgtgcctcttcctcaatgcgcagatgtgtgatcagagactccaaagagaattctttggtcttgtgtctgagaaggtttttgaaatccttccagccaggaggcaatttgtctatgataacagcaacctgaaattgctcatccaatgtcataccctctga

SEQ ID NO: 49005 - DNA, 444 bp, Glycine max
  Peptide Sequence Number=SeqID_140690
atgtctgccgatacgctctgtttcgattacgcgcaagacaccttcagcagcacatttcacgtgacggcggcgcaaaacaacgaggttgaaaccctgcttacgctggccaaaacgttacgtttgcgtctggcgaccattaccccggatgccagtgcgctgaagaatcttcttccggcggtggcaccagcgcagtgtgtcgtctggcgggatgaacggcagtggctctgggcgatgcgccaccagtgggggcgccgtgttgccgcagaagctgaaaacgtggctgagctttcagcgctgctggccgtggagccggcggatatcgcgctgtttgatagccgacgtaacccatgggaaaccctgcagcgatgccatgccccgttaccggaatgcggcgcggactataccgttgcgctggcgttagccatgagtgaggtgcccgcatga

SEQ ID NO: 49006 - DNA, 336 bp, Glycine max
  Peptide Sequence Number=SeqID_140691
atcacatctagacctcactcctgtagcagagaaaaggaaagaaagcctcaagaggctaacattaacctcccatacttccattggaaggacaatgtagaagcttacttagattgggaaataacaatagagcaacaacttaaaaggaagtctacttcaaaatcttatgactctcactcatatccaaagaaagatcaaggtcaaggcatcttaggggcggcaccttctaagcccaaagatgataaagggaagacaatagaaaaacaaccccctaacactagtatgcaagagaagactagctctataaagtgctttaaatgtcttggaagaagacattaa

SEQ ID NO: 49007 - DNA, 408 bp, Glycine max
  Peptide Sequence Number=SeqID_140692
atgggtaaagcggaggaggtacaagagaagatgaaggccgacatgaaggccatgaaagagcaaatggccacgatgatggaggccatgatgagcatgaggaagataatggaagccaatgcagttgcagttgccgccaccagggctgtttctaaggtgaacccgatgcccccatctgatctcaaccaaatgaaccatccaacctcagatatggcgggcaaagatttgggaagtacaggcggcccccatgatgtgcaaattcaaaatgagcacgccttcccgacatatggtttgcctctcaactatacgccacctaatgtggcgtacactcccaataagaatgtcaattactccactcatatacccattgagagccaacaaacccaaactgatcatgcacatgtctcttaa

SEQ ID NO: 49008 - DNA, 359 bp, Glycine max
  Peptide Sequence Number=SeqID_140693
ttaggctaccctatgagaggtgcctgtcggaggaaatcatcgcgcctttcatcgcgcgaggtttcaatgaagcaaatgcgaagacactccaaaggatccgcaaagcatggaatagagtggaaagaaaagataaagagcttaagggaagtagcaatggcatcataggcggctatcgcaaatggttgaagtctagaacgcaagggataacttggctcctaaagctaaaaggtttgagtggtgaagaggttgaaattcctgaggaaagtgaagaagtgcaagctttgaaagccgagctcgaaagaatgagagtggtaaaagagaagctgaaggtggcggtcactagggtcaggaaagaatga

SEQ ID NO: 49009 - DNA, 309 bp, Glycine max
  Peptide Sequence Number=SeqID_140694
atggtttcaattagaagtgatcatggaggaaaatttgatgcaaaagctgatgaggcaatttttcttggttattcattggaaagcaaggtggtatatagagcgtttaataggagaacattatgtgtggaagaatctatacatgttgtgtgtgatgaaactaactctcttattcaagaaaatgctttggaagatgaagatataggtcttcaggataagaacattgcacttgaagatgaaaccaaggttaaggatcttgaacaaaataaggaaatcacaaccacacctcctaaagacctcccaaaggaatga

SEQ ID NO: 49010 - DNA, 204 bp, Glycine max
  Peptide Sequence Number=SeqID_140695
atggcgtgttgttggatgaatagtgttgatatcgtagcgacgaggcaggtcgttacatttagtggtatcagagcaggtcgaacctttcggccaggagtgatggttggacgaaatgatcgtgtgatagcggatgcccttcaagccttagctcaggctatagggaatccaaataggggagaagctagtggagctgttgagtactag

SEQ ID NO: 49011 - DNA, 603 bp, Glycine max
  Peptide Sequence Number=SeqID_140696
atgggaatgaggggttgcattaattacaatcccgcacttgttataagacagttagggtaccccatgagggaagcaccgacggaagaaagcctgtctcctttccttgcgtgggaaaacccgttaaggaaagataaagagcttaggggcattcgtaatggcatcattggtggttatcatgaatggatgaaagttcgtacagggggtttagattggctcgccaagttaaagattatcaacgaagagaatttcgaagctccggaagaagatgaagaagttcgagctctgaaaacaaaactaggaaaagcgagacttgccaaagaaaaattcaagttggtcgctacagacgtccggaaagagtgtgccgggttacgagaagaaaatgcagctatcgcaagagccctagaacgagaaaccaagaaggctcgcaaggaagagcatggccgggacaaattccgtggagctttgtggggcaacaacaatgagctcaagcttgtaggcctaggatcttcttcatcaatggattcctttgcttcttggaagatgaatggcagcggaatggagaaaggaagagagagaggagacgccacttcaaggagaagatga

SEQ ID NO: 49012 - DNA, 384 bp, Glycine max
  Peptide Sequence Number=SeqID_140697
atggcgttggttgttgggtcacctatgatatcttgttgccacggatttacagtagggaactggttatgtgactcagatctagttaaccctactggaattgaacgggttctcaccgaaaaagaccttcttgctgactcatattcagacctagaggcttctatcctagatgagaaagaatttctcctattaaaggttatctctaccttactggagttgtcttgtttaatttgttctatggttggagcgggtcaagggatagacggtgtggccttatccatgacccatttttctggaagagttacctcatcccattttatggttcttaggagagaaacattggcctttgtcatatcagtgacaaacaaggttgtctctcctttttga

SEQ ID NO: 49013 - DNA, 126 bp, Glycine max
  Peptide Sequence Number=SeqID_140698
atggtcgcacaggaagaccgagaagtaaagccacaccaagaagagacgaaaatcatgaacttgggtgttggtgaggaaaagaaagaggtagccaacattgtgccagtccctaagaaagatgggaag

SEQ ID NO: 49014 - DNA, 1056 bp, Glycine max
  Peptide Sequence Number=SeqID_140699
caaattctgatcaacctgattggcaacgccatcaaattcaccgagcgcggccacattgatctgcgcgtcgagctgcgtcatctcagcatcacgcgggcggaactggagattcaggtgcacgataccggcatcggtatctctgagcagcagcagtcgcagctgttccaggcatttcgtcaggcggacgccagtatttcgcgccgtcacggcggtaccggtcttggcctggtgattacgcagaaactggtgcacgaaatgggcggtgagatcgccttccacagccggcagaatcagggctccaccttctgggtacaggtacatctggatctcaatcctaatgcaccggcgattccacgcatgctggacgatctgcacgccacgccgctggcttatatcgaaccccatccggcggtggcgaaagcggttcaggagatgctgagcattacgcctctgcaggtgcagcactttgccagccttgacgatctgcccgacgcccacttcccgctgctgctgatggggctgccggtcagcgatccgcatccggctacgctgtccgatgcgctgattgcccgcctgcgcgcacacgccgactccgtgctgctggcgctgccgagcgaaatgatgctgttcgctgacgatctgcgcgcgcgcggtatcgccggctgcattgccaaaccggtgtcgctgacgcgattgctgccgatgctgctcgatctcaacatgcgtcacagcgacgccgccccgcgcggcgtaagacagccgctgacggtgatggcggtggatgataatccggccaacctgaagctgatcggcgcattgctggaggagcaggtccagaacatcattctgtgcgataacgccagtcaggcgattcatcaggcgcaacagcagcggctggacgtgatgtttgatggatattcagatgccggacatcgacggcatctcgcgccagaaagatcatccgcagcctgccacagcacgccagcacgccgattgtcgcggtcacagcgcatgcgctgtatgtcctacgcacgccgcttatctctgccggcatga

SEQ ID NO: 49015 - DNA, 339 bp, Glycine max
  Peptide Sequence Number=SeqID_140700
atgacgttgttacttagcaacattatgcccaacgaccgtaatgccgatctccccctgcggaagtatcagttgggatcgcgcccacaagacacccagtggacctggaaaagtccaacagggccctggggtttccagctctggttacgggcctctatcagtcctacagggtgcccgtaccccccccccccggcaaggtcatgccatcccgacataggtaaggatcgcgcccacaagacacccagtggacccggaaaagtccaacagggcctggggtttccagctctgattacggccctctgtcagttctaccgagtgcctgtcgccccaacaagtcattag

SEQ ID NO: 49016 - DNA, 228 bp, Glycine max
  Peptide Sequence Number=SeqID_140701
atgattcctccacccaggattgtacctgttgctggagaggtcataattgttctattgtggctgattttgttgctgaggttgaggaggtctgtcgcaatgtgcccttcacgggcgagcgaaggcgaggctcacgggtgcgctttccaaaggaggaaagatgcgcggagtcgccaccaacgtttgtttgtggaaaacgtcgggaaaaccgaaggaaaccggccaaaatga

SEQ ID NO: 49017 - DNA, 237 bp, Glycine max
  Peptide Sequence Number=SeqID_140702
atggaccttttcaggtcttggagacgatcaataataatgcctataggtggagctgatatagaggaggaggaaccaacagatttgaggtcaaatcctcatcaagggggagggggtgatgcaatcctccctaggaaaggaccagttaccagagccatgagcaagaggctccaagaggattgggctagagttgataaagaaggccttagggttctcatgaaccttagggtagatttttga

SEQ ID NO: 49018 - DNA, 363 bp, Glycine max
  Peptide Sequence Number=SeqID_140703
atgatggctcatgtagtagctaccttccttttttttgtgtatgcaaatacaaatgaacagagacatatctttgatagtatcattaatgctgtcaatggacacgctggtggaatgtttttcctatatgggtatgaaggtactaggaagacctttatgtggaagacattagcttctgcactacattcaaaaggtgatattgtgttaactgttgcgtcaagtgggatagcctcattgttattaccaaatggtagaactgcacattcaaaatttgttattcctgtgcgtacattagaaaactcaaagtgtaatatccaccaaggcaaattcttcttgtcattcctagaggaagtagatcagacatag

SEQ ID NO: 49019 - DNA, 353 bp, Glycine max
  Peptide Sequence Number=SeqID_140704
caatcactacgcatggctccaaactcgtgggtggaggttgcatgaacgaaaacacaattcatggggctccaaaaggggttgaggatggagaattgcacaaagcaatcactacgcatggctccaagctcgtgggtggaggacgcatgaatgaaaacgcttttcatggggctccgaaaaagggtttagaatggagaattgcactatgcaatcactacgcatggctcaaagctcgtgggtggaggacgcatgaacgaaaacgcaattcattgggctccgaaaaagggttaaggatggagaatcgcactaagcaatcactacgcatggctccaaactcgtgggtggaggccgcatga

SEQ ID NO: 49020 - DNA, 630 bp, Glycine max
  Peptide Sequence Number=SeqID_140705
atgtccaaatcttgtggatttgggatgaccggccctctcgatgagtcgatttcttgctttctcataagggtggacccttgggtacttgtacctatcgcctttagaggactacacatcctcgccttcagaggactgcatgtccctcaccttgagaggagtacacgtcctcgccttgagaggactacacgtcctcaccatcagagggctgcacgccctcacctccagaggactgcacgtcctcgccttgagagggctacccgccctcgccttggagagctacacgccctcgctatcagaggactgcatgtcctcaccttcgtagggctacacgcccttacctttagaggactacacgtcctcgccaacagagggctgcacgccctcaccttgagaggactacacatcctcgccttgagaggactacacgtcctcaccatcagagggctgcacgccctcacctccagaggactacacgtcctcgccttgagagggctacccgccctcgccttgggtactagttaccctcaccttcagaggactatacgtcctcaccttcagagggctacacgccctcgccatcagaggactgcatgtcctcaccttcgtagggctacacgccctcacctttag

SEQ ID NO: 49021 - DNA, 223 bp, Glycine max
  Peptide Sequence Number=SeqID_140706
atggctagaacacgaggtttaggtcgtgccataggtagacttgtaggcagagatagacttgatgaccaggatgctgctgatgttcccgagaggcgtaggcctactgccgtagcccgtaggctacgggttcatcagatgactgcggagggacgtgatatggttgaggacgttgctgacatgcctggcgatgtccctgagctggctccggaggcacctgagatgc

SEQ ID NO: 49022 - DNA, 345 bp, Glycine max
  Peptide Sequence Number=SeqID_140707
atgggtgaagtagaggaggtgcaagagcagatgaaggtcaacatggaggccatgaaagagcaaatgaccacaatgatggaggccacgataagcatgaagaagataatggaagccaatgcgattgtagttgtcgctaccagcgttgttgctaaggtgaacccgatgcccccatctggcctcaatcaaatgaatcatccaacctcagccatgcacgccttcccgtcatatggcttgcctcccaactatacaccacctaatgagatatacattcccaatgaggatgtcaataactccactcccatactcattgagagccgacaacctcatcatgtacatgtctcttaa

SEQ ID NO: 49023 - DNA, 276 bp, Glycine max
  Peptide Sequence Number=SeqID_140708
atgggaaatttggatcatctagaggaaaggctcagggactttgaaggaggtgaagattatgcctttgctaacctagaagagttgttcctagtacccaaacatggtcattcccaggaatatgcccaaaggtggagggatctggcagcccaagtggtacccccaatgatggaaaaggagacgataatcgtgatggtagacacattatcggtattctactatgaaaagatggtgggctacgcaccttcaaagctttgcggatttggtcttcgccagtga

SEQ ID NO: 49024 - DNA, 723 bp, Glycine max
  Peptide Sequence Number=SeqID_140709
taccaaggaagtgtttggaggaaagggcaaaggccttggaaaatcaaggcaaatgggctttcttttattgacatcttggcgcttttgatctttggagttgtcctctttccgaatatggaagggttagtagacctagccgtgattgacgctttcctcgcctttcatcatggcaaggaaagcccggtcgtcgccattttggacatgtatgacacgttcgactggggatgtgaaaagagtggcgcaagaattgtttgttgtgcactggctctctatgtgtggctggtttcacacctttttctccaagaaggtaggcccatctatccgctacaaggtcaccgctcgtgcgtcgaaaaaggaaaggcaaattgggaccaactcttagcaagcaaagaaggagcatctgtcaactggttccctcgatggaaggaaggaggaaccagagttcttatttcatgcggaggatttccaaatgttcccttgatggggacgaggggttgcatcagctacaatcccgacagagagcttaggggaagcagtaatgggatcatcggcggcaatcataagtggctgagagtccggacacaaggattggattggctcccaaatctaaagactgtgagagacaatgaggcatcagaagaaagtgatgaggtacaagccctaaaggcagagcttgaaagagcccgggtagtcgaagagaagttcaagtccatagccatcaaa

SEQ ID NO: 49025 - DNA, 147 bp, Glycine max
  Peptide Sequence Number=SeqID_140710
atggctattggtcggctagagcatccaggtcgcgtacgtgtggtagggacagttcatgaccagtgtactcaactagtggcattgggaaaagtgtatgagagtgtgtccattatacacaatgtcccttatgcagatgatgtggttagg

SEQ ID NO: 49026 - DNA, 695 bp, Glycine max
  Peptide Sequence Number=SeqID_140711
tgaagaacttcgtgactattatgaaggaaggcataggtcacatcttagacctcacttccatagaagagaaaaggaaagaaagcctcaagaggctaacattaaactctcaaacttccatggaaaggacaatgtagaggctaacttagattgggaaataagggtagagcaacaacttaaaaagaagtctacttcaaaatcttatggctctcactcttatccaaagaaagaccaaggacacattacttctcaatgccccaccacaaaaaccatgattatgaggggccaagacatttatagtagccaagatgaggctactacttcacctttctctagtgaaagtgaagaagcaaaagaggaagaatctagtaaagaaacctacccccaagaagatggacaaccattagtggttaaagagaagtgtaaggagataagtgtctcctacaagaggttagctaagagggaaactcattttacaataaagacaaacattaaagaaactttccctcttagacaacctccacattttctcttttgtaaaaagacacttgctagcattgccacacctcttgggcttgagtttattcctcaagtaaagaagttgttggatgagggtttggttcgcaagagcttaaatccttgtgctttgttggtgcccaaaataggtattattaggcaccaagtccctaaaattggtg

SEQ ID NO: 49027 - DNA, 341 bp, Glycine max
  Peptide Sequence Number=SeqID_140712
cattgatcacgggtctctgccagtcgttcggggttcctgtcacacctagtaaggtgattcgaccgccgatcaccagggctttcatagaaaagtattgcacgcctatacaggtgcagggtggcgacctgcaggccccagacgcaccgccgccacctcatcaggctgatccagctgggtcatttgacacggagcggtatttacggcatttgatttgccagcaggcggccaaccacagggcgcacgtgcagacccatgactgtctctaccagctcagcctcagcctccagagccagggttttgctccttttccatgccctactccggatcagttcagggcatag

SEQ ID NO: 49028 - DNA, 309 bp, Glycine max
  Peptide Sequence Number=SeqID_140713
atggctgaagagccaaggagagtgaccctggaagattactcaagttccattgtgccgcaattcttttccagtatagcgcggccagaggttaaggccacagtccaagcaactattagacgcttcggctggggggaaaataaagttgaagactcccgaagaagccatggatcttatggaaaatatggctgcaagttgcagggtgtgccatctatggtggagctcacaattctagctgttgtatccccaatgaagaaccagctcgtgaagtcaattatatggggaaccagccaagacaaaatttcaatgtag

SEQ ID NO: 49029 - DNA, 186 bp, Glycine max
  Peptide Sequence Number=SeqID_140714
atggatataggtccagcactaggtaccagatctatggaaaactctatctctctctcgggtggatcttcttcatcaatggattcctttgcttcttggaagatgaaaggaagcggaatggagaaggaagagagagaagagacgccacttcaaggagaagatgagtctagaagaagctcaccaccatag

SEQ ID NO: 49030 - DNA, 597 bp, Glycine max
  Peptide Sequence Number=SeqID_140715
atggccaagtttgaccctgagatagtcctagagttctatgctaatgcttggcccacagaggagggagtgcgagacatgcattcgtgggtgaagggtcaatggattccctttgatgcagatgccctcagccaattcctgagtgagctgctatttttggaggaaggccagcagtgtgagttcagccagaggaggaacagggccggtgggttcgatgaggaagccattgcccagctattgtgcacaccggagcaggatttcgcttggaccgctgcagtgaggcgggtgcggatcatgcgcaccagcatgaccactttcacccagacatggatgacactactgatcagcaatgtcttaccaagcgatcacaactccgatctccctctgcctaagtgccagttggtgtatgccatcctgacacggatgagtgtccacgtggaccaggtgattgctaacgccatttatttgtatgcaggtatgatgcctaccagggaccctctggacccagataagtccaacagggccctgggttttccggcgctgttcacgggcctctgccagtccttcggagttcctgtcaaccccagtaaagtaatctga

SEQ ID NO: 49031 - DNA, 459 bp, Glycine max
  Peptide Sequence Number=SeqID_140716
atggatctcattgaaaatatggctgcaagcgacattgctattttgagagatagagctcacattcctaccaaaaagagtttattggagttgacctaccaagatgcattgttggcacaaaacaaattgttgtctaagcaactggaagcattgactgaaacgctaagatgtaccatctgtgggggagctcatgaatctggatgttgtattcctattgaagaacaccctactcgtgaagtcaattacatgggaaatcagcccagaaaaaattttgatgcaggaggattttctggatttcaacatggccaacaatataatcaacaacagggacaatggaggaacaaccctggtaatcagttcaatagagatcaaggtggaccatccacaaggccacaacaacaagggcctagtctctatgatcgcacaacgaagctggaagagactttagctcagtttatccag

SEQ ID NO: 49032 - DNA, 189 bp, Glycine max
  Peptide Sequence Number=SeqID_140717
atgggtcaaggaatcacaacgaaaagtgtacctaacaacttatctgaatcagacaatattgttgtttggttatgttctctgcggaagaagcctgacgttaacatcaagggtgcagttaacagtgcaatgaagacattagccaatagtttggaaggaaaggtagatcaagctgtgccgatgatggattga

SEQ ID NO: 49033 - DNA, 615 bp, Glycine max
  Peptide Sequence Number=SeqID_140718
atggcctacattgttgcgttgaccgggggcataggcagcggcaagacgaccgtcgcgaacgcctttgcgcgccacggcgcaaccctcgtcgatgccgacgtgatcgcccgtcaggtcgtcgagccgggcacccctgctttggccgcgatcgccgagcgatttggtaatgaaatgttgctgccggatggcgcattgaaccgcgctgcgctgcgtcagcgcatctttagccatcccgatgacaaaacctggctgaaccagctgctgcatccgctgatacaccgtgaaacccagcgccaactggcgcaggccaccagcccgtacgcgctgtgggtggtgccgctgctggtggaaaacggtctgcaggatcgcgccgatcgggtgctggtgatcgacgtcgacgccgaaacccagctggatcgcaccatcgcgcgcgacggcgtcagccgtgagcaagcgcagagcattctcgccgcccaggccacgcgccggcagcgcctcgccgtggcggatgacattattgacaacagcggcgccgctcaggggatagagccacaggtcgccgcactgcatcgtcgctaccttgaactggcggcaacagcgccccaacaggattaa

SEQ ID NO: 49034 - DNA, 276 bp, Glycine max
  Peptide Sequence Number=SeqID_140719
atgattataaggggccaagacatttatagtagacaagatgaggctactacttcaccttcctctagtgaaagtgaagaagcaaaatgggaagaatctagtgaagaaatctacccccaagaagaaggacaaccattagtggttaaagaaaagtgtaaggaggtgctcatatgggacaccttaggtttgtcgtatttttttgtaggaataatcaacataaaaatacagaaaaaggtgtcgagggaaggagcccagagtatgaagaacctcgggatttga

SEQ ID NO: 49035 - DNA, 405 bp, Glycine max
  Peptide Sequence Number=SeqID_140720
atgggccacatgaatactaacctgagtcaagatggcgtagaccagctggcacttcggcaagggaaaatcagaattatgatcgctgggaggatgttgctgagaagcagtgtcatccagatctgtgttagggtggtcatgctagtgcgcatgatccgcaccggtcttcctgtcacacttcatgcgaagtcctgccccaaaacacacagcagctggcctatggcctcctcatcaaatctcgaagcctggctcctcctctcactaaactcgcaatgttacccctcttccaggaccaacggatgccctaagaacttattaatggcatcttcatcaaaggggacccattggccccgcacacaagagcgcttatacccgactccttcctctgtaggccatgcattagcgtag

SEQ ID NO: 49036 - DNA, 708 bp, Glycine max
  Peptide Sequence Number=SeqID_140721
ttgagctgtggttccttggccaaggataccatgatcatttggaaaaggtcgaggcggatgttttggagatccttagatcgttcaaaacatgttgttctttttggaagaaggccagagaaatctttgccaatgatattcagagtttgtttgatgcaactatgaaggtcacagccctcaaacaaaccagccacgacatgattgcacacataggaaaagctcgggctgcagtggaagagttgaagaggtttcttgtagctgattcgctggaggaagtgaataaaaagctggataagttctatatggttcttatcttgaggagtcttcattcagattttgatcatgtgcgtgatcaagttcttgctggagatcaagtaccatcgatggattctctcatcactaggctgcttcgggtgccccatgtgctgaaagaagaaaatctagctgacacgatggaaacatcagccatggttgcaactcgtgggagagggggaggccgtaacagtagaggaggtcggagtggtagagaaaaatcagagtccaagttctctgatgaagagtaccaagagtatttgaagctgaaatctgagaaatccagcagtcaagcctcatcttcctctgtaccatgttactcgacggcatgtatttctcaatctattgacggtcccagtccttggattcttgattcaggtgcctctgatcatatttctg

SEQ ID NO: 49037 - DNA, 252 bp, Glycine max
  Peptide Sequence Number=SeqID_140722
atgagggacaaagatatcaacgtcatccatttcgtggaacattgtaactgtggatttacacgtgattctcctcaaatttcagccagtccgcatcaattagaccttgcaccttacgcttcagagccctacaatgctcaatggaatgccacggggcttctccatgacaagcacacattgcgttcgagtcgtattctcggagaaatggaggttgatgaaccttggttggggttatggcgaccattgaattattaa

SEQ ID NO: 49038 - DNA, 1344 bp, Glycine max
  Peptide Sequence Number=SeqID_140723
atggacaagaaaatccgcagtatcgtgagtagcattttgaaagacgcctctgttcctgatgctggtgaagatgttccaacatcttccaccccgaatgtttctgtgccggatgttgagaaagatgttccaacatcttccgggccaaatgctgaagtactctcttcccccagcaaagagagatcaacagaggaagatgatcaagcgataaaggagacccctgcaccaagggcaccagaacctgctccaggtgacctcattgacctggaagaagtcgaatctgatgaagaacccattgccaacaggttggcacctggcattgcggaaagacttcaaaacagaaagggaaaaaccccccttaagaggtctggacgaatcaagactatggcacagaagaagagtactccaatcactcctgccacatccagaagaagcaaggttgctatcccctccaagaagaggaaagaaatttcctcatccgattctgatgaggatgtcgaaccagatgtctcgacatctaagagggccaagaaatctggaagaaaggtgcctggaaatgttcctgatgcaccattggacaacatctctttccactccattggcaatgttgaaaagtggaaatatgtgtatcaacgcagacttgcggttgaaagagaactgggaagaaatgccttggattgcaaggagaccatggacctcatcaaggctgctggactactgaagacagtcaccaagttgggagactgttatgaaggcctagtcagggattcattgtcaacattccctctgacatatcaaacagaaaaagtgatgattatcaaagagtgtttgtcagaggaaaatattgatgtttctgagcatcaaattgccaaggaaatcactgccaaacgagtccagcattggccaaagaaagggaagctttcagcagggaagctaagtgtgaagtatgcaattctgcacaggattggagctgcaaactgggttcccaccaatcatacttccactgttgccacaagtttgggtaaatttctgtatgttgttggaaccaagtccaaatttaattttggaaactatatttttgatcaaaccgtcaagcattcagaatcatttgctgtcaaattacccattgccttccctactgtattgtgtggcattatgttgagtcaacatccaaatattttaaacaacattgactctgtaatgaagagagaatctcctctatccctgcattacaaactgtttgaggggacacatgtcccagacattgtctcgacatcagggaaagctgctgctttaggtgctgtgtccaaggatgctctgattgctgaactcaaggacacatgcaag

SEQ ID NO: 49039 - DNA, 156 bp, Glycine max
  Peptide Sequence Number=SeqID_140724
atgaattcattgcctagcgctgttcagtgtcctccgttatcaagcgcggagcctctgaagaaaaaaagaaggggtagagacgagagtcgtcatcacggaaagggcaggacggacgaaatcagtgtcttgtctttgctttcctcttatctccgatga

SEQ ID NO: 49040 - DNA, 240 bp, Glycine max
  Peptide Sequence Number=SeqID_140725
atggcagtggaatggagaaggaagagagagaggagatgccacttcaaggagaagataagtctagaagaagctcaccatcataggaggccatggataagagcttggaggaagaaggagatgaatgaagggagagggagagaagagcacgaaattttgtgctctaaaagagatctgaaatctgaacccactaatccaagatcaattacaagattcttcactaagtgtgcttatatgtcataa

SEQ ID NO: 49041 - DNA, 159 bp, Glycine max
  Peptide Sequence Number=SeqID_140726
atggcttcctatggtgtgtcatctccaatcctctttcttccttcttcattatgctaccatgatcttcaagaagcaaaggaatccattgatgaagaagatccaaggcctaaaagctccaatggagctacatcatgtggtatcaagagtcgctttatctag

SEQ ID NO: 49042 - DNA, 519 bp, Glycine max
  Peptide Sequence Number=SeqID_140727
atgtggaagcaaggtcacatcaaatctaaatgtcctatttaccttagaaaacaacttgttgaaaagaaaggaaagaaggaagaaaaatatagaaaggcctacatagcttgggaagacaatgcatctgcatccttcgactgttctagtgaagaagatattgcaaatgtgtgcttgatggcaaattcaatggatgactcctcaaccattgaagaaactgaggtaaactttgaatttgaagaagttttggaagcatttaatgaaatgcatggtgaagtgcaaaggcatgttgtttcaaacaataagctgagaagtgatctaaaactgcatatcactaaattggcttcaacacaaagtgagcaggataaattgagacaagaaaatgaaaaacttttttcaagctataaagtcactggttgtgtttgtgcatctacttctcttaatatggatgattacaaatctttgcaaattgagtttgaaaaattcaaaaagaatcactatgtagaatgtatgaaggtttaa

SEQ ID NO: 49043 - DNA, 483 bp, Glycine max
  misc_feature (128)..(128): n is a, c, g, or t
  Peptide Sequence Number=SeqID_140728
atgggtttaggcaaagacaacggcggcataactagcctgataaatgccaaaggaaatcgtgggaagtatggtttaggctataagcccactcaggcagatataaagagaagcatcgcgggaaggaagancggtggtcaaagctcgcggttgagacaagaaagtgaaggaagcccgccctgccacataagcagaagctttataagcgcgggtctgggagacgaaggtcaagtggtcgcgatatacgaagatgatgttccaagatctttcttcatctgttcctacgtctctacccattctcatccatttgcatgtttacttctttattttcgaaacggcaaatccgatgacgagtcccccgaaggtactaatacctgggacccgtctatcaacttcgagcaagaaatgaatcaaacggaagatgaaggaaatgaggatgtgggacttcccccagaattagaaagaatggtcgctgtcataccctaa

SEQ ID NO: 49044 - DNA, 546 bp, Glycine max
  Peptide Sequence Number=SeqID_140729
gggcaggatcgccttgggctaccttttggagtgaagacaaaacatgaacggcagaaaccagtcaaggtgcttaaggatgaacgcaaccggggatggggtcacgaccgaccgatcgttacccttctctgtgcgaaacaagcagggaatgtcgctgcaaggcagccccgcctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49045 - DNA, 471 bp, Glycine max
  Peptide Sequence Number=SeqID_140730
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccctcgtcactggtagtggcgatataggccacgtaggagggagagaggagggtgtcgccaatgggaatggcgacacacccagctggtaccgctaccccttatggcgggataggtctcgtggaactcgcccaggtgctggcgaggcagccatgcttcacgtgaagttcagcttttcaggcttgcaggggtaccgagctcgaattcgtaatcatggtcatagctgtttcctgtgtgaaattgttatccgctcacaattccacacaacatacgagccggaagcataa

SEQ ID NO: 49046 - DNA, 732 bp, Glycine max
  Peptide Sequence Number=SeqID_140731
atgcttggaccagatacacagatcatgttctggggagaaacattttacctgagaggaagttctgaggaccgtccaccaaagcagtccagagtcagaggtcatttggtgaagattaatgctgacagtctcaacacattcctagagacacctgtggtattagctgagggagagactctacccgcatacttcagatactacaggttgcctacagacttcagagagatagaggctgccttatgcatacctggccgagggttcatcttgaactctgagggccatcctaggaagattctcaagaaggatttgactacactagctcaggtgtggagtgtcctcttatactccaacttggcccccacatcacatacctctgatctgacagtggacagagctaggctgatctttggcctagtctctcacttggatatgaacataggagcactgatctctggccagatgacctctatagcccattctaacacttctagacttgggttccctgctctgatcaccgcattatgtagggccaaaggggttgtctctgacagccttacctttgagcacctgagcccagtcattaacttggcttacatcaggaataactgttggaatcccgacgatctaacagtttctatccggggggctagaagggcgagggcaaggccagctgagcttccttctacttttgcagctcctactccagcatccacctcagcagccccttctgtccta

SEQ ID NO: 49047 - DNA, 309 bp, Glycine max
  Peptide Sequence Number=SeqID_140732
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccccgaattccatcggacttgattgtctctggatggctaaggagactttaatagtctcgaaaacaacgaaagcggatgaccatgattgtctctgcataccatcgaacttgattgtctcttga

SEQ ID NO: 49048 - DNA, 291 bp, Glycine max
  Peptide Sequence Number=SeqID_140733
atggcttatgtggatatctctgctatggtcaaatctaagatttttccgtacaccttgcggaaggcttgcatttggaaaatggcacgcagcgtgtttgctttgtgcccctattttagggacctacatgggagggagctaaaagggcttttagtgataattcccaaggtggtcatatctctcttgatggtctttagaggtatcatcccctttgaagaacatattgcagcagtagggactactagcaacaatatgctatcaaagagaaaaactctagatgagggttcactgtaa

SEQ ID NO: 49049 - DNA, 567 bp, Glycine max
  Peptide Sequence Number=SeqID_140734
atggtggaagcctctggtaatcgattaccagcctgtgtaatcgattacacagaggaatgggtcactggctgtgtaatcgattaccagagatggaaagccttaaaataccccttttacttgcatgtagtgatcgtgatggcggcgcagctaatccgtgatcgaatagagatggagtgcctagagggagcttgggagaccctcgaaggcaacacgaggtgccgatttcggggcaccattcgattcacggctacttctttggtgcatccaaatgaaactgcacggacgcttcagcgcacggtggagtggatactacccacgcctacaccatatcgtctagtggagcccgtccaagtgattgaggtaacgtcaaccgaggaagaccctgaggaggatctggaggagctacctcctgagcctgctgtggatgcccttgactatctggagggtgatgaggatccacttcttgaggtggattctcccgaggaagtcatgtcggcatctgaggcagactctacggaggatagtggcccgggggagatggcgatcagcggaggctcttcatcatag

SEQ ID NO: 49050 - DNA, 273 bp, Glycine max
  Peptide Sequence Number=SeqID_140735
atgtgccctaacccacatcgcagttatcgtcattttattcatcgttcttcttcatcagcagctaaggcatcacatccatctattaatatcgaaagagcaaaagaaatcaagagaaaaattggggaagcgaaaaagagagaaaatgaaagaaggaatggttcgtggtggccaggtcaaatacttggccttgatcacctttctacttctcatcttacttctcctcgttcaggaactcccgttaagcttcacagaaaggaagtttccaacaagtaa

SEQ ID NO: 49051 - DNA, 588 bp, Glycine max
  Peptide Sequence Number=SeqID_140736
atggagagaagtatgatagatgctgctagtggtggagcccttggagacatgactcctactgaagccagaaatttaattgagaagatggcttccaactcccagcaatttagcgccagaaatgatgctatagtcattagaggagtgcatgaggtagctacaaactcagctgcatcatctgaaactaagaagcttgaaggaaaactggatgcattggttaacttggtaacccagctggccttgaaccagaaatttgtacctgttgcaagggtctgtggtttgtcctcatctactgaccaccttacagacctttgcccttccatgcagcaacctggagcaattgagcagcccgaagcttatgctgcaaatatttacaatagacctcctcaacctcagcaacaaaatcaaccacagcagaacaattatgacctctccagcaacagatacaaccctggatggagaaatcaccctaatctcagatggtctagccctcagcaacagcaacaacagcctgctccttccttccaaaatgctgctggcccaagcaaaccatacattcctccaccaatccaacaacagcaacagccctag

SEQ ID NO: 49052 - DNA, 282 bp, Glycine max
  Peptide Sequence Number=SeqID_140737
atgatgacaaaagtgatgaacaaaaagctcaagagaatcaaagaacatccatctcaagaaaatctagagcaagtcaaagagttcaagaatcaagaagaattcaagactcaagaagaaagcctacaaacaagaatcaagattcaagatcaagattcaagactcaagagattcaagatctcaagaatcaagatcaagattcaagactcaagattcaagaatgaagaaaagactcaatcaagattagtattaaaaagttttttcaaaactttgaatagcacatga

SEQ ID NO: 49053 - DNA, 737 bp, Glycine max
  Peptide Sequence Number=SeqID_140738
atgactaatgcaaattgtccgcaagagtcattgcattcagtctcaaatgggaatctaagattatggaaatctatccactattgctttaagtctgaaggaccctctatgaagtcactttgtgaaagtcacaatgatatatggacccttatgactgcccttgagcttcctataatatatgtgcgagagccaaagggcaggaagatgaagacaatctctggacattgtgttccggtaaaagacatattagtttcgaaagcagctaaaattctcaccaagtttgtctctgctgacaatggtgcttctcttgtcatcaatgcatatctccaccgagcttctgcatctttcaacgagctcaagcagctccacaaggagcttggatcatctcactctcataagaagcacaaaaggcacataacagagaatggtaatgacagtgggatcatctcactagatcttcctaaggttaaaaatcctgccaaaggaaaggttttgatgcaagcaatgtatggagttaaggtggagactttggaagcggttgatgcctctgtgaagatattatatcctactatccaggctggtgtagatatcgttgagatagaatggcttgtgaagactgttgaggaattacgtgcgggtgtcgagaagctttcacaaggaaatgatcttcttgcaaagggagtagatgggctttttgaagccgctatgactagtcgtgatactttgctcagctttgtgag

SEQ ID NO: 49054 - DNA, 279 bp, Glycine max
  Peptide Sequence Number=SeqID_140739
atggcttctacaagtggagatgctactccaccatctccaaaaaccgcaaggctcatggcgcagatgattaaacttggtaatcaaatgagaagaatgagttatgacaatgaagaaaggatagagagaatgagaaagaagaatgaagagagtttgggaagaatacacaggagtagtgaagctttaagtgtgaggattgaaaatataaagcgaagaagagaggaggatggaggaatgagaggtatagggagagaagtgttggatcaagtggccttggaataa

SEQ ID NO: 49055 - DNA, 155 bp, Glycine max
  Peptide Sequence Number=SeqID_140740
atcagttcagggctgaggtcgcattgcacggagattggcccgaggcccaagcagggggggcgcctgcaggagctcccggcgatgcagaggaggcccgcatggatgaggagatgacagacttgctcggcttcttgggaggaagcggagccacgtga

SEQ ID NO: 49056 - DNA, 636 bp, Glycine max
  Peptide Sequence Number=SeqID_140741
atgaccaccctgacccagatatggatgacgttgctgctcagcaacatcctgcccagcgatcataattccgacctccctctgccgaagtgtcagctggtgtacgccatcctgacacggatgagtattcacgtggctcagttgatcgctgatgccatttatctatttgcaggtatggcaccgaccaggcaccctatggacccagataagtccaaccgggccctgggatttcccgcactgatcatagggctctgccagtcgttcggagtccccgtggcacctaccaaggtgattcggccgcccatcacccgggcttttattgagaagtactgcacccagagacaggctcagggtgatgctccacaggccgcaggcgcaccaccaccacctcatcaggctggcccggctgggccatttgacatggagcagtatttacagcatttggttcgccagcaggcggccaaccaccgggcacatcatgcagagccagggcttcgcttctttttcatgccttactccagaccagttcagggcagaggtcgcatggcccggggattggcccgagacccaagcatgataggcacccccagaggctcccgacgatggagaggaggcccacgaggacgaggagatggctga

SEQ ID NO: 49057 - DNA, 772 bp, Glycine max
  Peptide Sequence Number=SeqID_140742
caaggagagcctagtggtggctatcttggcggacttatttgatacgtttgaccgaaggtgcgagaagaatagtgcacgaatcgtctactgcttacccgctctttgtgtgtggttggtttcgcacctattccaacaagacataagacacccgtgtgcacttcaaagttatcgctcgtgcgtcgaaaagagaagagtcgattgggaccaatacttggctgggataggaggcagcacgatcaactggtttcctcgatggaaggaaggaaaggagggagttcttttctcatgtggggactacccaaaagttccgttgatagggacgaggggttgtattaactataatcccgtactttccataagacagctagggtaccccatgaggggagcaccaacggaagagagcctctcgcctttccttgtgagagatttcggcgcgcaaagtctcaaggttgtacaaagagtccacaaggcatggaaaagtccgttgaggaaagataaagaacttaggggcatccgtaatggcatcatcagtggttatcatgaatggctaagagttcgtacgcgagggttagattggctctccaagttgaaagttatcaacgaggagaacttcgaagctctggaagaggatgaagaagtccaagctctaaaattagagctagggaaggcaaggctcgccaaagaaaaattcaagtcagccgctacaagcatccgaaaagagtgtaccaagttacgagaggaaaacgcgagcaacccctgcaccaaaatataa

SEQ ID NO: 49058 - DNA, 234 bp, Glycine max
  Peptide Sequence Number=SeqID_140743
atggctaccattgcgttatcaagtagatatgggagcaagttagcatatgacaccggaatttggggtgaatcctacaggcttttcgctgcaaaattcatttcttggttggtgttttttttgacaggctttgtggttgatttagggatggcctttgtggataactgggtggtgggtaaggaggagatccacttcgatcctttcactggcgaagaccaaatccgcaaagctttgagg

SEQ ID NO: 49059 - DNA, 1365 bp, Glycine max
  misc_feature (1286)..(1286): n is a, c, g, or t
  Peptide Sequence Number=SeqID_140744
atggccaatcaaggagactgggtcccgtttatggatgtgttagctttgctaatttttggggtcgtcctctttccaaacgtggatggtttgatagacctagcagcaatcgacgctttccttgcctaccaccatagtaaggaaagtccggtggtagctgtcttggcagatctatttgacacatttgaccgaaggtgcgagaagagtagcgcacggatcatctgttgcttacccgccctctgtgtttggttggtttcacacttgttccaacaagacacaagacatccatgtccgctcctaagccatcgctcgtgtgctgaaaaggggagaatggattgggaccagctcttggccgagatgggaggtagaacaatcagttggttcccccgatggaaggaaggaaaagaaggagtccttttctcatgtggaagatacccaaacattccgctggtaggaacgaggggttgtattaactacaatcccacgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagcttagaggcgttcgtaatggcatcattggtgggtaccacgaatggctgaaagttcgcatacgagaggacgaagaagtccaagctctcaaaagcgagttaggaaaggcaaaactcgccaaggagaagttcaagttggctgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaataatgaactcaagttgcgaagggaagaaagagaccagtcgcgagcccatagcatggttctgaaagaggagttgattgcttgttcaaggtccaaaagaagcttgtctcagtgtttatgcgagacagagaccaacatgttagctatcatcgccaagtaccaagaagagttaggtctagccacggcccacgagcatagaatcgcggatgagtatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgnccccgaagagattcatgggcttctcggctattgtcagcatatgatagacttaatggcccacataattagaaatcgttag

SEQ ID NO: 49060 - DNA, 517 bp, Glycine max
  misc_feature (14)..(14): n is a, c, g, or t
  Peptide Sequence Number=SeqID_140745
caacgcggcctttntacggttcgtggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccagcatgtagatcgatggacggcaatgctgcttgtggagtcaccggccggaaaggttgctggagaattccccagagttgcgccgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 49061 - DNA, 420 bp, Glycine max
  Peptide Sequence Number=SeqID_140746
atggataatgaagagggagtgcaagaacaaatgaaggtcgacatgtcggccttaaaagatcagatggcttctatcacggaagccatgctaaaaattcaaaaatcaatagaagacaatgctacggcggccgcttccaacacagctagggaagcggaaccggtgctacagcccgcaataaacttgggccgagacataaacgcgatgggtttcaatcggagttatagtcctcaagcctacccttatggtttacctccagacttcactccccgtaccgctccagacgatttaagccaagcccctaccttcgaggggcaactccctcctcatgccgactatcctctgcaggaagatgatgaaagagatgcccatctaggcccactacttcccctcaaggaatcagccccccatgagttgccctaa

SEQ ID NO: 49062 - DNA, 132 bp, Glycine max
  Peptide Sequence Number=SeqID_140747
atgcactggatgtctaccatcattttaggaacttttaggaataactgggaagcgtattttaatgatcctagaccattggagccagagagattaaaagcgaatccagtgggcacaatattatctccgagttag

SEQ ID NO: 49063 - DNA, 873 bp, Glycine max
  Peptide Sequence Number=SeqID_140748
atgaacattattgaagctgctgtagctaccccggacgctcgcgtcgccatcaccattgcgcgtttcaacaacttcatcaacgacagcctgctggaaggtgcggttgacgccctgaaacgcatcggccaggttaaagatgacaacattaccgttgtgtgggttccaggtgcttacgaactgccactggcagcgggcgcgctggctaaaaccggtaaatacgacgcggtgattgcgctgggtaccgttattcgtggcggcactgcgcacttcgaatacgttgcgggcggtgcaagcaacggtctggcacacgttgcacaggatgctgaaattcctgtcgcgttcggcgtgctgaccaccgaaagtattgaacaagccatcgaacgtgctggcaccaaagccggtaacaaaggtgcagaagctgcactgaccgcgcttgaaatgatcaatgggaattccgtgaaacctgctgctcgtcgccgcgcccgtgaatgtgccgtccaggcactttactcctggcagttgtcccagaacgacatcgctgatgttgaataccagttcctgtcagaacaggacgtgaaagacgttgacgtcgcctattttcgcgagttgctgtccggcgcggcagtgaatgcaggtatgctggacgaactgatggcgccttacctgtcgcgtcagctcgaagagctgggccaggtggagcgcgcggtgctgcgcgtcgcgctgtttgaactgaaaatgcgcgaggatgtcccttacaaggtggcgatcaaggaagcgatcgaactggcgaaaaccttcggcgcggaagacagccacaagtttgtgaacggggtgctggataaagtggcgccaacccttcgcaagaaaaagtaa

SEQ ID NO: 49064 - DNA, 990 bp, Glycine max
  Peptide Sequence Number=SeqID_140749
atggttttgagcctaccccttaaccctccgacatcgcagccgccctccatcttaaaacctctatcatccaagcaaaccttacctctaaaggaggcctccaagaaccccgtacccactctactcgccgatacctaccattctatccatgaccgtacccaggctggccgtggaaccatttcttgttgtgcacccttactctatcagtggtttaccttccacttacctcaatcccgtgccttcaagaccaatgatgataagctttcttggcctcgccgaatcatgactcttgacccatctgacattgtttggtaccaagcagctagtgatgttggagagattattgtgagttgtggtgaatatcccaacgtacctcttttgggtatgcgtggcggaattagctacaacccgcttctcgctcgacgacaatttgggtacccgataaagacaaaaccaaacaaccttgccttgactaatgaattctatcttaaccatggagatcactcgaacaaaagggaaagattcgcgcaagcttggagcgctatccgcagactcaacagaagtcagttgggaaagaaatcagactatgtgcacgaatcttatacccagtgggttattgataggaccaagagctttggcctaccctaccgcttacccagatacctatcgtccaccatcccaccatcatccttgcctatcccctttgatactaaggaagagtttcatgaacaattaaccaaagaaaggcaagaaaaagaaacttggaagaggagataccaggggctcgagcaagagaatgagattttgaaggggaagatagcccaacagagccgtgagctttttatccagaaccagaggatgattgagaaggacgacttgcttcgtcggaaagacgctttgctccaccgagatgctagaaggaagaggaggtttatggatttgttctcccgtgcacattcagattccgaggatccatctactccgggagtttga

SEQ ID NO: 49065 - DNA, 261 bp, Glycine max
  Peptide Sequence Number=SeqID_140750
atgaattgcgttttcgttcatgcgtcctctaaccacgagtttggagtcatgcgtagtgattgcttagggcaattctccattctcaaccttttttcggagcccatgaattgcgttttcgttcatgcgtcctccacccacgagtttggagccatgggtagtgattgcttagtgcaattctccattctcaaccttttttcggagccccatgaattgcgttttcgttcatgtgtcctccaccttcgagtttggagccatgcgtag

SEQ ID NO: 49066 - DNA, 141 bp, Glycine max
  Peptide Sequence Number=SeqID_140751
ttcagggcagaggtcgcgtggcctggagattggcctgaggcccgggcaggagaggcaccagcagaggctcccaacgaggcagatgaggcccgcgaggacgaggagatgaccgatttcttaggaggaagcggggccacatga

SEQ ID NO: 49067 - DNA, 453 bp, Glycine max
  Peptide Sequence Number=SeqID_140752
atgtggctgaaagaggtaaagacccttgtggttctgtctagaaatcgagatgaacacgctaagtgcgcctcactaagcctgacctatacggctaagcaccactttgcttctatggcatctaagaaaaggaaagcaccttctacacctacccaggccaaatttgatagatctagtagcatagacattgctattgtaaaggagttttacaccaacctctatgaccccgaggataaatcacctaagcaagtgagggttcgcactcctatagtgatgggcagctgtcgcaacatgcccttttgcgggcgagcgaaggcgaggctcacggatgcgctttccaaaggaggaaaggtgcgcagagtcgccaccaacgtttatttgtggaaaacgtcggaaaaaccgaaggaaatcggtcaaaatgaaaattctaagttcgggagttgtatttacgtttga

SEQ ID NO: 49068 - DNA, 864 bp, Glycine max
  Peptide Sequence Number=SeqID_140753
atgaaagactcgggaatacgtatgtctctaaaaacagtccagtggagtcgccaactgccgcaacctacccttcggcgggagggtgacgcgagggctcatgggtgtgtcttccataggaggaaaatgcgtggagtcgccaccaacgctaataagaggaaatcgtcggaaaaatcggaaaggtgtggtctacgaactttaagtgtgaaaggttcgggagttgtttttacgcacggggaagaacgaagaacggatgaagaacgtcggaaaaccttcacggatttgctcacggaagcgttaccgaagcacctcgacttggattttcttcacagaaacaatttttttcacccaaaacagctgaaatggatagccaagggggttagggatatttggaatagcctcccttcgcctatttataggaaagggggggaggaggttgccgcccaactcgcccaggcgagctgggttgcttcctccataagcaaccctgcttcaaaaatattctggaagggcctagattcgaaaattgaaaattgctatttgcacccctatattgataaaactttaccgattgcgcgacaatgctccctttcgactttcggcatgtcacggaacttcacagattacctaacaatgggtgttaagtacctcgaagcggtcaagcaaaggttgcaggctatcaaacaatggtccccggacgaaattaggggaaatccggtttgccagaaagcgcatcgaattgtcaagtatttaaaattaaaacggatgaatctgagtattgaactcagggaactagtcctagacatggttaaattcagaaataaggcattgttgaaagaaacgttgataattgatgatttagaatag

SEQ ID NO: 49069 - DNA, 318 bp, Glycine max
  Peptide Sequence Number=SeqID_140754
atggtggaggaagaagaagggatggcaaccacttgccacttgtcccattttgagtggaacaaaaagggcccacctttttctcttgatgtgacttatgcacagccacaagaagaagggaaaaatctgacctttgaaacgctaaaatcttgcctcagcttgcgtgccgtttctctagttccagtccctcgcgtttctctgcacccgtcggggccagtttctgaaagtaggcaatatgtatatcaaaacactcagaatgaaaccttgagtgtggttcagaggttggttttgttcaattttaagttgcacgcaaaacgatga

SEQ ID NO: 49070 - DNA, 65 bp, Glycine max
  Peptide Sequence Number=SeqID_140755
atgccagtttcggccgaaacaaacgtcgttgagcttcgcacaaaaaaacctagctcgacctacat

SEQ ID NO: 49071 - DNA, 237 bp, Glycine max
  Peptide Sequence Number=SeqID_140756
atgggccgccgcctcggaacaaagggtggaataaccataaggtattcggtcacatgtgcatcgaatgccaaaggtcccgaatcagtgcttgacactaatttcgggctccgcctctcggatgacaaaagggtgcgaataaccatatggtatctccgcgtatcatgggtgcagaatgaccaaacttggtctctgcttgtcagggccccgcatgctatcaagcgttctgtcttacgatga

SEQ ID NO: 49072 - DNA, 586 bp, Glycine max
  Peptide Sequence Number=SeqID_140757
gaagcacttggaagagaaagtgaaggctttggcagatcaaggtgaatgggcttcattcattgatgtcttagcgctattggtgttcgaagttgtcctctttccaaatgtggatgggctagtggatgtagcggtgattgatgccttccttgcttatcaccatagcaaggaaagtccggtcgtcgctgttttgacccatgcctatggcacatttgaccgaagatgcaagaagagcggtgcaaggattgtctattacacacccgctctttatgtatggttggtctctcacctctttcttcatgaaagtagatccatctgtcccctacaaggtcactacatgtacgtcgagaatgggaaagcaaattgggagcagctcttggctggcatggtaggggcattcattaattggttcctccgatggaaggaaggaggaaccggagttttgttctcatgtgaagcgttcacaaacgtccccttgatgggaacaaggggttgtatcaattataatcctgtacttgccataagacaacttggctaccccatgagagaagcaccatcggagaagagtatcacacctttcattgcataa

SEQ ID NO: 49073 - DNA, 919 bp, Glycine max
  Peptide Sequence Number=SeqID_140758
atgcaggggaacaacaagaacctcatactaattttgcagaaatgggcgctgttccgggcagcacctgctgttgacgccgtaacagattcagatgccccacagcacgcacagacggcaaagaaaaagccacaagctccggaagatatacctaaaccgaagaagcgtagcgccctgtataagtggttcaacggcaatcacgaagagatgcaataccaggccgcagttgcagccgctgccagcgcgaccagagcacagaccgctaccgctggggttaacgttcttgaacagattggcgggcgctttgctacctatggcacatgggcggtacgcggggctgaaatcgcaacggctggtgcaggcgcatccgttgccgggtttttaatcggcatgatgcccggacgactgaacgacggtgaacaggatttcatcgatcgtatacggcttgcacagatgagtgaagcgcctactcgtgtgcgctatacatgggagaatgacagcaacggaaatcccgttccgcatggctggcacaccccaccgggtaaagatatggtgagagtccgtaaaatgcagtgggacagcacccgacaggcttacaccttcaccaccgaggaggaaagcccggtaaccatcatctggaccccggatcattcaggtgtacacactccgtcaaacacgggcaatcagactccgccgaggctaccgggaacgatccttgttaacccgttgccggatggaattcagagcaccagcacaacaaccacggcaccggatgagaaaaatttcgcggattatattctgattctgcccgtatcagacatcccgccgatttatatctatattcgcaacaatccgggacaggttacaggcaagggccagaaggttactggcacctggttagctgatgcgggacatggtaacg

SEQ ID NO: 49074 - DNA, 610 bp, Glycine max
  Peptide Sequence Number=SeqID_140759
atgaagtttatcattaaattgttcccggaaatcaccatcaaaagccaatctgtgcggttgcgctttattaaaatcttaaccgggaacattcgtaacgttctcaaaaactatgatgagacgctcgccgtcgttcgtcattgggatcatatcgaagttcgcgcgaaagacgaaaaccagcggccggttattcgcgatgcgctgacccgtatccctggcattcatcatattctggaagtggaggacgtacctttcacttctctgcataacatttttgaacagacgctaccgctgtggcgcgaacagctcgaaggcaaaagcttctgcaagcgtgtgaagcgccggggtaaacatgaattcacctcaattgaggttgagcgctacgttggcggcggcctgaaccagcatatcgaatcggcgcgcgtgaagctcaccgatccggacgtgacggttaacctggaaatcgaaaacgatcgtctgttgctggtgaaagggcgctatgaaggtattggcggcttccccattggtactcaggaagatgtgctgtcgcttatttccggcggcttcgactccggcgtctccagctatatgctgatgcgtttacggctgccgc

SEQ ID NO: 49075 - DNA, 390 bp, Glycine max
  Peptide Sequence Number=SeqID_140760
atgtcctcagcggcgaaggccgagctgcgtaatcgcgagctgggctttatctaccagttccaccacctgctgccggatttcacggcgctggaaaacgtggcgatgccgttgctgattggcaaaaagaaaccggcagaaattaacgcccgcgccagcgacatgctgaacgcagtagggctgggtcaccgtggcaatcaccgtccgtcggagctttccggcggcgaacgtcagcgcgtggccattgcccgtgcgttggtcaacaacccgcgtctgggcaccgcgtttctggtggtcacccacgatctgcagctggcaaaacgcatggggcgccagcttgaaatgcgcgacggtcatctgaatgcagaactgaccctgatgggagcggagtaa

SEQ ID NO: 49076 - DNA, 459 bp, Glycine max
  Peptide Sequence Number=SeqID_140761
atggcgcaggacggccaggcgccgcgcagcttcaccaaactgaccgccagcggcgtgccgtggatgacggtgctggtgatgtcggtcgccctgctgctggcggtggtgctcaactacctgatcccggagaaggtcttcatgatcatcgcctcgatcgccaccttcgccaccgtctgggtgtggctgatgatcctgctgtcgcagatcgtcatgcgccgcacgctgtcgccggaagaaactcgtcagttgagcttcccggtgccgtggtggccggtggcgccggcattggcgaccgcctttatggcattcgtcatcggcctgctcggctacttcgaagagagccgcatcgcgctgtacgtcgggctggtgtggatcgctttactcaccgtggcttactggctgtgggtgcgcaagaaaggcgggggttcgccggtgaccgcggcaacgcagcagatgtaa

SEQ ID NO: 49077 - DNA, 195 bp, Glycine max
  Peptide Sequence Number=SeqID_140762
atggtcttcttgaccagacatgaagagtctataaaagcaagaggatacatctacttgggtttgactgagaacaagagagggtacatctcttatggatcagttctagtggagggtacatccactaggttcaaagagaacaagggagggtacatcccttgtggatctttgcttgtaaaaggatttttacaaggttga

SEQ ID NO: 49078 - DNA, 315 bp, Glycine max
  Peptide Sequence Number=SeqID_140763
atgaatccccaactaaatgtgccctcccaactaaatgctgacccaactactgatatccatgttgctcagtctgaaagcaatgaaatgtcacatgactattgttccatcggctccacttgttattgtgaatacaaaatcttatcagcaagtgtaccgagtcgtgcaactccattggagcttgtaggcctaggatcttcttcatcaatggattcctttgcttcttggaagatgaatggcagcagaatggagaaggaagagagagaggagatgccacttcaaggagaagatgagtctagaagaagctcaccaccatag

SEQ ID NO: 49079 - DNA, 567 bp, Glycine max
  misc_feature (376)..(376): n is a, c, g, or t
  Peptide Sequence Number=SeqID_140764
atgactaccctgactcagacatggatgacgttgctgcttagcaacatcctacccagcgatcataattctgacctccctctaccgaagtgtatggcgcctaccaggcaccctctggacccggataagtccaacagggccctgggatttccagctttgatcacagggctctgccagtcgtttggagtccccgtcgcacctagtaaggtgattcgcccacccatcacccgggcttttattgagaagtattgcacacagagacaggcccagggtgatgcaccacaggccgcaggtgcgccaccaccacctcatcaggctgacccagctgggtcatttgacacagagcggtatttgtggcactcgatgcgccagcacgcgnccaaccacaggggactggggcaggtccatgagtgtctctaccatctaagcctcaacatgcagagccaaggcttcgctccttttccgtgccctactccagaccagttcagggagaggagatgtcagatttgctcggcttcttgggagggattccggaaccgtgtagagtttcatttaggaacctcgtcctaa

SEQ ID NO: 49080 - DNA, 321 bp, Glycine max
  Peptide Sequence Number=SeqID_140765
atgccaatctccacctgcagatgtatcggttggaatcgcacctacaagatgcccagtggacccgaagaagtccaacagggccttgggatttgcagctctggaatcgtgcccacaagacgcctagtggacccgaagaagtccaacagggccctagggtttccagctctggttacgggcctctgtagtcctacagggtgcccgttccccccggcaaggccacatcatcatggcatagggatcgcgcctgcaagatacccagtggacccgaagaagtccaatagggtcttggagttgtcaagctctaattacgggtctctgtga

SEQ ID NO: 49081 - DNA, 684 bp, Glycine max
  Peptide Sequence Number=SeqID_140766
atggagagaagtatgatagatgctgccagaggtggagcccttggagacatgacccttgctgaagccagaaatttaattgggaagatagcttcaaactcccagcaatttagtgccagaagtgatgctattgtcattagaggagtgcatgaagtagccacaaattcatcttcatcagccgagactaagaagcttgaaggtaaactagatgccttggttaacctggtaacccaactggccatgaatcaaaaatttgcacttgtcgccagactttgtgatttatgctcctctgccgaccaccacacagacctttgcccttctatgcaacaatctgaagcaattgaacagcctgaagcttatgttgcaaacatctacaatagacctcctcaacctcagcagcaaaatcaaccacaacagaacaattatgacctctccagcaacaggtacaatctcgggaggaggaagtatcccaaccttagatggtcgagtcgttcacaacaccagcaacaacaacagccttattttcagaatgctgttggcccaagcagaccatacgttcctccaccaatccagcagcaacaacaacaacaacaaaaacaacagccccagaaacaacaaacagttgaggcccctccgcaaccttcccttgaagaacttgtgagacagatgactatgcaaaacatgtag

SEQ ID NO: 49082 - DNA, 270 bp, Glycine max
  Peptide Sequence Number=SeqID_140767
atgtttatacggataaccactcgggtatttccgccccgtcaacgtgactcaaatgtcagtatgacagatcttgtgagcgcgaaagatgacgtaaatctccgcgtgtcaaccttggtggccgacaaaagacgaggtgcggataaccgtaaggtatcttcgcgggctaccagctcttgggtcatggtaacaaaaagcggtgcggtcgataaaagcgaagctcttgctcctacgtatcctcaaatgaggaactcagactcaaacatgctttag

SEQ ID NO: 49083 - DNA, 432 bp, Glycine max
  Peptide Sequence Number=SeqID_140768
atggcccagagattggctgaggaccagacagaggtggcacctgtagcagctcccgacggtctagaggacgcccacatggatgaggagatgacagatttactcaatttcttgggaggaagcggagccacttatttcgtcaccatttttgtgacttaccattttcgtgcgtttttcgttcaccttgtggttagacgcaaaattgattgcaataacataaatgagataaaggaagagagaatgcaaacacaattttatactggttcagccacttcccgtgcctacatccagtactcaagcaacccacttgagatttccactatcttagtaaaatccattacaaagtctgaaccacacagggacaacccatcccttgtgttcaggaatcctttacaacaagagactcacagtctcttaaccaatctcattgaataa

SEQ ID NO: 49084 - DNA, 384 bp, Glycine max
  Peptide Sequence Number=SeqID_140769
atggatagtggctactctaggcacatgacaggtgacaagtctagacttactgactttgtgttaaaggaaggaggatacgccacttttggagacaacgataagaaaagaattatgggagaaggaaacattggaaatcagcacaagactcataaaaaatgttttgtgatgacaaaaagctcaaagatcaatcaaagaacaactcaagtgaatcaaagatcaatcaagaacaattcaagagttcaagataagaatcaagaagaattcaagactcaagaagaaagtctagagacaaggatcaagattcaaggttcaaagatctcaagaatcaagatcaagattcaagactcaagattcaagaatgaagagaagactcaatcaagataa

SEQ ID NO: 49085 - DNA, 300 bp, Glycine max
  Peptide Sequence Number=SeqID_140770
atgccacatcctatagagggttgtgtcccgacgtcctttagcacatggttccttaaagcaattcacctagtcatctgctccctcgaacacaaagttcaagatcatctcaggatccaaacacaaacaacacatggggagtcactctcactaagtaagatcatagggagaccagtcagggtcacgatgttttgcgagaatgctccaaccatatgggatcagcacaggcttaaaggagcactcaaacccgatgacccccaaggcctacactccgaagagtccgtcagggcttctccctcctga

SEQ ID NO: 49086 - DNA, 575 bp, Glycine max
  Peptide Sequence Number=SeqID_140771
tggtcatgttggtgcgcatgatccacactcgtctctttgcagcggcacgggtgaaatcttacctcggtatgcatagtagcagtgtaatagcctccctctctggttgtgctcgcacagttggccctcctccaatatcagggggtggcccaagaatcgtgtggatgtggagcacactgaaaatgaggacacgtagccctctaaaggtgagggcgtgcagccctttcaaggcgaggatgtgtagtcctttggaggtgagggcgtgcagccctctgatggcgaggacgtgtaatcctctcaaggtgagggcgtgcaaccctctgatggtgaggacgtgtagtcctctcaacggtgagggtaacttagtacctaaggtgagggcgtgtagccctctcaaggcgaggacatgtagtcctctagaggtgagggcgtgcaaccctctgatggtgaggacgtgtagtcctctcaaggcgaggacgtgtagtcctctgacggtgagggtgaaggcgtgcagccctctgatggtgaggacgtgtagtcctctcaaggcgaggacgtatagtcctctggagacgagg

SEQ ID NO: 49087 - DNA, 258 bp, Glycine max
  Peptide Sequence Number=SeqID_140772
atgactttgtctctagagtatctcccatgtgatataaggataaaatttgcacaatttcaggtcaaaggcaaaaatcttgagcgcgcatccaacgctaagcgcagcttcagcgcgcttagcgcgacagaagaatctggcagagcatcaatttcaaggccgtgcgctaagcgtgagatccgctcactaagcgcaatggttgtctttagccaggctcagcgcatgactgacgctaagctaaaatccactaactcatgctaa

SEQ ID NO: 49088 - DNA, 112 bp, Glycine max
  Peptide Sequence Number=SeqID_140773
tgggctttgggccttcgtaggcgcgctcagcgcgacaccccctcgctcagcgcgtgtagatcgcgcgcttagtgcgcatgttgcaggcttagcgcgcgtgttgcaggcttag

SEQ ID NO: 49089 - DNA, 342 bp, Glycine max
  Peptide Sequence Number=SeqID_140774
atgtcacgatggcatgaccttgctgggggggacgggcaccctgtaggactgacagaggcccgtaaccagagctggaaaccccagggccctgttggactcctccgggtccactgggacggaatgttgctaagtagcaacgtcatccatatctgtgtaagagtggtcatgctggtgcgcatgatccgcactcgtctctttgcagcggcacaggtgaaatcttgccccgatatgcatagtagctgcgtgatagactccctctccggttgtgctcgcacagtcggtcgccctccaatatcagggggtggcccaggaactgataaaaggaaactactggccccttaa

SEQ ID NO: 49090 - DNA, 497 bp, Glycine max
  misc_feature (121)..(121): n is a, c, g, or t
  Peptide Sequence Number=SeqID_140775
ggtcggaacaggagagcgcacgagggagcttccagggggaaacgcctggtatctttatagtcctgtcgggtttcgccacctctgacttgagcgtcgatttttgtgatgctcgtcagggggncggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccatctggtgataagacaataaggatatgggctatatctgatggctcctgtttgaagacatttgaaggacacacttcaagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 49091 - DNA, 195 bp, Glycine max
  Peptide Sequence Number=SeqID_140776
atggcgaccaaaatgaagcgatgtccatttgaagctttgggctcaatagctccaatcacgtctattcctcacatagagaacgaccaaggtgctgccaagacgttcaaaggatcttctaggccatggcatgtctattggcatgtgttccaaaggatccctcatgcacttccactagcatttactcagcctccctga

SEQ ID NO: 49092 - DNA, 219 bp, Glycine max
  Peptide Sequence Number=SeqID_140777
taccctggtcttcagaggactacacgtcctcgccaacagagggctgcacgccctcaccttaagagagtactgtgtaacgtcctcactttcagaggactgcacgccctcaccttcaagagggctacacgtcctcgccaatcagaggactgcgtgtcctcaccttcagagggctgcacgccctcaccatccagaggactgacacatgtcctcatgccttga

SEQ ID NO: 49093 - DNA, 684 bp, Glycine max
  Peptide Sequence Number=SeqID_140778
atgtcgtatattgacttcacgaagatgattaactctcccagggacccccgaaaagcactttgtagagggttgaagccacttaattgtgactctgatattttgcaattggttgaagatgtttctggctttgatgtagttgaagtgtatgtggacgagggggtgtttgaaaaatctggaaaaaaaaagttgaatgattttaagggatatgaggttgttataattgatggagtggaggctgaagcagttgtggagggtgaagatgaggccgaggttcaggttgatgaacaaggtttggtggaggttcaggtgcagggtgaagatgaggctggtgttgtggtgtggtggatgatgatgtcgggacttaggaaaatgatgacaatggcagtgattatagtgaagtttcagataatgactttgaagaaagttcggattggacagaatggttggactctgagacatttagatactccagttggaagtgaagatgaaggtccttcaaaagtcaaattccctcattttaaggtgcctggaaatgatgaagatgtcatgtttgaggggttggttgaggtaatcaaggagcttggcgataacgtagaacatagattgtgtgtcaaacatttgtatgctcgagaaacaactacctctggttgggacaaggccatgaatcagattggagagttatga

SEQ ID NO: 49094 - DNA, 222 bp, Glycine max
  Peptide Sequence Number=SeqID_140779
atggatggcatggcaaagagggaactgaaggaaacacagttacctcctagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 49095 - DNA, 906 bp, Glycine max
  Peptide Sequence Number=SeqID_140780
atgacggtgaaaacctctgacacatgcagctcctggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggctccgccccctgacgagcatcacaaaatcgacgctcaagtcagaggtggcgaaacccgacaggactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccacagattacgcgcagaacaaaaggatctcaagaagatcctttgatcttttctacggggtctgacgctcagtggaacgaaaactcacgttaa

SEQ ID NO: 49096 - DNA, 632 bp, Glycine max
  misc_feature (627)..(627): n is a, c, g, or t
  Peptide Sequence Number=SeqID_140781
atggccgcaatgatggaggccatgatgagcgtgaagaagagaatggaagccaatgcggttgcaattgccgctaccagcgttgttgctaaggtgaacctgatgtccccatccggcatcaaccaaatgaatcatccaacctcagatatggtaggcaaagatttgggaagtacgggcgggccccatgatgtgcaaattcaaaacgagcatgccttcccgccatatggcttgcctctcaactatacgccacccaatgtggcgtacactcccaataagaatacacatgaaattccccatcacaatctagccgacttcgagcctgggctcggatatgccaatgaagggcaagcagttggtggtataccccttgaaaacacttcagaaggccctcagtatcatccccaactacacctcttgcattcaacaacaagtgaaaaccctcatgctatggcagaaatgggaaagttggatcatctagtggaaaggctcagggtcattgaaggaggtgaagattatgcctttgctaacctagaagagttgttcctagtacccaatatcatcaaccctcccaagttcaaggtgctcgactttgacaagtacaaggggactacttgccccgagaaccatctnaagat

SEQ ID NO: 49097 - DNA, 1053 bp, Glycine max
  Peptide Sequence Number=SeqID_140782
atggcagtaaatcagagccagttaggccagatgttcgagcaggttttacggctgtcgaaagtcgacgccagccagagcgtcgccattctgaaaagtcactattccgatgcacgcaccgtgcaggccgccactgatgctgcactacgattgggcgcgaaggtgtattgcgttgagctgccggccttcaatcacccgacggcgatgggtaacgacatgaccgcctactgcggtgataccgcgcttaccggcaacattgccgcacagcgcgcgctggaagcggcggacctgatcgtcgataccatgatgctgctgcattcgccggagcaggagcaaatcctgaaaaccgggacgcgaattttgctggcggttgagccgccggaagtattggcacgaatgttgcccactgaagaggacaagtcgcgcgtgctggccgcggcggcagtgctggaaaaagcgcgcatgatgacggtgaagtcgccggtcggcagtgattttcgcgccccgctcggccagtaccccacggtaacggaatatggctacgcggatgagccgggccgctgggatcactggccgagcggcttcctgttcacctggccgaatgaagatcaggctgaaggcgtgctggtgctggacgtcggcgacatcctgctgccgtttaaatcttacgcgcgtgaacgtattacgctggagatcgagcagggctttgtcacccacatccacggcggctttgaggctgagtatctgcgcgattacatgcgctacttcaacgacccggaagtgtacggtatttcccacatcggctgggggctgcagccgcgcgcgcagtggacagcgatgggattacacgacaaaaacgacggcatgtgtatggacgcgcgcgccttttacggcaacttcctgttttcgaccggaccgaacaccgaagtgggcggtaagcgcaaaacgccgtgccatatggacattgctctgcgccgctgcgacatcaaagtggacgatttgctggtggtggcggaaggtgaagtggtggcaccggaggcctcacgcgcgcgttaa

SEQ ID NO: 49098 - DNA, 465 bp, Glycine max
  Peptide Sequence Number=SeqID_140783
atgggatcaagtcaaaagccttcgcttaaaaagaggttctatcaagtcaaaatcaagagcttagaggtcaccagtttacgaaagttggggcaattaatgggtcaacttcaacggcaagccttcgcaaagcctatgggttctacccctcattggccagaatttctaaaaagtccaaatctcggcgcaggaattagaccgccaaaggcaagtcgaaaatggggtggtcggaataccgagaaaatatttggagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaaggttctatcttcatgcgaaggatgtccaaatgttcccttga

SEQ ID NO: 49099 - DNA, 312 bp, Glycine max
  Peptide Sequence Number=SeqID_140784
atgtacaaagataagtggacccaaccttggcccatgggctcaaaaatctaccctaaggttcatgagaaccctcgggccttcttcaacagctctagcccaatcctcttagagcctattgctcatggatttggactcaaagtcctcgcttttatctttcacaagacacaaagtcctcgcctttatctttcatgggactccaagtcctcacttctatcttttaggactcaaagtcctcgcttttatctttcacaagacacaaagtcctcgcctttatctttcatgggactccaagtcctcacttctatcttttag

SEQ ID NO: 49100 - DNA, 245 bp, Glycine max
  Peptide Sequence Number=SeqID_140785
atgattcgattgcctagcgctgttcgtctatcctccaccctcaaatcttatcgggagccccatgaattgcttgtcattcatgcatcctccaccatcgagtctggagccccacgaattgattgcctagcgctcgctgttcgtctatcctccaccctcgaatcttatccggagccccatgaattgcttctcattcatgcatcctccaacatcgagtctggagccccacgaattgattgcctagcgct

SEQ ID NO: 49101 - DNA, 658 bp, Glycine max
  Peptide Sequence Number=SeqID_140786
atgcagcagcaacaacaacaacaaagacaacaagcaactgaggctcatcctcaaccttccttagaagagttagtgaggcaaatgaccatccagaatatgcaatttcagcaagagacaagagcctccattcagagtctgataaatcagatggggcagatgactactcagttgaaccaagctcagtcccaaaattctgacaaattgccttcacaaactatgcagaatccgaaaaatgtgagtgccatcaccttgaggtctggcaaccaaattcaagtgcctccaccagtagtagcacctgcacctgaacctgtcaagcttcattctacacttgaaaaagaggatgagatagttgcacaaaagagaaagcttcctaacaaaaattttcatgcaggtggaccttcttctagtaattctgacttacaacaacctcctatccctcttctattcccacctagagcaattccaaacaaaaaaaatggaaaaagcagaaaaggagatcttggagaccttcaggaaagtagagatgaacttacctctgctaggtgccatcaagcagattccaagatatgccaagtttctaaaggaactgtgcacccacaaaaggaagctcaaggcaatgaacggattagcatgggcagaaatgtgtcagcattgatag

SEQ ID NO: 49102 - DNA, 345 bp, Glycine max
  Peptide Sequence Number=SeqID_140787
atggaagagaaagtccaaacacagtttttatactggttcggcaaagttcgttgcctacgtccaatccccaagaaacccgcttgggagttccattatctcaaaaatcctttacaccttctaaaacgcataaggacaagccttcctttgtgctcagatgctttacaacaagagactcacagtctcttagccctttttcagaaggaaaaatctgtagaaaattcgtgcccaagtcacttatttatagtccttagatggccatttaaaaatcaagtgaaaagatatgactgttggcagattttctcaaaacttgccactggtaatcgattaaaatcctggggtaattga

SEQ ID NO: 49103 - DNA, 597 bp, Glycine max
  Peptide Sequence Number=SeqID_140788
atgcgcactagcttcaccaccatcacacagatctggatgacattgttgcttagcaacattctccccaacgaccataactcggacctccccctgcagaagtgtcagttggtttatgccatcctgactcaggtgagtgtccatgtcgcccaattgatctctgatcctatttaccagtttgcagggattacgcctttgagacacccaatggacctagagaagtccaatagggccctggggtttcctgctctgattacaggcctctgtcagttctatggagtggtggtcacccccatcaagctcatccggcctcccatcagtagggcaggtgcagggtcaggcatcgtagcagccagaggaggaccagcaacagctagcaacagatgcaccaccgtcgcttctagaggaggtaccctctctaaggtccatctccgaccacctgcggaggatagaactttagatgcacagctgaacgagacattctataggtacaacatgcaccagcagagtcaggaccccagtcctttcccttggccaacccccgagcaatttggggccacagtggcctggctaggggatgagaccgattttgagatgtga

SEQ ID NO: 49104 - DNA, 363 bp, Glycine max
  Peptide Sequence Number=SeqID_140789
atggccaagtttgacccagacatagtcctcgaattttatgccaatgcttggcctacagaggagggcgtgcgagatatgcgatcctgggtgaggggtcagtggattccgttcgatgcggatgctctcagccagttccggggataccctttagtgttggaggagggccaagaatgcgagtatagccagaggaggaaccggtccgatggatttgatgaggaggtcatcgcccagttgctatgtgtaccggggcaggattttgcccggactgctgctgggagacgggtgcggatcatgcgcaccaacatgaccaccctgactcaggtctggatgactttgctgctcagcaacatccagcaccagtga

SEQ ID NO: 49105 - DNA, 572 bp, Glycine max
  Peptide Sequence Number=SeqID_140790
atggccaggtttgacccagacgaagtcctagagttttatgccaatgcttggcccacggaggagggcgtgcgggacatgcggtcatgggtaaggggccaccagttcctgggagacctgctggtgttagaggagggccaggaatgcgagtatagtcagagaaggaaccaggtcgatgggtttgacgaggaggccatcgcccaactgttatgcataccgggtcaggattttgcccggaccgttgccgggagatgggtgcggatcatgcgcaccagtatgccacctaccaggcaccctctagacccagataagtctaatagggccatggggtttccagcgttgatcacaggtctttgccactcgttcgggcttcccgccacacctagtaaggtgattcgaccgccgatcacccgggccttcatagagaagtactgcacgcctagacaggcgaagggtggcgcaccgcaggcggccaaccacagggggcacgtgcagacccatgagtgcctctaccagctcagcctcagtctgcagaaccagggtttcgctccttttctgtgccctactccagatca

SEQ ID NO: 49106 - DNA, 399 bp, Glycine max
  Peptide Sequence Number=SeqID_140791
atggaagatatggtaacctctaggaggtttatattggaagcactacacgaggcgggcgtgattttccttgatgggggcaagggagatgcttgtttgatacacccgggagcgtcacacgatgtagaggcatgcccggtggcggaggacctgctacatgggtggatggacaaaggcctgtttgaggtttgtggcacaaggaaatgggagcaagatgtgtgcatgcaatcggctgacaagagcccgagcaaacccaagcccttggtgatctacttcaccagggatgttaccatgcataagccccgaggcttccaacctatcccggttaagaagcctgcccttttcccttacaagaatgacaaggcggtcccattggtttggagtcgtacccgaatcaaataa

SEQ ID NO: 49107 - DNA, 615 bp, Glycine max
  Peptide Sequence Number=SeqID_140792
atgactggacgccttcttgccggttcattggcttttgaaagccgcatccttcattatctcattgtgcggattttgcttccacgatcttccaaccttgcccaggtttatgaggaagatcgtgttatcatgtgggcctttcatatcgggcgtcaacttgactgggcacacttagtcagatatcgcatgcataaggcattgcgattaaatgctccattgccatatccacaccttgtcactctctttcttcgccattttcaaattcctcttgattctgaaccttatgttccaatcaagagatcttttttaattggtgctgctatgattgcctcctttggttaccgcaaagagcatgatggctcttgggtcaaaaagggtgctcaacccgctgatgatgaaggcaacctaccagttgaagataattcctctcttcttcgaaggcttttggacaagttcgatggtcttcagacttttgttggtgacaagtttgatgccatggaattgcaagtcgacatgcggttcgatgccatggattcaaggatcaccaaggttgaaaaagatgtctccttcatccgtacttgctttgatccaccaccaccgcctccatcatcatcttag

SEQ ID NO: 49108 - DNA, 678 bp, Glycine max
  Peptide Sequence Number=SeqID_140793
atggatatctctgaagatactgacatccctgtaatattgggaaggccattcatgttgaccgcaagttggatagttgatatggggaagaggaagctggagctaggttttaaagatcagaaaattgattttgatttatttgttgaagacaagcctgctccaaaacacaatgtttgcttacaggtaatggaaggaggccaagaggttctgaaacacaagcctcacgttaagcgcatctctgttcatgcgctaagtcgcgagtctcaagcacttagcacccatcccttgcatctaaggatgatttggtctgctaaactggccaagatggcctctaagaaacgtaagagtagtgattctaggccactggatcagaatgataacaggagatttcaatcagaggaagcctggaaccgatatatcgataatattttagaccgaaggatccttccggaaaggaatgtgaaactttatcattctgagtttgatgagtttaaagtagaattggagaggcgaaatcttcacaaatgccttgccaaccttcaggaaagaagcatagatgtgccagtggttaaagaattctatgccaatttctatagtcctgcaaatcaagctcctaaatgtgctagaataagaggccatttaatcaggatagatgcagacaacttaaatgagttcctctag

SEQ ID NO: 49109 - DNA, 228 bp, Glycine max
  Peptide Sequence Number=SeqID_140794
atgtcagtgaaaaacctcgtcggacgcctaggagtacatgacaagacaaaccacacactagcaagagaccagtcagggtcacagtattttatgagaatgctccaaccatgtgggatcgacacaggcttaaaggagcactcaaaccgggtgagccccaaggcctacactccgaagaatccatcagggcctctccctcctgattcaggtccaacccagaaaacattttag

SEQ ID NO: 49110 - DNA, 595 bp, Glycine max
  misc_feature (26)..(26): n is a, c, g, or t
  Peptide Sequence Number=SeqID_140795
cgccacgcttcccgaagggagaaagncggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccctgcatatacttatgctgcaggaattgctaccctcaactcgcagctgagagctcatagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 49111 - DNA, 303 bp, Glycine max
  Peptide Sequence Number=SeqID_140796
cctctgcatgctatcaagcgttctgtcttacagatagcaaaagaatgggtgcgaataaccataaggtatctccgcgtatcatgggtgcagaatgaccaaacttggtctctgcgtgccatcggacacgactgtgtccgaatggcaaagggaatgaccaaacttggtctctgcgtgccatcggacacaactgtgtctgaatggcaaaggggtgcggataaccataagaatgaccaaactttggtctctgctttgtcatcgggcccgccgcctctggatgacaaaaggggtgcggataaccataag

SEQ ID NO: 49112 - DNA, 1035 bp, Glycine max
  Peptide Sequence Number=SeqID_140797
atggctacctcaccaaaagaaacttcagcttctggttcaccctctgtaccatcatctccgcaccaggaacaacctgaattcaacatccaacccatacaaataattcctggtcaagcctctgctcctgagaaactggctcccagaagacaacagggagtgaagatttctgaaaaccctagccttgcaacaagtcctagggaagtagacccggagatggataagaagatccgcagtattgtgagtagcattctgaaagatgcttttgtgcctgatgctgagaaagatgttccaacatcctccaccccaagtgtttctgtgcctgatgctgagaaagatgttccaacatcctccactccaaatgctgaagtccttccttcacccagtgaagaggagtcaacagatgaagaggatcaatccacagaggagacccctgcaccaagggcaccagaacctgctccaggtgacctcattgacttagaagaagtcgaatctgaagaggaacccattgccaacaagttagcacctggcattgcagaaagacttcaaagcagaaaaggaaaaaccccccttaagaggtctggacgaatcaagactatggcccagaagaaaagcactccaatcactcctaccacatccagaaggagcaaagttgcaatcccttccaagaagaggaaagaaatttcctcatctgattctgatgatgatgtcgaactggatgtctcgacatcaaagagggccaagaaatcagggaaaaaggtgcctgaaaatgtccctaatgcaccattggacaacatctcattccactccattggcaatgctgaaaggtggaaattcgtgtatcaacgtagacttgccttggaaagagaactgggaagagctgccttggattgcaaggagatcatggacctcatcaaggctgctggactgctgaagactgtcaccaagttgggagattgttatgaaagcctagtcagggaatttattgtcaacattccctctgacataactaaccgaaagagtgatgagtatcaaaaa

SEQ ID NO: 49113 - DNA, 840 bp, Glycine max
  misc_feature (8)..(8): n is a, c, g, or t
  misc_feature (793)..(793): n is a, c, g, or t
  Peptide Sequence Number=SeqID_140798
ggcgaatntgggatcaactcgttagcaagcaaagaaggagcatctgtcaactggttccctcgatggaaggaaggaagaaccggagttcttatttcatgcagaggatttccaaatgttcccttgatggggacaaggggttgcatcagctacaatctcgttcttgctataagacaacttggctatcctatgagaggagcaccactagaggaagagatcgtgcctgtcatttcacgaggtttcaataaaaccaatgtggagacactttggaaggtccgcaaggcatgggaggtgttgcaaaagaaggacaaggaactcagaggcagtaacaatgggcccatcggtggctaccgtgagtggttgaaagcccacgtgcaagaggaagacgaagaggcgcaggcccttaggacagaactcaagcaagctcaaacagtcaaagaaaggttcaaatctgcagctcttaaaatccgaaaggagaatgccgaactgagagatgtaaatatggctaccaccaaagctttggaacaagagaccaaaagggcccgtagggaagaacatggccgaaacaagttccgaggggctctgtggggcagtaacagcgaacttaaactccgaagagaagaaagggaccaatcgcgagtagacggtttgatcttgaaagatgaattgaaggcttgctcgaggtccaagagaagtttgtctcagcggttgtgcgagacagagaccaacatgttagctatcatcaccaagtatcaagaagaactaagcctagccacagcccacgagcatagggtgncggatgagtatgcccaagtgtacgcagagaaggaggctagaggaagg

SEQ ID NO: 49114 - DNA, 501 bp, Glycine max
  Peptide Sequence Number=SeqID_140799
atgttgctaagtagcaatgtcatctatatctgtgtaagagtggtcatgttggtgcgcatgatccgcactcgtctctttacagcggcacgaatgaaatcttgccccgggggggcccaggaaccgttaaaaggaaactactggccccttaaccggaagtgcaagtctcgcccactgaaagtgaggacgcatagtcctctaaaggcgagggcgtgtagccctctgaagttcaagacgtgtcgcctttcgaaggcgagggagtgtagtcctatgatggcaaggacgtgcaatcctctaaaggtgaggacgtgtagtcctctgaaggtgagggcgtgtagccctacaaaggtgaaggcacatgaccctttgacggcgaggacgtgtagtcctctgaagttgaaggcgaggacttatagtcctctggaggtgagggcgtgcagccctctggtggtgaggacgtgtagtcctctcaaggcgaggacgtgtagtcctctgacggtgagg

SEQ ID NO: 49115 - DNA, 530 bp, Glycine max
  Peptide Sequence Number=SeqID_140800
cgaaaaggatcttcctccaccaccactactgttggccaccgccgccaaggaacatctggagacccacccgcaccagttcctccttctctttcatctccacgatcatctacattattttctttagatgatcagcgtcaaaggtactactctcaattctgtaatagagtcattctagaccctaagtaccttgaccttgaattttttgatgaagaaacatttgattgtcaccaagtgtttcaaaattctgctttgattgatttcatgactctaaaattgccctactttcctgagttagttaaggttttctataataatttgaaaattcaggatggtattctttactctgaggtgcataatattcccattgttattgatcagtccttgttctattctctgactaaactgcccagtcaaggtgctccttttgagggcacccttgttgatgactggaaatttgattattctactcatgatgctcgcagaatggtctgcaatgaccaggctgacatgaccggaagattacttgctgg

SEQ ID NO: 49116 - DNA, 222 bp, Glycine max
  Peptide Sequence Number=SeqID_140801
atggctagcgctgttcatgtgtcctccacctacgagtttggagccacacgtagtgattgcttagtgcaattctccaacctcgcctttttttcggagacccatgaatgccattgcctagcgctattcatgcatcctccaccaacgagtctggagccccgcgaagttattgcgtacaactgttcgcaaattctccattctcaacttctttttggagccccatga

SEQ ID NO: 49117 - DNA, 174 bp, Glycine max
  Peptide Sequence Number=SeqID_140802
atggcgtccaaccgaagcagcagctgggctcgcggtgaaggagaaggctcgcggaagaggtatgcaaaggaagaaggagaaggctcgcggaagagtttcaataaattgctgggtgcaccagcaatattgctgggtgcacctagcatatccctaattcctttggtaacagtgtaa

SEQ ID NO: 49118 - DNA, 624 bp, Glycine max
  Peptide Sequence Number=SeqID_140803
atgactctccacctccaatcttgccatactccattgaatgctccacaattctcaaacctctccgtattctgccccttacacattttcaccaaccagtgtgtcacttcaacatttattcttcacaggccacttcttcagcagatattcaacgttcattccttgaacaaaaaaaatactaaaacagctcagagaatgccttcagagttatcaactgactcaaccaagacaagcaccagttctgattcatcaacaactacaagcaagattgaatatccaactcacactaatccattaatcctacagttcactgcagtattccacaatgatatggacattatagaagtgcccactttttaccaccaacaatgggcaccaaaataccctgagtttgtcaactttagatatgatggaacaatataccaaatcaggctaaggcagcatcgggaaaaagtctactttgcggaagggctgaaagaattcagaaaagatttatcaatttacgaatctgtgatcattaaattcttggcatgcagcagcaaatccatgtttgatctttatttcgttccctcactagaatgtcagacttgcggaaggccagaagttatgtcaagacaacatatttag

SEQ ID NO: 49119 - DNA, 203 bp, Glycine max
  Peptide Sequence Number=SeqID_140804
tggctccggaacgatgagctcttgaagccgaagcggaggcggaagaaccctttcgtttctttgacgattctgccatttgaaggagtttttgcagatttcaatcggtttgggaatggaggaacgtcgcaagagaaaaggggctgcgcagggatttctggaaaatgtgatatttatagagcaggacgcgtggtaatcgattacaa

SEQ ID NO: 49120 - DNA, 304 bp, Glycine max
  Peptide Sequence Number=SeqID_140805
caaaaaagaaggagtagagacgagaatcgtcatcacggaaagggcaggatggacgaaatcagtgtcttatctttgctttcctcttatctccgatgagaggcccacttgggccttccagattcttcctccaaaaggcttttgcttctggaggaagcaaccttgctcacctgggcgagctgagctcgcttgggcgagctgggtggcaaggggttcagccttcttggcacttcttattctctcgaaatttctaaggaaaattgtttccgggaagaaaatccaagccgaggcgcttcctcttcaacgg

SEQ ID NO: 49121 - DNA, 327 bp, Glycine max
  Peptide Sequence Number=SeqID_140806
atggtacgcgcaagttgcgtcagggtcataccactttgggaaaggatgttggtagatcttcctgggagttattacggccatttggttggtgatgagggacggcaagaggtcttcgtacgtcattgggatcggggtgaattctggaatcggcctcaggggaagttcctcattgtgttggaaccgacaccaaagtgggcattgccgaccgggcgagtcgtggttggagccggagcttggggggcctccctctggatgggggcgggcgctctaggctgtacgggtgctgaattggaggagttcccagcgcgagctgagaagctcggatga

SEQ ID NO: 49122 - DNA, 291 bp, Glycine max
  Peptide Sequence Number=SeqID_140807
atgggtgaagtagaggaggtgcaagagcagatgaaggccgacacagaggccttaaaagaaaaaatggccacaatgatggaggccatgatgagcataaaggagatagtggaggtcagtgcggcttaccgaactcgtgctagagctagagtaatgggtgaagtagaggaggtgcaagagcggatgaatgccgacatggaggtcaagaaagagcaaatggcgacaatgatggaggccatgataagcatgaagaagataatggaagccaatgtggttgcagttgccgctagttaa

SEQ ID NO: 49123 - DNA, 949 bp, Glycine max
  Peptide Sequence Number=SeqID_140808
aggacttcacgtcctcaccatcagagggctgcacgccctcgccttcagaggactacacatcctcaccatcagagggctacacgccctcaccttcagaggactgcacgcccttaccttcagaggactacatgccctcgcctttagagggctacacgtcatccccattagagggctgcacgccctcaccttcaaaggactacacgtcctcacctttagagggctacacgtcctcgccatcagaggagggctacaagtcctcgcctttagaggactatacatcctcgccatcatagggctacacgccctcgccttcagaggactacatgtcctcaccttcagaggactacacgtccttgccatcagagagttgcatgccctcgccttgggtactagtaccctcaccttcagagggctacacgtcctcaccttcagaggactatatgtcctcaccatcagagggctgcacgtcctcacctttagagggatgcacaccctcgccttcagagagctacacgccctcgccttcagaggactacacgtcctccacattagaggactacaagccctcacctttagagggctacacgcccttgcctttagaggacaacacgtcctcaactttagagggctacacgccctcgccttcagagggctacaggtcctcgccttcagggggttacacgccctcgccttcgggggcaccaagtctgcgccttcaaagacctcaaagtcatctgcccttaatgctttaccgagacttgcgctcccgggtgaagggccagtaatttccctttatcagtcccttggccaccccctgatattggagggctaccaactgtgccagcacaaccagagagggaggctatcgcgcaactactatgcataccagggcaagatttcatctgtgccgctacaaagagacgagtgcagatcgtgcacaccaacatga

SEQ ID NO: 49124 - DNA, 420 bp, Glycine max
  Peptide Sequence Number=SeqID_140809
atgcttcagagcattcatcagggacagatcatattacttcagagtttacaagtggtggcgcctccaggatccattccttctattgagcagtttctagagagggaagatggaggtcccacaacccaagtaccaaagcatgtagaggatgcatcatctgaggccaccgttccagagccattcattgtagaggaggaggcaagtgagacacaggtcacatcagatccacccacaccagtggtggacctatcctcacctcagcatgcagcagacccctccactcctatacttgagataccagtggacccgaccacaccagtcctaactatgagcacttctcctccagctactccagtacttcatctgacggatgagaagggtgttcagactcaggatactcaggaccagtcacatgaattctaa

SEQ ID NO: 49125 - DNA, 372 bp, Glycine max
  Peptide Sequence Number=SeqID_140810
atggcgttcatgtttctatcagctgttccctcctgttcagtactgaggaattggtgcgtaacgcaaaagcaccagccggaacatacaagtggcgcccgctttccattcgggaaaccatgtcaggtgcgcaactgcattaatgaatcggccaacgcgcgggcgatgaggcggcctcttgcgtattacgccgctggcgctaagggagtgtatactggcttactatgttgggtaactgtgagggtgtccagtgaagtgcgttcatgtggcagaaaaaagctgacggccagcagaatatgtgatacgactcactattcggcgaattcctcgctcactgactcctaccgctcggtcgttcatgcggcagcgctctga

SEQ ID NO: 49126 - DNA, 297 bp, Glycine max
  Peptide Sequence Number=SeqID_140811
atgttcctcatattcaacactagtgctttgaaaggacttgatgatgctccacaaccgaaatcaaaggctgctgctaggtggattgttgttaaggtacatgatttaatgtatagacaaaaaggaatcactaaatgtggctactatatgatgcactggatgtccacgataatcttaggatctttcaggaataattgggagacgtattttaatgaagttagaccattggaagcagagagattcaaggcgtttcgcatccagtggacacagtattatctaaaagttagaaatcaaacatag

SEQ ID NO: 49127 - DNA, 288 bp, Glycine max
  Peptide Sequence Number=SeqID_140812
atgacccctactcatgacgcactcttgtattacaacgggaggtggaacatgccaccgcagaacaaatttgtaggttacgtgttcacaggttgtaccatcgatgaactgaaggatttgataaagcaagttacacctaaatggattccccctcatggaattcacgaatcacaaaccgtaagacgattgttttttcggcaaccaggtcgtttcgagtattcagataaagttataaaatatgaaattaatgagctaaaaaccaacgatgaagtgttgaaggtgttagtatag

SEQ ID NO: 49128 - DNA, 402 bp, Glycine max
  Peptide Sequence Number=SeqID_140813
gaaactagcagtttacatcttcttgttggggaggtaaccatcaccctggatgatgtggcatctctgcttcatcttccaattattggcgccttccataccttcaagcctctacacgtcaacgaagccgtgttgatgttagtggagttacttgaagtctccggagaggaagctagagctgagacaacacagtgtgcctatcttctgcatctgttaggttgcactctttttgctaacacgagtgcaacccatgttcatgttgttttcttagacactctccgtgacttgagtcagagtggaagctatgcatggggagatgccgccctagtgcatatgtatgatcatttgaatgatgctcctaagatcggcgaccaacaatttgctggctacatcactctattacag

SEQ ID NO: 49129 - DNA, 619 bp, Glycine max
  Peptide Sequence Number=SeqID_140814
gtggaggacacacgaatgaaaacgcaattcatggggctccgaaaaagggtagagaatggagagttgcactaagcaatcactacgcatggctccaaactcgaaggtggaggacacatgaacgaaaacgcaattcctggggctccgaaaaggggttgagaatggagaattgcactaagcaatcactacgcatggctcatcaagcttatcgataccgtcgacctcgagggggggcccggtaccagcttttgttccctttagtgagggttaatttcgagcttggcgtaatcatggtcatagctgtttccttcgggaaacctgtcgtgccatctgcattaatgaatcggccaacgcgcggggagaggcggtttgcgtattgggcgctagcggagtgtatactggcttactatgttggcactgatgagggtgtcagtgaagtgcttcatgtgggaggaaaaaaaaggctgcaccggtgcgtcagcagaatatgtgatacgggagatattccgcttcctcgctcactgaatcgctacgctcggtcgttcgactggggcgagcggaaatggcttacgaacggggcggagatttcctggaagatgccaggaagacacttaacagggaa

SEQ ID NO: 49130 - DNA, 183 bp, Glycine max
  Peptide Sequence Number=SeqID_140815
atggttaaagcacgtcaaaagggggttgaagaccgaagaacgacgaagaccgaacgaagaacgatgaagaacggggaaaagagggaggtggttgacgcccagctcgcccaggtgagctgggttgcttccaccagaaggcaccaccttctgttggaaccccctggaaggcccaagtgggcctga

SEQ ID NO: 49131 - DNA, 351 bp, Glycine max
  Peptide Sequence Number=SeqID_140816
atggctccgaaaaagtttttcgcgaagagatctaggagggacgccgcggttgaagggaccagtgccgcccccgagtttgatagccactgtttcaggagcaccgagcaccagcagcgctttgaggccatcaaaggatggtcgttccatagagagaggcgcgtccagctcagggacgatgagtacacggattttcaggaagagatagctcgccgacgttggacgtcactggtcactcccatggctaagtttgacccagatctagtcctggagttttatgctaatgcttggcccacagaaaagggagtgcggggacatgcggtcatgggtgaggggtcaatggattccctttga

SEQ ID NO: 49132 - DNA, 339 bp, Glycine max
  Peptide Sequence Number=SeqID_140817
atgacacgcggagataccttacggttatccgcacccttttgtcatccagaggcggcgggcccgatgacacgtagagacaaatttggtcattctgcacccttgtgtcatctagaggcggcgggcccgatgacacgcggagataccttacggttatccgcacccttttgtcatccaaaggcggcgggcccaatgacacgtagagacaaaatttggtcattctgcacccttgtgtcatccagaggcggcgggcccgatgacgcgcggagataccttacggttatccgcacccttttgtcatccagagccggcgggcccgatgacatgcagagactgacatag

SEQ ID NO: 49133 - DNA, 615 bp, Glycine max
  Peptide Sequence Number=SeqID_140818
atgccttatgtggaagccgcagaagaatcgttagaaaccgctttccagtcttttgaggtggtcagcatttcctccgtggactccctctttgggcaaccttgtctgtccgaggcggcggtaatgatggcccgagttatgttggggaacggttatgaacccgggatgggtttaggcaaagacaatggcggcataactagtctgataaaaacccaagggaatcgtgggaagtatggtttaggctataagcccactcaggcggacatgaaaagaagcatcgcgggaaggaagaacagtggtcagagctcgcgttggaaacaagaaagtgaaggaaacccgccctgccacataagtagaagctttataagtgcgggtctgggagacgaaggtcaagtggtcgcgatatgtgaagatgatgttccaagtaccttggatttggtccgaccatgccctcctgatttccagctgggaaattggcgggtggaggaacgccccggcatttacgcaacaagcataatatccgatgacgagtcccccgaaggtactgagtcctgggacccgtctatcgactttgagcaagagatgaatcaaacggtagatgaaggagatgagtatgag

SEQ ID NO: 49134 - DNA, 108 bp, Glycine max
  Peptide Sequence Number=SeqID_140819
ctctacgaaggttccatctacagagcaggtggagaaggtcggcgggcttcatccaagtccctatcggaggaggttggagcgatgcatgatggccgggaaaagacgtag

SEQ ID NO: 49135 - DNA, 168 bp, Glycine max
  Peptide Sequence Number=SeqID_140820
tcatttggctcacaagttcttcaagggaaggttgcgaatgagcctcaactgtttgttgtttctggggctgttgctgttgttgctgctggattgtggagagcgattcgaccatctaaggttgggatgattcctccactgggattgtacctgttgctagagaggtcataa

SEQ ID NO: 49136 - DNA, 54 bp, Glycine max
  Peptide Sequence Number=SeqID_140821
atggatgacatggaaccaaggcttgtaacttgcaaccacaagacaagaggctga

SEQ ID NO: 49137 - DNA, 1107 bp, Glycine max
  Peptide Sequence Number=SeqID_140822
atgaaggtgaagggtgatggtcatgaaaaagttgtagccgtagtggccaaaatatccaataagccaaggacccctgttgtgtctgtgcgtgaagaaagagccagcatccaagaggatatttggttctcaatgtaccaaagacgccaagtgaaccaagttgttactgcgaagaggacgtggtttgttcctcgagtattgcttctcaaccactccgctgcattcttgttgaaaaattcagcttcatcgggaagcatgaaacttgtttttgagcttgtgcttgatattggttgtaagatggtcgaaatgctatatgtgggaattgcagacattgaaaatgctcattcttggttctacccactaggagaggaaagcccaggtagtgtcctggttgccgtgtgtggtgaaactcgagaatggaaacccgaggctaagcaggaaattgcggaggacttcctgaaccagtttaacttgagagacagtggctttgtgatgccattcatgatgagattggtgatattagacgggaagccaaaatcacatgaggttttcatgagaaatccccaacaactcggtcataagctttttcgaagtcatgatatagcccacacttgcttcgagatgaccgtgcagaaactgataggtctaaagtccatgatggatgttggtgaatctgatttggggatgcgcaccacaacagtttcagctatctgggtgggaacattacctgatgtgaaagtatcaccaatcatgtgccaaatatcatcaccagtgtgcatctttgacttcccttttagagacaggagcagtaagagaggcggctacatgatcatcaatcttggggatatgctgtatggtcaacaagcgtggatcagtgcaccaggtatcagcaatgaacaggcctgtgactttatttcgtcgcctttgaataatggtttgggtatggaagaacttgatattgccaaagatatttttgatgaaggagacagattcattagtaagttgcttgagcttatgcaaggcatcgccactggtattggaccaagtttgcaccacaatattttcatattctgggtgagtgaggcgaaagaggacactttcaaggaatga

SEQ ID NO: 49138 - DNA, 1437 bp, Glycine max
  Peptide Sequence Number=SeqID_140823
atggggttggaatcggtgggagatttagcgattcacgtgattctcagtaagttaggagcccaagacactgccagagtcgcgtgtgtgagcaaaaggttctgttcttccgcttccgacgacactctctggatcaatcactgcttccacgaactcgctctgacacaacccctcgatcatctcggaaaccctctctcttccttcaagcaaaagactcttgatgatagacacattgtgtatgctaaagttcaaatgatgtttttggaatgctatcaagcatggcgaggagcttttgttatgtatccttggtctcttgttaagcgtgtaaaaaggtgctgggataaaataaaaacctggttgaccaataattttcctgaagctgaggccactctttgtaaaggtgctactgaagctgacattcaggagttggagaatgtattaaaggtgaaattgccacttccttcaaggatcctttatcgttttcacaatgggcaagaaattgcaaaagcagatccagaaactactacatatggcagttctttgggtctaattggtggctactccttctatagtcatttggtgaatgtttatctattacctatacgtcagataatcctagaaacaaagcaaactaggcgtcacttgagctttttaagaagatcaaagtatgttctcgtggctgcttcatccacatacagtagaaagttatttttcctcaactgtaccaatggtcaactatatgttgggaccagggatctacttactgaaggagacataatcccttgtgtacctcatgatctgattaatttacatcaggaattgaatatttcagagcaacaagatgccatgctactgtggttagaagaacatggtcgccgtttagaacatggctttatcaaacttcatgacaaaggaaatggcaaaagcattaatcttttcccagaagaaccccctctttgttcaatggctgttactaatggtgtgaaggttcgtgcttctgcattggttatccctgagttgattgatcttcaagatgaccttgaaaagtacttatttgcttattcaatccgcttgtcccttgaacctcaagggtgcactattaatggaatgtccttcagctcctgccagctccattggaggcactggatcatccgagctaatgatattgttatatctgatgtcaatggagaagctgttataggacaggtgctcaagaatttgtctatcagagtcgcatgcatctaccaacaccatcaggttccattgaaggttcttttacatttatacccggcagatacttggtggaacttatgggatgaaatgaagatccagtgggagaaaatttcagataggtggtttagattggcagacccaaaaggagatccttttctagctacagtggctcgtttcccgctccagcttccagactatattttctga

SEQ ID NO: 49139 - DNA, 1797 bp, Glycine max
  Peptide Sequence Number=SeqID_140824
atggcaaatcttgttcctggggtgcttctcaaacttatgcagcacatgaacacagatgtgaaagtagctggtgagcataggtcctctcttttacaagttgtgagcattgttccagcacttgcagggggtgagttgttcccaaatcaaggcttttatctcaaggtttctgattccttgcatgccacctatgtctctctccctgatgaacatgatgatctcatcctcagtgacaagattcaattggggcagtttgttttcgtcgatcgtttggaggcagcttcaccggttcctattcttcatggggttaggcctgttcctgggagacacccttgtgttggaacccctgaggacattgttgcaacaactcactcacttgggttccttagtaatggtaaggctagcaagaaaagtgcttgttctggtcccttggacttagagaggtctaagtctccgaggaaagtgttgagcaatcaccatgttggggagaaggagaagaaggagaaagtaagattgaataatgaagatcaattagacaagaaagcaatgctttttgctaagagtaaatctcagacaacaaaagcagcagcagccaatgttgttgatgtgaagaaggaaccgttggcgagattgaagtcattgaattcaaggaccattccctcttcccccactagctgctattccttgcctacttcttttgagaaattcgccaatggagtcaagcagcaggcaaatatcaagggagtggacaggctaactgctaaggtgggagtggtggagataggaaagggcgtccgtggagccagtcctaccgggaagagaatttccgtgggaaatccgatcagaaatttggttcagggaattgagcttggggctaaggcgctgcgtaagagctgggaagggaatatggaaatcaagaagaaagatacatccaaattaagggctgccaagtgtgatcctaagccagaggttcgcagctcaactcctaggagaagtacttcaagtgaaaagtttccctctaaagaagagagcaagatgcaaccacagacaaagtccttcaaggaagaccacgagaatcaatcatctataaagagagttattgccaatggaactatggaggaacaagaaaaaccaagtaagcaaagagtttccgttggaaagagatcgtcagaagcttctaacaatggattccctgaaaacttggtcaaagtttctccaagtagtagaaaagtgacagatgcaagtgttcaatgggcttcactcccatcatctattgcaaagcttgggaggttgagggcgagccttggcataacagtgaggttgctgccttatgacctgaaactaaaagtaatgggtttaactctcggaaacaacctccttttatgcacggataaggctgtgtacatctaccctccccctcccccgagacccattagatgggagccttatacactaggttgcctttatgtttttgaatttggctatataatgaggaattgttcagagcataattttttgtacttgttctcattttgtctattggcatgtcctcaactttcaattaaggtcatgatggagagggaagtgatgaagcaaagagatgccgcacagatggcagcaactgaggctatacaagaggctgccgctgctgagagtttgctgcaatgtctaaggtatgaatgtattcatatgaacaactttactatggacttctcaatgtcagatcagtacttcccatctttagtgtttctcaacatggttgagattttggactgctcatgtcaggaagttggaatttag

SEQ ID NO: 49140 - DNA, 657 bp, Glycine max
  Peptide Sequence Number=SeqID_140825
atggcggcgaaacttcaaatatttacgggattgccccccgcgccatttcaatcttcctcctccactctctgcgtactcaagaagcctctcactacctccttcttcggcactgcacgagtggaagttctgaaacttcgagtgatgaggattgcgaagcctgcgcgcggtggaggtgctctcggtgctcgcatgaacctctttgacaggttcgccagagttgtgaagtcgtacgcaaacgctgtcttaagctcgtttgaagatccggagaaaatattggagcaagctgtgcttgaaatgaacgacgacttgaccaaaatgcgtcaagctactgcacaagtgttggcatctcaaaagcggttggaaaataaatacaaggctgcacaacaagcttctgaagagtggtaccggaaagcacaacttgctcttcagaaaggtgaagaggatcttgctcgtgaagcacttaagaggcgtaaatcttatgcgcttaagttgttagaatctttggatgacgacacgacagacttcacagtagctgactctttaaagtgctttcatatgtacatttcaactcatgataatgccagttctttgaaagctcaacttgatcaacaaaagactgttgttgagaatcttgtctctaatacaaggcaaaaatag

SEQ ID NO: 49141 - DNA, 267 bp, Glycine max
  Peptide Sequence Number=SeqID_140826
atgacgagcatctcacaggctattatttcccagagctccaattcggataagtttggagctgtgccagcaaaggatgaaggaaggaaaagtcaaatattgagaagtcagtgccagataccagtcaaaatgactatcttaggtgttttttctagtcccaccagcactgagacaactatcagacatctgatctcactataccaatttcagctcttaattcaggttaagaagcatcaattacagattccaacgaaatttcagccatcttaa

SEQ ID NO: 49142 - DNA, 735 bp, Glycine max
  Peptide Sequence Number=SeqID_140827
atggatgaagtttttgccatgtccaagatgaggaaagcagatttggtgaaacgggtggtgatcattgccgtgatggctattgcagatgcagctgatacaaatgatgtttatagtccatgtcttgatgctaaagttcagagaggagatggttttacattcggtattgcattttcagacaaggaatttttctcccaaggtaatggtccgcagctttcgccttgcgacaaacgcctagacctcgcaaacaaaggagcacagctttctgttttcaggccgacggttgatgagatctcactgctcaccatcaacaggagcatcgtaaacgcgggcaaagatgcatatatggttgcatttgctgggcagaaatatgcagcaaggtcactacctattatgtttgctgacaacagtcacacgattactagtttcactttggttcttgaatttcaagagggaacccttcaaaacttgtattggaagagttttggttgtaatgcatgtcctagtggaagcatttgcctgaacaatcaagactgtgcagttccaaacacagagtgtcaaaagaatggggggagtgcctgcaacttgggaatacagttggcattctcagggactgacaagaatctcgatgctcttaattcttggtatgaagcgcaaaatctacggcagtactccctctatggtctattctccaatcttcgtgactccatcatcgggccatatgaaaatctcttttaa

SEQ ID NO: 49143 - DNA, 984 bp, Glycine max
  Peptide Sequence Number=SeqID_140828
atgggagacttttcattacacgaaaacaacatggattatcatcaggacaaccctgcagtcttcttcactatcatcaacaacaccaagctactgaaagtcccagaggagtttctgaaacatttgaatgaagacttgtctagtaatgcagttcttataggcccttctggtgataagtggcaagtaactattttgaagaaaggaaataacgtctatatgaacaatggttggtcacaatttctgaaagacaactcagtggtgcttgatgagttcttgcttttcacatatcatggaggaaactgcttctatgttcaaattttttgtgggaatggattggagaggctatgcctcaaagaaacaagacaagaacaagctgtcacccctcaatttttagatctgacttttagcaacaaagccttaatttctgatggatgtgagataaagaaaacaagtcaagaacaagcttccaccccaagtttggtaaggataacaaacaagagtaaacaaagaaaaacttctgctggttcatttcttcaccatgaatcgaagtcgtcgtgccaagaagatctgcctttcagcaacaaagccttactttctaaggacttcccaaagcctctgagttcaatcaaatttgaaacttcagaagcatgcaaattggccgagtcctttacctctcgcaatcctcattggaagcacctcatgacaaaatgcaatgtggaagatcattgcacattgcacattgctactcagtttgcatgtaagtacattcctgaagtagtgaaacagatcattctatggaattcggaaggaaaattttgggaagtggaagtgacttgtttaagatatcaaaataaaaggtatactcggtttacgacaggatggggaaaattcgttcgtgataacaagctcatgaaaggtgacacttgcatttttgaacttgaagacgaaaatcatatgagcgttcacatattcagaaccagtgtctga

SEQ ID NO: 49144 - DNA, 3402 bp, Glycine max
  Peptide Sequence Number=SeqID_140829
atggccgtcaacgacgccgatcaatccaataagtctcacaggactcgtcaatctggtgccaaaaccaacaagaagaagaagactaagaagaagcaaaagcagaatcccgatgacgccggaggattagaggatcctaagaaccgaaaccctaaggcattcgctttcacttcctccaacaaagccaagcgcttgcaatcacgcgccgtcgagaaagagcagcgccgcctccacgttcccgtcatcgaccgctcctacgacgaacccgctccctacgtcgtcgttgtgcagggccctcctcaggttgggaagtcactgttgattaagtctttggttaaacattacacgaaacataatttgcctgatgtgagaggtccaattaccatcgtatcagggaagcaaaggcgggtgcagtttgtggaatgtccgaatgatatcaatggcatgatagatgccgcgaagtttgccgatctagcacttcttcttatagatggaagttatggtttcgaaatggaaacctttgagttccttaacatattgcaagttcatgggttccctaaggtcatgggggttctcacccaccttgataaattcaaggatgcgaagaagttgaggaaaacaaaacagcgactcaagcaccggttctggactgaaatatatgatggcgctaaactgttttacttatcgggccttattcatggaaagtatgtcaagcgtgaagttcacaatcttgctcgatttatatcagtcatgaagtttcatcctttatcttggcgaacttctcacccctatgttatggtagatcgttttgaagacatcactcctcctgaaaaagtgcatgcaaataataaatgtgacagaaaagtcactctttatggctatcttagaggctgcaatttgaaaatgggcaataaggtgcacatagcaggagtgggtgattatagtttagctgttgttactgctttacctgatccttgtcctcttccatctgccgcaaaaaagaaaggactgcgtgataaggaaaagttattctatgctcccatgtctggccttggggatcttttgtacgacaaagatgctgtatacataaatattaatgatcaccttgttcaattctcaaaagttgatgaaaactctgctatgacgagtaaaggaaagggtggagatattggggaggatttggtgaaatcgctacagaatatcaaatactcaattaatgaaaaactagagaacagctttatcaatatttttggtcaaaagacaaatgtgtcatcagaagctctaggtgatgcacatggcacaaacaaggaagttgaaccaaatggcaaaacagaagctttggataaatatcagcctggggctgttataactggtgaagataataacaaaatggatttggatggttcagaatcatctgatcaggatgaagatgatgccacagacagagaaccctctggttctgatgatgatgacaaagatgcaccaaatagtaatgctagtaatggagtccatttgcaagaacatattgagtttcatgatggaagacagaggagaagagcaatatttggaaatgatgttgatcaaaatgatctgatggattcagaaggggatgatgatggtgataccagtgatgatgatgtagaatcttcagaagaggaggaggaagatgacaatgataatgatgacacaaatggtgcacaaaacgtgagagatggattgaatgacgatgggatggtcaacactgaggattgttccaagtgtacacaatttgtggatcagagatgggatgagaatgataatgaggagattcgcaatcgatttgtgactggcaatttggcaaaagctgcacttagaaatgcattaccagcagctaatactgaagaggaaaatgatgatgtctatggtgactttgaagatttggaaacaggagaaaagcatgagaatcatcagacggatgatgctttggctgcaacaacacacaagggagatgatttagaagctgaggagcggaggcttaagaaacttgctcttcgtgctaagaagatactggtaatgaaaatgaagacaagttccgtcgtggtcaagctaatgaaattgaaagaggagattgaactccagaaacaaatgaatatagctgaactcaacgatcttgatgaggctacccgattggagatagaaggcttccgaacaggaacttatctaagattggagattcatgatgttccttgtgagatggttgaatactttgatccctaccatccaatattggttggagggattggtataggggaggaaaatgttggatacatgcaggccaggttaaagcggcacaggtggcacaagaaagttttgaagactagagacccaattattgtatctgttggatggaggcgttaccagacaaccccaatttatgccattgaggatagtaatggaagggatcgtatgctaaaatatactccagaacacatgcattgccttgctatgttttggggccctcttgctcctcccaacactggggttgtagcctttcagaacttatcaaacaatcaggcaacatttaggattactgcaactgcagttgtacttgagtttaatcatgcagcaaggatagtgaagaaaatcaaattggttggttatccatgcaagatattcaagaagacagcacttatcaaggatatgtttacctcagatcttgaagtagctcgttttgaaggtgcagctattcggacagtcagtgggattagggggcaggtcaagaaggctgcaaaagaagagataggtaatcaagcgaaaaggaagggtgggcaaaccaaagaaggaattgctaggtgcacttttgaagacaaaattctgatgagtgacatagttttcctgcgtgcatggactcaagttgaagttcctcagttttataatccattgacaacagcattgcagcctcgtgacatgacctggaaaggaatgaaaactgttgcagaattgagaagagagcataatcttgctattcctgtaaataaagattcactttacaagaaaattgaaagaaaacctagaaaattcaatccagtggtgattcccaagtctctacaagcgagtctaccctttgcatcaaaaccgaaggatatttccaagcgaaaaaagccgttacttgaggagagaagggcaaggggtgttgtcatggaacctcgagagcgcaaagttcatactcttgttcaacacctccagttaatagatagggagaagatgaaaaagcgaaagcttaaggaagagaataagaggaaagcacttgaagcagagagtgcaaaagaagagctgttgttgagaaagcgccggagagaggagagaagagacaaataccggaaggaagacaagcagaataagaaaattcggagagcagaggtttga

SEQ ID NO: 49145 - DNA, 318 bp, Glycine max
  Peptide Sequence Number=SeqID_140830
atgggttctgagagagttgggtatttggatgatcctaacgttttgccctgtgttggcaatgatgcttatggaccctttcctcaaggagacctggctcttcctcttgaagcttatgattccccttctaatgctctcactatcatccaacagagatcaccggtggttaagagtattgcttttgtatattttcctgttgaacatcatgccagttgcccttctaatcagaaacttcccaaggctgtgcatatttctgtggtggttggtttgctgctcccttcaaaaatggaggggaaaaattcaaggatgtgctttatatga

SEQ ID NO: 49146 - DNA, 2079 bp, Glycine max
  Peptide Sequence Number=SeqID_140831
atggcaattagatccctgagagtgagagatgctatggtataccttgaccatgtccaagcaataaaatctggtttggtatcaagcattttcacttgtaatcaactcattcacctttattccaaccatggccttttacaagaggcccacaaactgttcgatgaaatgccccatccaaacgtattctcttggaatgccataatcatggcttacataaaagcacacaacttgactcaagcgcgagccctttttgactctgcctctcacagagatttggtttcttataattccctgttgtctgcttatgttggttcagatgggtacgagactgaggcacttgatttgtttactagaatgcaatctgcacgtgacacaattgggattgatgagatcactctcacaaacatgcttaaccttgctgccaaactacgtgtgctgtgttatggaaaacagatgcattcgtatatggtgaaaactgcaaatgatttaagtaagtttgctttgagttctctcatagacatgtactccaaatgtggctgctttcaagaagcatgcaatttatttggcagttgtgatgagatggtggacttggtttctaagaatgcaatggttgcagcttgttgtagggaaggaaagatggacatggccttaaatgtattttggaaaaatcctgaattaaaggatactgtatcttggaacacattgattgcaggatactcccagaatggctatatggagaaatcacttaccttttttgttgagatgattgaaaatggtattgatttcaacgaacacactttagcaagtgttttgaatgcctgctctgctctaaaatgttcaaaacttggcaagtctgtccatgcttgggtgttaaaaaagggttatagttcaaatcaatttattagcagtggcgttgttgacttctactctaagtgcgggaatataagatatgcagagttagtctatgcaaaaattgggattaaaagtccatttgcagttgcgtcgttgattgcagcctactcatctcagggtaacatgacagaagcccaaaggctttttgattcactgttggaaagaaactctgttgtatggacagctctatgttctggctatgtcaaatcacaacaatgtgaagcagtcttcaaacttttcagagagtttagaactaaagaagcactagttcctgatgcaatgatcattgtcagtattcttggtgcctgtgcaatacaggctgaccttagtttgggaaagcaaattcatgcttacatcttgagaatgagatttaaggtggataagaaattactgagttctttggttgatatgtactcaaaatgtgggaatgttgcatatgccgagaaactcttcagactagttactgatagtgatagagatgcaatcttatataatgtcataatagctggttatgctcatcatggttttgaaaataaagcaattgagctttttcaggaaatgttgaataaaagtgtcaagcccgacgcagtcacttttgttgcacttctatcagcttgtcgacaccgtggattagtagaactaggagagcaattttttatgtccatggaacattacaacgtattgcctgagatttaccactatgcatgtatggtggatatgtatggaagggctaatcaactagaaaaggcagtagagttcatgaggaagattcccataaagatagatgctacaatctggggagcatttcttaacgcttgtcagatgagcagcgatgcagcacttgtcaaacaggcagaagaggaactattgaaagttgaggcagataatgggtccagatatgtgcagttggccaatgcgtatgctgccaaagggaaatgggatgagatgggaagaataagaaagaaaatgagaggacacgaggctaagaagcttgctggttgcagttggatatatgtggaaaatggcattcatgtatttacttctggtgatagatcccattcaaaagcagaagcagtatattcaactctgacatgcttgaatgggaaactgtatttatctttcaaagaacagaagcaactttatgaaattcaaagtgatgttgattgttga

SEQ ID NO: 49147 - DNA, 1275 bp, Glycine max
  Peptide Sequence Number=SeqID_140832
atggctccttctcagccacctcattgggccccatctccatctctaacaccaacaccaatcctccacaagtctttctttcccccaccgtcaaactcgccggcggttgacttcagtccgcccttgattgcaatggtcgtcgtcgtcgccgccgctttcctcgtcgtcacctactcccgcctcatcgcgcgccacctcagacctcccatccaccgcctcctccgccgcttccgtcgacgccgcttcctcccatcctccgtcggcgacctcgagtccttaccctacgagtctccctttgatggaccgcacgtgttctctccttacggtttggacgaaacggtgattaaaacaattccgttttcgctttacaccgcgaaatacgacgctcgttttgacgagtctcgcaacgactgcgccgtttgccttctcgaattcgaagacgatgattacgtgagaacgcttcccatttgttcgcacacgttccacgtggactgcatcgacgcgtggcttcgctcgcacgctaactgtcctctctgccgcgccggagttctctgcaccgattcacctttcactccgatgatggctgccagaatccgaccaagcttcgacgacgacacaattctccaccgtatcagtatagatcctctcatcgatccgccgctgctgcctgcggcggctatctcctccgtgccggagattactccctgcgtcgacgagaattctccaaggaggaaccagaaccatgcaaacgtgaattcagaggattgttttagggattttctgctgaagagatcgtactcgttcggatttgaacggagtctggcgtcggagaggatggtgatggaaccggcgacagcgtcgccgtggcggtaccggagagggagtagtagtttctggagcaagaggccttcgccgtttggatcgttggggaagccgagggtgttttcgtttaggtattatagaggaatgaagtcaccgttcttccggcggaggggattttttccgttgtcggagtcgagcgtgaggtacggcggcggcggcggcggcggggggagctcgtcgcggcggagcaagtcgatagcaagtccgatgtttctgcggtcgtcgggggtgacgtcggcggcggcgttctcgtcgagcaggctgaggtgcggggatcccgaggcgcttctttcgccggagaggtttaacgggagggggttgatcggagatgggtggagggatgaggaagagcatttaattggagagagaactaagacatttcatgctgagaagtga

SEQ ID NO: 49148 - DNA, 693 bp, Glycine max
  Peptide Sequence Number=SeqID_140833
atggaagatacgccaacaccttcaactgctttgacctaccttaatccttcctactgggacgagaggttctcgaaggaggagcaatacgagtggttcaaggattattcccattttcgccacttgattcaaccccatctcacgccccattccgctgtcctggagcttgggtgtggaaactcacaaatgtgtgaacagttgcataaggatggcacaaccaacataacttgcattgacctttcacctgttgcagttcaaaacatgcaaaaacggctattgtcccggggattcaaagacataaaagtgctgcaagctgatatgctagagctaccttttgaggatgaatgttttgatttggttattgagaaaggaactatggatgtattgttcgtggacagtggtgacccatggaatccaaagcctgaaactatattcaaggtcatggccacattgaaaggtgttcacagggttttgaaagctggtggcacatttatctcagtaacttttggccaggtttcaaaaattgttagatgtgttgtgtctcttttaatgagtattgctgtgattgattctaatctatctaaaattcatgccagccacatttcaggcgccctatatttaatgcaccagatttcaactggtctgttgagtggactacttttggtgaaacctttcactattttgtctatgttctga

SEQ ID NO: 49149 - DNA, 288 bp, Glycine max
  Peptide Sequence Number=SeqID_140834
atggctttaccagaggtagttcgttccgacattctctttgtcttcattatcacacgacaagctgtttctgtttgtgttctgattcacactgatcatatgcaggttgggttgagactgctcctttcacccgttacttccaaccttcttctccgcacagcatgctgttcaatagggcttgcgcttcccgtgtattccacgtttaaagctattgagaacaatgacccatatgagcaacaaagattttacttgaggcattatgatctaacaagctgcccactcttgatgtaa

SEQ ID NO: 49150 - DNA, 816 bp, Glycine max
  Peptide Sequence Number=SeqID_140835
atggggaaaggaggtggttgctttccaagcaaaacaaaggcaccaatttctggagcagaaaaggatccaattattgttgaaagtctaattccaacaaatgatcgaagtagcacaagccaagaggtggaagcaccagcaccagcaccagcagcagtgaaaaagctgaaaattttcattgtgttctactcaacttatggccatgtggagtcattggcaaggtccttgaagaaaggggttgattcaattgaaggcgttgaaggggtgttgtaccgcgtgctggagacgctgccaaaggaggttctggaactcatgaaggcacctgagaaggatgagacagtgccactcatatctgaagacaagttggtggaggctgatggcttgctgtttggttttccaacaaggtatggcagcatggcggcgcagatgaaggtgtttttcgattcgaccggtcagttgtggagagagcagaagctggcaggggtgcctgctggcttctttgtcagcactggcactcagggtggaggccaagaaaccacagcttggacagcaatcacacagttagtccaccatggtatgctctatgttcctattggttataccttcggtgctggaatgttcgaaatggactcggtcagaggtggatctccatatggtgctggagtttttgctggcgatggatcaaggcaggctagtgaaacagaactggcccttgctgagtatcaaggaaagtacatggccacaatagtcaagaagaattgctggcttaggcttattggattcaaacaacactcaagtgtgcaactggctcatgattga

SEQ ID NO: 49151 - DNA, 444 bp, Glycine max
  Peptide Sequence Number=SeqID_140836
atgagacgcacacttgaacaatgtgaagcaaaacccaccaaaggggagaccaagacttgtgctacctctttagagtccatgctccaatttgttgccgcaatcattggttcggaggccaagtataacattctcacaagtgctgagaatggtgataacaaaattgaaactcttggtgtttgccatttagacacatctgattggaacccgaatcatattatatttactaggcttggaattaaacctgggaaggctccagtcaatcttagcagtgatgactatgtaccctttgtggagctctctttctatgtatgtcttgcatgtgccttgttttatccacaaacagaactcattgagcaatatcgggaagaaacagtaatgaatcttctgaaggcacagtctactgtctcagttgctggtggtggtcaaggctcaaacaacagttga

SEQ ID NO: 49152 - DNA, 708 bp, Glycine max
  Peptide Sequence Number=SeqID_140837
atgaagttgcagatgctcttcttgttcatgatgagactaaacataaggtctgaaatagggttcaaagctagctgtaggttgcgcatgctctccttgttcatgatgagactaaacataaggtctgaaatagggcttataactagctgtaaatgttcacagaacacttgcaatgacattgaatacttgcaaaatttcatactgaaagagagtaagaaactgaagagaggaagaaagaggtatatcatgaattcaattattacagtgttgtatttcaacggaagagtatttgaagacaatgatggtgtaatatttgaaggcagaaaatatgttgcgttgcaaatttgtgatgacgaagatgttgaaactatgatcgaaagttttcaacaacaacaacaaatgtcagttctagagttgtacgtagaaaaggatgttgctggtggttctatgtttcatgctgcaaattctgttacgtcatgtggacgtaatgtatctcattatgagtcggaactgccaaaaaatataagcaatttacatgttgatgaagatgatgatgatgatgatgatgattatcttgcatctaactcatacgttgaagagtctttcgatgaagatgatagtgatgatggaatatctcatacagacgatgaagtcactgacatcgttgaaccagtttcaattgttcacccaagcgaaggtaaatgtttgtga

SEQ ID NO: 49153 - DNA, 303 bp, Glycine max
  Peptide Sequence Number=SeqID_140838
atgtctgaaattactgacacgctcaagcttctcgatttcacgtggccggggcgagctgctgtggtcgtgccacctcatgcccgcgccctcttggcttggagggcttgtgattcgggctcctcgacctcttgcgtgtcctcacggcttgcgttgatatgcagcttcccatggatgatagctaggtttaatgataattcaataactcaaaacaacgttgttttgaaaatatgcaaagatcatcctaggagattgggaaactctaaattgcgaagagggcgatcagagaatgagaatggaggatga

SEQ ID NO: 49154 - DNA, 123 bp, Glycine max
  Peptide Sequence Number=SeqID_140839
atggctggtggtgacatagttgttctttatacgaaaaatgagggtatattaagcaaaaaatggcaacagaaaggaagagaaagaaggaattctgaagtaggcccagcccaacagtggcgctaa

SEQ ID NO: 49155 - DNA, 397 bp, Glycine max
  Peptide Sequence Number=SeqID_140840
ctcgaagaagaaaaagcgcggcggcggcgggagcggtcgccggagcaagggaagaacacagtccaaagatcacgcttctcaattcggcgccgacgattacgatcagctctccgaagatattaccgcattatgcgcaattttcgaagaagactgcaaggttcttccaggatcgcctcctcgtgtagttattaagctcagccttactaaggatatgggttatgaggacctagacgtttctgctgttcttgctatcaggcaactcaatcactgtctctttctgtttcttgttaggtgcttgcctgggtatcccttcaagtgccccaagttgcagattactccggagaaagggttatcagaagctgatgctaaaaagcttttgtcgctcttccaagatctg

SEQ ID NO: 49156 - DNA, 831 bp, Glycine max
  Peptide Sequence Number=SeqID_140841
atggccccgaggaagctttcctcaaagagatctaggaaagacgctgcggcatcagggactagtgccgctcccgagttcgatagccatcgtttcaggagcgctgagcaccagcagcgtttcgaagccatcaagggatggtccttccaccgagagagacgcgtccagctcagggacgacaagtacacagatttccaggaggagatagctcgccgacgttggacgtcgctggtcactcccatggccaagttcgatccagatatagttctcgagttttacgccaatgcttggcctacagaggagggcgtacgggacctgcggtcatcggtgaggggccagtggattccttttgatgcagatgccctcagtcagttcctaggatatccgctagtattggtgggagggttccagggagtgcgaatacggtcagagaaggaaccgggccgaatggatttgatgaggaggccattggctcagctgctatgcataccaggtcaggattttgctcggaccgctaccgggagatgggtgcggatcatgcgcaccaacatgactgccttgacccagacatggatgacgttgctgctcagcaacatcctgcccagcgatcataattccgacctccctctgccgatgtgtcagctggtgtatgccatcctgacgcggatgagcgtccatgtggctcagttgatccctgatgccatttatttatttgtaggtatgccacctaccaggaaccctttagacccagataagtctaacagggccctgggttttccagcattgatcacgggtctctgccagtcgttcggggttcctgtcacacttagtaag

SEQ ID NO: 49157 - DNA, 1200 bp, Glycine max
  Peptide Sequence Number=SeqID_140842
atggatatggtgaatcaagaggagtgggtcccgtttatggatgtattagcattgctaatctttggggttgtcctctttccaaacgtagatggtttggtggacctggcagcgatcgacgcttttctcgcctatcataaccacaaggaaagcccgattgtcgctatgctagccgacctatatgacaccttcgaccgaagatgtgaaaagagcaatacaaggattgtttgttgtactctagctctttatgtacggttggtttcacacctttttcgccaagaggtaaggcatgcttgcccgctagaaggtcaccgttcatgcacagagaaaggaggtgcaaattgggaccaactcttagcaaacaaagaaggagcgtctatcaactggttccctcgatggaaagaaggaagaaccggagttcttgtctcttgcggaggatttctgaatgttcccctgatagggacaaggggttgcatcgattacaatcccattcttgcgataaggcaacttggctacctgatgagaggggcaccactagaggaagagctcgcacttgtcatttcacgagggttcaatgagaccaatgtggagacgcttcggaaggtccgcaaagcatgggaagtggtacaaaagaaggacaaagagcttagaggcagtaacaatgggccaattggtggctactgtgagtggttgaaagcccatgtgcaaggtttggattggctcccaagtctgagaaccgctaaaagggaggaagttgaggcaccggaggaagacgaagacgtgcaagctcttaggacagaactcaagcaagctcaagtagtgaaagaaaggttcaaatcagcggctcttaagatccgaaaagagaatgccgaactaagagatataaatatagcaaccaccaaagccttggaacaagagaccaagagggctcgtagggaagagcacggccggaacaagttccgaggggctctgtggggcagtaacagcgagcttaagctccggagagaggaaagggaccaatcacgagtagacagtttgatcttgaaagatgagttgaaggtttgctcaaggtccaaaagaaacttgtctcagcgattatgcgagacagagacccacatgtttagccatcgtcagcaagtaccaagaagaattaaatctagccacagccccacgagcacaaagtgggcggacgagtatgcccga

SEQ ID NO: 49158 - DNA, 582 bp, Glycine max
  Peptide Sequence Number=SeqID_140843
atggaagggggagcggttaatgccgttgagtccgataggccgcgcaggtctaaacctttaagggatgtggcatcccctaggaggtttatctttgaggccctacaaaagggagtgaaggaagagaggagcagcacatatgcatgcagttcatggatggtatacttggtgatatacttcaccaagggcacagcttcgcaaaagcccggacaccccttggcagctaaacctgtccctttcccataccaaaatagccacgcagtcccatggagatatacacctccgagggggaaggaagaagaagccaccgacgtcagctcgttgtcggctaaggtaacaaatatcacgggactgagtggtgtgacccgtagcggtcgtgtgtttgcacccccggacctaccagtccaacccgcgaacgtcaaggggaaagcaaaagtggtggaggaacaagatgatgaaatacccctcgcttcgaataaagatataccggcaaaaggtcttccggagaaaaaggatggtaaaaaggaggtgtcgctagaggaagccagcgagttcctccgtataattcagcagagcgaattcaag

SEQ ID NO: 49159 - DNA, 429 bp, Glycine max
  Peptide Sequence Number=SeqID_140844
atggcaagagctggtgacaatggtggtgtatatcatcaactggacgaatctcagcgcttatttctggacgcgtggactacacaaatgcaacgtttgttgaaccgtaacaaagaagagccctacagacgaatagccaaatcttcctcgtttactcttaaacctctatcccttagagaagtgtgtgatgaccaaatcagaatgagagaaaagagagaacaagagaaagaaatagtgaggcaccacaaaggaatatggaaaagaagagtgatacacctgaggaaaagagtgatacacataagagagagagtgatacacatgagagaaaatttaattattttgcagaggcgagtgaagaatttaaaaatgtctttcctaaaggagattcctcatggactgccacctttcaagaggcatagaacatcaagttga

SEQ ID NO: 49160 - DNA, 558 bp, Glycine max
  Peptide Sequence Number=SeqID_140845
atgaaagataagagggatgcggaagaaaaactagaaaaccaaaagaaaaagaaggatagtatggccttgtcttcaaaggccaaggggaaggaaaaagaggaaaaggattcctccaagaagattgttaagaaggaaaatcattgcgacaaaatggaaatatcccttagcaccgccatacctcttaagcttgaggttattcctcaagtaaaggagttgttggatgagggtttggttcgtaagagcttaaatccttgtgctttgttggtgcccaaaataagtattatggggcaccaaatccctatgataggtggtatgatgaatatgttgagtggtgcaaccctcttttgtaaaatcactcatgcacccaaaatcttcatgatttgtgtacatggggactcattaggtaggaataatcaacatgagaataaagaaaaaggtatgttttattccattactttccttaactttttaaatagtgatcaagggcttcccatggaccctaagagaataaaggtgttgaggaaagaatccatgagtttcaagaacccacggatttga

SEQ ID NO: 49161 - DNA, 423 bp, Glycine max
  Peptide Sequence Number=SeqID_140846
atgaccatgattacgccaagctcgaaattaaccctcactaaagggaacaaaagctggaatcgatgcagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccaggaggagcttttgccg

SEQ ID NO: 49162 - DNA, 278 bp, Glycine max
  Peptide Sequence Number=SeqID_140847
cagcggaagaaggcaggaggtgtgggttccaaaaccacatgttccggaatgtgtcatccctttcagagcatcaggataaggaagattggtacctagatagagcagaaaagcccagtcacagcggagttaaaggaattcaatgccatgagtgtgaacctatggacacatcaaagctgaatgtccgaccatttggagatctcaagaagatcactggaatgggaaagctagtccatgatggacttcgctacatgatcaaaggattgcaaatctggggctga

SEQ ID NO: 49163 - DNA, 397 bp, Glycine max
  Peptide Sequence Number=SeqID_140848
gaaatggccccgaggaagctggcctcaaagagatctaggaaggataaagcggctgaaggaaccagttccgctctcgaatatgacagccaccgctttaggagcgttgaacaccagcagcgcttcgaggccatcaagggatggtcatttctccgggagcgacgcgtccagctcagggacgacaaggcgtgcgagatatgaggtctgggtgaggggtcagtggatcccgtttgatgcagatgctatcggccagctcctgggatatcctttagtgctggaagagggattttgcccggactgctgccgggagacgggtgcggatcatgcacaccaacatgaccaccctgactcagatctggatgactttgctgctcagcaacatccagcccagcgaccataa

SEQ ID NO: 49164 - DNA, 250 bp, Glycine max
  Peptide Sequence Number=SeqID_140849
tgatcaaggggttcccacgaatactaagagaataaaggtcattcctgagtggcccactctaccaagtataaggaaaatttggggcttcaatgacttaacaaacttttacaaaaggtgtggggagggaacgatgcaatcctacccaccacgggcattagatagaagaccccaagaagattgggccagagatgcaagagaaggccctagggttctcatgagccttagggtagatttcgggcccatgggctaa

SEQ ID NO: 49165 - DNA, 444 bp, Glycine max
  Peptide Sequence Number=SeqID_140850
atgaccggaaggcttcttgccggttcattctcttttgaaagccgcatcctccattatcttatagttcgcattttgcttcctagatcttcaaaccttgcccaggtttctgaagaagacctcattgtcatgtgggcctttcataaaggcgcttcagtcatagcatcctttggatatgttaaagagcatgatggatcttggataaagaagggtgctaaaaatgttggtgaagaaggacatgagggagaagattcatctcttctttctaaaattttggaaaggtttgatggtcttcaaacctttgttggtgagaggtttgacactttggaactacaagtggatatgcgcttcaatgaaatggagtcaagaatgactaaggttgaagaagatgtatcttacatccggtcaagctttgatcttccaccgccgccgccaccatcatcttag

SEQ ID NO: 49166 - DNA, 330 bp, Glycine max
  Peptide Sequence Number=SeqID_140851
atgggaagaatcaaagaattcttagactgtgtcgttttgaattctttgacaagggagaagggagacacaaaagaattcaggcggttagtcccttgttcttttggaaaagagagaagaaagacacaaaaagaattcaggcggttagtccttggcgaattctttttgccaaagggagaagagaatgaaaagatgaatagcacaagttttcaaggtttagaaaaccagaaaacttcagaaagcttttggtacaaagaagaagaagaagttcaaagagattcaaggcttgtaaaggattgtatgagattgttagaaagattggaaaatgattaa

SEQ ID NO: 49167 - DNA, 666 bp, Glycine max
  Peptide Sequence Number=SeqID_140852
atgggatcaagtcgaaagccttcgcttaaaaagaggttttatcaagtcaaaatcaagagcttagaggtcaccagtttacgaaagttggttcccttaatcccccccccttcaacggcaagccttctgcaaaagcctatggaattagaccgccaaaggcaagtcgaaaatggggtggtcgggataccgagaaaatgtttggaggcaaaagcaagaatcttggcaggtagaaacgaatgggccccgttcatagacgttctcgcactgttgatctttggaggagtcctcttttcgaatgtggatgggttggtggacctggcagcgatcgacgcttttctcgcctatcataaccacaaggaaagcccggttgtcgctatgctagccgacctatatgacatgttcgaccggggatgtgaaaagagcagcgcaagaattgtttgttgtgcactggctctctatgtgtggttagtttcacacctttttctccaagaaggtaggcccgtctatccgctacaaggtcaccgctcgtgcgtcgaaaaaggaaaggcgaattgggaccaactcttggctagcatggaggggcgtctgttaattggttccctcgctagaaggaaggaagaatcaggattgtatcttcatgcgaaggatgtccaaatgttccctggatga

SEQ ID NO: 49168 - DNA, 237 bp, Glycine max
  Peptide Sequence Number=SeqID_140853
atgaagaacggtggaaaaccttcgcgaaatcgcccacagaaacgtctcggaagcgttacggaagcgcctcggcttggattttcttcacggaaacaatttttctcactaattttaagggaaaaaagggaggtggttgccgcccagctcgcccaggcgagctgggttgccgccttctggtggaacatcttggaaggcccaagtgggcctgattgctatttgcacacccatgtttactaa

SEQ ID NO: 49169 - DNA, 233 bp, Glycine max
  Peptide Sequence Number=SeqID_140854
aacataatgaagggaaacccaacaaaggagtaagtcacggtaaaacattgcacaagattaaatggcctaactctctaaaaacagtggagtcgccaactgtcgcaacctacccttcggcgggagggagacgcgtgactcgcgggatgcgtgttcctcaaaaggaatacgcgcggagtcgccaccaacgtttatttgaggaaaacgtcggaaaaaccggaaaagacgcgatctaa

SEQ ID NO: 49170 - DNA, 676 bp, Glycine max
  Peptide Sequence Number=SeqID_140855
aggactacacgtcctcgccttcaacggactacaagtcctcgccttcagaggactacacgtcctcgccttcggaggactacatgtcctcccttccagagggctacacgccctcgcttttagaggactacacgtcttcgccttcataggactacacgtccttaccttcagaggactacacgtcctcgccttcagaggactacatgtcctcccccccagagggctacacgccctcacctttagaggactacacgtcctcgccttcagaggactacatgttctcaccttcagaggactacacgtcctcaccttcagagaaatgtacgtcttcaccttcagagggctacgcgccctcgccttcagagggttgcatgccctcgccatcacaaggctacacgccctcaccttcagaggactacactccctcacctttagagggctacaagccctcgccttcagaggactacacgtccttaccttgagaggactacacgtcctcgccttcagaggactacacgacctcaccttcagagggctacatgtcctcgccttcagaggacttcacgtcctccccttcaaaggacttcacgtcttggccttaagagaacggcacgtccttgccttcagaggactgcacgccctcaccttcagaggactacacgtccttaccatcagttga

SEQ ID NO: 49171 - DNA, 286 bp, Glycine max
  Peptide Sequence Number=SeqID_140856
atgctctcttttgacttttggcacgttacgaaacttcacgtattgcgcaacaatgggtgccaagtacctcaaagcggtcaagcaaaggtcgcatgccatcacatggtccccggacgaaaattagggtatgacacttgtcgcaacctacccttcggcgagagggcgaggcgtgactcgcggatgcgtgttccacgaaaggaatacgcgcggagtcgccaccaacgtttatttgaggaaaacgtcggaaaaaccggaaagacgcgatctacgaactttttagtgaaag

SEQ ID NO: 49172 - DNA, 717 bp, Glycine max
  Peptide Sequence Number=SeqID_140857
atggctaagtttgacccagacatagtcctggaattttatgccaatgcttggcccacggaggagggcgtgcgggacatgcggtcatgggagggccagaagtgcgagtatagccagagaaggaaccgggctgatgggtttgatgagaaggccattgcccagttgttgtgcataccgggtcaggattttgcccgggccgctgccgggagacgggtgcggatcatgcgcaccagcatgactaccttgacccagacgtggatgacgttgctgctcagcaacatcctgcccagcgatcataattccgacctccctctgctgaagtgtcagctggtgtatgccatcctgacacggatgagcgttcatgtggctcagttgatcgctgacgccatttatttatttgcaggtatgccacctaccaggcaccctttagacccagataagtctaacaaggccctgggttttccagcattgatcacgggtctctggcagtcgttcggggctgccgtcacaccaagtaaggtgattcaaccaccgatcacccgggccttcatagagaggtattgcacgtctagacaggcgcagggtggcgcaccacaggccccagacgcatcgccgccacctcatcagctgatccagctgggtcatttgacacagagtggtatttacgacatttggttcgccagcagcggccaaccacagggggcaggtgcagacccatga

SEQ ID NO: 49173 - DNA, 594 bp, Glycine max
  Peptide Sequence Number=SeqID_140858
atggtttgtaccaaccaagcggatatgaccggaaggcttcttactggatcattggcattcgaatgccgcatcatgcactacttgattgtgtgcatcctactccctagatcttccaaccttgcacaggcccatcttgtgagatatcgcatgcataagacattgcgatcaaatgctccactcccacatccccatctgatcaccttgtttctacaacattttaatgtccctcttgactctaagccctttgtcaaagtcaagagatccttctctatcggtgtgaatgtagtctcctctttcggataccgcaaagagagggatggctcttgggtgaagaaggatgctccagtacaggctgctgaagaccgctctccatcaccacattctcagagagatgactcttcctctcttatgcacaacattcttgacaagttggatggactccacaccttcataggtgaacgctttgactcattggatagccgtattgatgccatggatgcacgatttgcagcgatggacacacgtatcaccaaacttgaggaggatgttacttatgttcgccagtgctttgaccttccaccaccatcctcatag

SEQ ID NO: 49174 - DNA, 48 bp, Glycine max
  Peptide Sequence Number=SeqID_140859
atggaagccaatgcagttgcagttgccgctaccagggctgttgctaag

SEQ ID NO: 49175 - DNA, 336 bp, Glycine max
  Peptide Sequence Number=SeqID_140860
atggcagatcttgtgagcgcgaaaaatgacgtaaatctccgcgtgccaaccggcttgtcggccgcgattgacgaagggtgcagaagacgatgcttggcggccgcgattgacgaagggcacagaagacgacgtcagtctctgcgtgctatcaggcttttcgtcttacagacagcaaaaaagaatgtttatacggataaccactcgggtatctccgcccgtcagcatgactcaaatgtcagtatgacagatcttgtgagcgcggaagatgacgtaaatctccgtgtgtcaatggccttgtcggccgcgattgacgaagggcgccgaagacgacgttag

SEQ ID NO: 49176 - DNA, 297 bp, Glycine max
  Peptide Sequence Number=SeqID_140861
gtttggcacctcgatgtcggctcttcgccacctggggctgtagtatgttccaagggttgggctgttcgcccattaaagcggtacgtgagctgggttcagaacgtcgtgagacagttcggtccatatccggaccgggaaggacgcacctctggtgtgccagttatcgtgcccacggtaaacgctggagcctccggtagcacagccgagacagcgatgggttctctgccccagcggggatggagcgaaagaagttttgagaattcaagagaaggtcacggcgagacgagccgtttctaa

SEQ ID NO: 49177 - DNA, 626 bp, Glycine max
  Peptide Sequence Number=SeqID_140862
atgccgcaactggattgcgacgcctccgatggcctgggcctgacgctgtatgaactgatgcagctgccgggcaggccagccgccgggctgagcgtgacgctgctggcctgtgacagcgaacgtccgctgccggaagaagcacagcaggcgcgcgacggctggctggcggcgggcggcgtgattcatgccgccgacgctgcctggccggaacacatcgacgtaattgttgatgcgctgctgggcaccgggctgaatcgcgcgcctgccgcgccttatcagtcgctgatcgaacagatcaatgcgcacgccgcgccggtgtttgccgtcgatatcccttccgggctggtggcggcgaccggcaccacgccaggggcggcggtcgtggcggactgtacgttaagtatgattgcgctgaagcccggtcagctcaccggcaaagcgcgtgaccacgtcggcgtgctgcattgcgcgacgcttggtctggacgcgtttctggctggcgagccggcgccgattcatcgctacgctgcagcggatttaccgcgctggctgaagccgcgtaaagccacctcgcacaaaggcgatcacggccgtttgctggtggttggtggcgacagcggcacggc

SEQ ID NO: 49178 - DNA, 192 bp, Glycine max
  Peptide Sequence Number=SeqID_140863
atgaggcgttatgctgtgaattggttttgtaaagttgtgcggctgcatagattccttacaatacaaacaataagcccaaatgagaagttcattttcatggggaatgaagtgaaagctccagtggaaatagttgagacttattgtttaaaacgcaacactggacatcgtttagatttactggaaactccttaa

SEQ ID NO: 49179 - DNA, 594 bp, Glycine max
  Peptide Sequence Number=SeqID_140864
atgcttaaccgagactcgcgctcccggagaattccaacagggccctggggtttccagctctggttacgggcctctgtcaatcctacagggtgcccgttccccccagcaaggtcacaccatcatgacatagggatcgcgcccgcaggacacccagtggacccaaagaagtccaacagggtcctagggtttccagctttgaatacgagcctctgtcagttttacggagtgcctgtcacccccagcaaggcaggcgcaaggcgagacaccacaacagcctggggatggctggccacaaccactgacgcaccaccaccacctcatcaggctgatccagctgggtcattcggcatggagcggtatttccaacacttggttcgccagcaggcggccaaccacagggggcaagtgcagatccatgagtgtctctaccagctcagcctcagtcagcagagccagggtttcgctccttttgcgtgccctattccaaatcagtttagggctgaggtcgcatggcccggagattggtccgaggaccagacagaggaggcacctgcaggagctcccgatggtgcagaggacgcccgcatggatgag

SEQ ID NO: 49180 - DNA, 531 bp, Glycine max
  Peptide Sequence Number=SeqID_140865
atggcagaatcgtcgaagaagagaaagggatcatcctccaccaccgctgctgctggccatcgccgccacggaccatctgaagcacccacaacacctatccatcctcccttatcatctccaagatcatccacttttttttcttccgatgatcaacgtctacggtacctttctcaattctcttctaggatcatcttagaccctaagtacctagacatagatttcttcaatgatgagacatttgattgttatcaagtgtttcaaaattttggcttggttgattttatgtctttaaaattgccttattatcctgaacttgtcaaagtcttttcctgcaatttaaaaattcaggatggcattatttcttctgaggtgcatgtcaaggtgcacctttttgagggcaccattgttgatgactggaaatttgattattctagtcatgatgcttgtcgtatgatcgactgggctcacttggttcggtaccgaatgcctaaggcattacgggccaatgcacctcttccttaccctcatttg

SEQ ID NO: 49181 - DNA, 399 bp, Glycine max
  Peptide Sequence Number=SeqID_140866
atgctggtggacttattgatggtctctccagagtctgccagggctgagacagcccagtgtcgtggaccgtatctacgcctgcaatgggtacgtgatatatatgagtgccaatgccaggcaggtcattggacagctgcggctcgcgcatatcttcttcaccttctgggttgcactctgtttgctaacaagagtgcaaccaatgtccatgttgtctacttggaggcccttcgtgacctcagtatgacggagaggtacgcttggggagtggctgctttggtgcatatgtggattgcgaccaagaagaccgtgaagagcattcgtacgccggcgtacagggagcgcctggaccgactccggattccggatgtctgttggaccccttatggggagcaccgggag

SEQ ID NO: 49182 - DNA, 213 bp, Glycine max
  Peptide Sequence Number=SeqID_140867
atggccaaggatgagactgatcttttcccaaaagtattgatgagtctgtcaaagtcaaagttcgactgggaaatggaagctgtggaattgaatcaaaaggcaaaggcactgcatggtggagacagagtaaagcattggccaaatgaatggagagaggctacacacttcactttgaaggaggtgtatgaagaaatacttagacaacaaaaatga

SEQ ID NO: 49183 - DNA, 372 bp, Glycine max
  Peptide Sequence Number=SeqID_140868
atggttatccgcatctttcgtcaactagaggcaagcgagcctattgacccgcagagaccaatatggtcatccgcacctttcttcgaagactcaatgtctatcgaccgagactactttagtctctattttgctatctggagacaatcaagtccaatagcatgcgggggccgtaatggtcactcgctttcagtgttctgggactatcaaagtcccctttatcatccagtgacaagcgagtctgatgatatccgagatgatcatggtcgtccgtttcaaatcgttttggagatttttgcagccccttttgtcatcctgagacaatcaagtccgatgatgcacaaagactctcttttgctatccagagacgatcaa

SEQ ID NO: 49184 - DNA, 393 bp, Glycine max
  Peptide Sequence Number=SeqID_140869
atgacggaagggtgtggtgaagggttttgccttgcaaaccttcccggtgatgcttttagtctatgggggaacttctttgaggcaaagaaacaaatgatggctgatgccaagtttgcggggctgcttgggtcggcggtgctgggttatggccccgtgctaagtttcggattggttggccccctcctccccccccgtgatcagttttgttggccaggattttgccaactttggcttgcgccccgttggctaagtctgtgcctcggtggtggatcatcatgtcataacatggcaagacacaaggggagggacgaatcaaagcgacaagggctgaatctcagtggatcgtggcagcaaggccactctgccacttacaataccccgtcgcgtatttaa

SEQ ID NO: 49185 - DNA, 153 bp, Glycine max
  Peptide Sequence Number=SeqID_140870
atgaagaaacaacaatggaagagaagcttgcttgtggggctctatggaggctggatctttgagcttcaatggggtcctttaatggtgattttccaccatggagatgcagcggaagacaaaggaaaagaggtgagaggaggcgccatccattaa

SEQ ID NO: 49186 - DNA, 153 bp, Glycine max
  Peptide Sequence Number=SeqID_140871
atggtgaggcatctccaatcatctttcttccttcttcattatgctgacattcatcttcaagaagcaaaggactccattgatgaagaagatccaaggcttacaagcttcacatggagctacatcatgtggtatagagcatcttcatctaggtga

SEQ ID NO: 49187 - DNA, 369 bp, Glycine max
  Peptide Sequence Number=SeqID_140872
atggaaaaacggctttgccgcggccctctcacttccctgttaaggtttctgcttacacaacatatatccagccccgttcgtaacatattccgctcgccgcatcgaacgcagcccgagcacatccgccctttagcgccagctggcgtaatagcaaagcccgcccgatctgcccttcgcgcaacagttgcgattcagcctgaatgcagcgaatggcacgacagcgtccctgtggaaagcggcgcatgtaagcgcaacggcagggtgaatggtggttacgcgtcacgtgcacccgctttacacttgccagcgctgatgtccggcgtgtatgctttgtgccgaattgagcggacacacccgttcagtagctga

SEQ ID NO: 49188 - DNA, 195 bp, Glycine max
  Peptide Sequence Number=SeqID_140873
atggaagtaggaactagaggaagcaaaagaacatcactagatgaagatgctctgataccacatgatgcaaactccattggagcttctaggcctaggatcttcttcatcaatggattcctttgctccttggaagatgaatggcagcggaatggagaaggaagagagagaggagatgccacttcaaggagaagatga

SEQ ID NO: 49189 - DNA, 294 bp, Glycine max
  Peptide Sequence Number=SeqID_140874
acacttcccgagcaggtacgagcagttatgcaagtgggatcagcaactttcattatcagagtaatcaagcacagcggaattggtagtggcgacagcaaaattctgcaagttgcaagtcgtttccaggatgttaagacatctcttgtgacatcagctttctgctccctctgtctccatgctcttctatcagctactagccttttccaggatgtcaaggcatctcttgtgacatcagctttctgctccccctgtctccatgctctagctgcagcatcttctatcagctactcgtaa

SEQ ID NO: 49190 - DNA, 306 bp, Glycine max
  Peptide Sequence Number=SeqID_140875
atgtcaaatcataaaagcactgagtcaacactgaagaaccttgaggtccaggtgggacaactggccaagcagatagctgacaagtcatccaatagttttgtggcaaatacaaaacaaaatcccaaggaggaatgcaatgctgtgatgacaaggagtaaaaggtttatggaggttgaggatgaggatagtgttgtgtataagaagaaaactgctgacaaaaaaagtactgatggcaagaaaaacgaggaaactggaaataaccatgcccttcggagaagctttgcagcagatgccactctactttaa

SEQ ID NO: 49191 - DNA, 443 bp, Glycine max
  Peptide Sequence Number=SeqID_140876
catccgctaagcgcaacactcctgggctaagcgcaaggaagaatccagaagaagatgagttgtacagattcactaagcgcaccgcttctgttcatctgctaagcgagaaaggcgcgctaagccaaaaatcactaacgtgggctaagcgcacgagcacgaacaagccaacctatttaagcctgaaatcagattttgtgaagggagtttggactgcgattcagagctttgcatgtggaggagacatcctcaccacttgtattttttcaatcattcatcttgttcttctctttgttgttaagaaggcttcctggtatagaaagctaaatcctctgttggatcttccctggtcattcaatagtggaaactggtttgactctaaagtcattgatagtgaagggctgagttgtcgtgctttcaaaaggaatcggggtgcgataagttag

SEQ ID NO: 49192 - DNA, 981 bp, Glycine max
  Peptide Sequence Number=SeqID_140877
atgctggccgcccctgcttgtgagacgtccgccgtgcgaaccctataccccgccatcgagccgtaccgcgagttcaccctgaaggtgagcgatctgcacacgctgcacatcgaagagtgcggcacgccagagggcattccggtggtgtacctgcacggcggcccgggtgctggcatctcgcccacccatcgccgcttctttgacccggcgcgttaccgcatcgtgctgatcgaccagcgcggcagcggccgctccacaccgttcggcgaactgcgcgacaacaccacgcaggatctggtggccgatatcgagaaggtgcgtgagcacctgggcatcgagcgttggctggtctacggcggctcatggggttcgacgctgtcgctggcctatgcgcaggcgcatcccgaacgcgccaccggcctgatcgtgcgtggcgtgttcctcggccgcgagatggagaaccgctggttcgccgaggccaacggcggtgcgcgctggatcttcccggaacgctgggaacgctatgaggcctacataccggaagccgagcgtggcgacatgatcgcggcctactggacgcgcatggatggcccggatgaagcgacccgcatcgaagccgcgcaggcttggctgggctgggaagacaacgccgccaccctgcagcacgacgtggatgcgcaatccaccgacgacccgctggacacattggcaaaggcccgcattgaagcgcattacttccgcaacagcatcttcctggagccggaccagctgctgcgcgatatcgatcgcatccgccacctgccctgcgtgatcgtgcaggggcgctacgacatcatctgcccgccgcgcagtgcgtgggatctggccaaggcctggccggaagcccggctggagatggtgacctccggccacagcgcgaacgagccgaccacggtggatgcgctggtgcgggcgacggacgcctttgccgaccgtttctga

SEQ ID NO: 49193 - DNA, 363 bp, Glycine max
  Peptide Sequence Number=SeqID_140878
atgaagaggggacttcagcatttggggtggaagatgttggaacatctttgtcagcatcagggacagaaacattcggggtggaagatgttggaacatgctttcagcattagggacagacgcatttgttcagaatgctactcacaatactgcggatcttcttatccatctccgttgtctacttccctaggacttgttgcacaggctagggttttcagagaatcttacacattttccctgttgtcttggggacaacagctttctcaggatacaggggctgacaggaatcactttttcgtttgtatggagttggatatggaattacaagttgttcctggtttcataacggtgctcttggtggactga

SEQ ID NO: 49194 - DNA, 123 bp, Glycine max
  Peptide Sequence Number=SeqID_140879
atgaatgaggagtataagctcatgcaagacaacaaggtttgggaacttgtcccattaccagaaggtaatgtggagaggtataaggctcgtcttgtggcgaaggactatacccaaaatgaatga

SEQ ID NO: 49195 - DNA, 417 bp, Glycine max
  Peptide Sequence Number=SeqID_140880
atggagcagcgtggccatggaatgtattacacgccaccaacatttgctcagtatccttcgcagatgtatcagtatcctttcgagggccatgacactgatatgtctgcaagcgaacattcgtttggtggtgttgccgaaacacaacctcatttttcatggccgaccatgaccccttcgcagcaacatgatgccccaatggcaacacctaatgccccattaggtcagcaatgggatgtacctggagcaatccctcctatgggtgatttattaggtgttgatttgcgtcacgagttttctgcagaggctgaggaacaagggcggagacagcgcgcaagaagaaatccggatcgtcaagcccgaaggtgggatcgaccatgtggcacatcctcgcgccatcacgaacaccatgatgactga

SEQ ID NO: 49196 - DNA, 195 bp, Glycine max
  Peptide Sequence Number=SeqID_140881
atggttttaaaaagggggagggggaaggtttctgcaccaaaaactctcccccctcattccaaaaagcaaaagctcacgggattcacaaattttgcagcccttaagtcaccatttctcacgtttttgattccattttgctctattattcatctccaacaagggatggccctaggcctatggtgcattctgaaataa

SEQ ID NO: 49197 - DNA, 282 bp, Glycine max
  Peptide Sequence Number=SeqID_140882
atggtgaaagttggaacctcttacgtgccgatcaacgtctcattttcgccaaaagttggcccagggcttcccggttcttattcggcgcaataccgtgcgcctcgaggggatgctgccaccagcttacttgattctagttggcgtatctgttgtctatcagctgttccctcctgttcagctactgacggggaattggttatccgcgtccaattcggcacacaagcataccagccggaagcatcagcgctggcaagtgtaaagccggggtgcctaagacgctga

SEQ ID NO: 49198 - DNA, 437 bp, Glycine max
  Peptide Sequence Number=SeqID_140883
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatatttgaggaaaacatcggaaaaaccggaaaagacgcgatctacgaacttttaagtgaaag

SEQ ID NO: 49199 - DNA, 976 bp, Glycine max
  Peptide Sequence Number=SeqID_140884
atggagaatcaagatgagtgggtcccattcatggatgtattagcattgttaatctttggggttgtcctctttccaaacgtggatggtttggtggacctagccgtaattgatactttccttgcatatcaccatagcaaagaaatcccggtggtagctgtcttggcagacttatttgacacatttgaccaaaggtgcgaaaaaagtagtgcacggatcatctgttgtttacccgctctttgtgtatggttggtttcgcacttattccaacaagacataaggcatccatgtccgctccgaagccatcgctcgtgtgccgagaaaagaagagtagattgggaccaacacttggctgggataggaggcggaacagtcaattggtttccacgatggaaagaaggaaaagagggtgttctcttctcatgtggaagctacccaaacatcccgttgataggaacgaggggttgcattaattacaatcccgcacttgctataagacagttagggtaccccatgaggggagcaccgacggaagaaagcctgtctcctttccttgtgagagattttggcgtgcagaatttcaaggttatacaaagagtccataaggcgtgggaaaacccattaaggaaagataaagagcttaggggcattcgtaatggcatcattggtggttatcatgaatggctgaaagttcgtacacggggtttagattggctcgccaagttaaagattatcaatgaagagaatttcgaagctccggaagaagatgaagaagtccgagctctgaaaaccgaactaggaaaagcgagacttgccaaagaagaattcaagttggtcgctacagacgcccggaaagagtgtgtcgggttacgagaagaaaatgcagctaccgcaaaagcccttgaacaagaaaccaagagggctcgcaaggaagagcacagccatgacaaattctgtggagcattatggggcagcaaca

SEQ ID NO: 49200 - DNA, 794 bp, Glycine max
  Peptide Sequence Number=SeqID_140885
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggagaaagtcaaaggaaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 49201 - DNA, 169 bp, Glycine max
  Peptide Sequence Number=SeqID_140886
atgtcgatctccccctgtggaagtatcagttggtctgtgtctatccaacataggggtcgcgcccgcaagacaccctgtggacctggagaagtccaagagggtcttggagttgccagctctgattatgggcctctgtcggttctacggggtgcctgttgcctccagcaag

SEQ ID NO: 49202 - DNA, 364 bp, Glycine max
  Peptide Sequence Number=SeqID_140887
atggctgagaagacaaagaaaagtctggaagaagctgcccagtccggaagcactgagggcgtcattgaccctccatctcccatcagacgccacgtgaagtggaagatgacccgcacgaagaaaactgggcagatgacgtctgaggcagcaaaggaaatggctgagaagattggatcgttcgtcccccatggacgtcaggatgtcctgaatgctgccattgggcgaccagagcaccctggccgtgtttgtgctgttggagtcgatggacttgcattgcctccggagccagaggttggtcccttaggtgcttgtgtcagcacaaaggagagttgtgttgctccctcagggaacgatccagggacgg

SEQ ID NO: 49203 - DNA, 435 bp, Glycine max
  Peptide Sequence Number=SeqID_140888
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccaggaaggcagttcgctccaaactggactgtatgcacaaaccccccgatcagccgaccgctgcgccttatccggtaactatcgacttgagtccaaccccagaaagacatgcaaaagcaccactggcagcagccactggtaattga

SEQ ID NO: 49204 - DNA, 329 bp, Glycine max
  Peptide Sequence Number=SeqID_140889
aacacgctttacggtgcccttaccgaacccgtgctagagctagagtaatgggtgaagtagaggaggtgcaagagcaaatgaaagccgacacaaaggcctcgaaagagaaaatggccataatgatggaggccatgatgagcataaaggagataataaaggtcagtgtggttgcaatagccactaccagcaccattgttgagcatgccttcccaccatatggcttgcctcccaactatacaccaccctatgtggcatacactcccagtgaggatgtcaataacttagctcccatacttattgaaagccaacaacctcaatctggcacatga

SEQ ID NO: 49205 - DNA, 1065 bp, Glycine max
  Peptide Sequence Number=SeqID_140890
atgggcgcggatcagtcgtgcgaccggtgcggcgtcgctgcggccggtggccaggaagatgtgttcgccgcgtaccggatgctcgcgcatgatcgcgcgctcctcatcggtatgccggcgcggtgccaggagcacatcgtcgggaatgccgatcttgccgacgtcgtggaagcgcgcggccaggccgatctgcgcacaggcatcgtcgtcgagatcgcagcgtcgcgcatctgcagcgacatcgagagggcatcgatcaggcaggcctgcgcgtgcagcaggtcgggggcgggtacggcgtcagggaacatggtcatccgcccgcaccgggtggggaccggtgcggggtgttcgggggggcgatcaacccggggcgagggtggtcagaagggcacgggccgcattgaagcggtcttccggcaacggcagcgggtgcttgatgcgcagcttgtcgggcccttccatggcgtagaggttcggttgtttctggatcagctggatcaccgccattggatcgatgttcggcttggactcgaacacgatgcggccaccgttctcgcccaggtccagcttgcggatgcccagcgtgttggccttgagcttcagctcggcgatggcgaacaggtgcttggccgcatccggcagcaggccgaagcggtcgatcatctccacctgcagctcgcgcagcgcatcggtgtcgcgcgcgctggaaatacgcttgtacagggtcaggcgcgtgtgcacgtccggcaggtagtcttccgggatcagcgccggcacatgcagctcgacctcggcaccgcgcacttcttcaccggcatccaggtcgggcagcttgccctgcttgatgctgcgtaccgcgcgttccagcagctcggtatagaggctgaagccgacctcggccatctgcccgctctggtcctcgccaagcagttcaccggcgccgcggatttccagatcgtgcgtggccagggtgacgccggcgcccagctcgtccatcgaggcgatcgcttccaggcgcttctcggcgtcgggtgtgatcgcgcgacggtcgggggtgatcag

SEQ ID NO: 49206 - DNA, 426 bp, Glycine max
  Peptide Sequence Number=SeqID_140891
atgaagcacttcactgacaccctcatcagtgccaacatattactaagccgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49207 - DNA, 396 bp, Glycine max
  Peptide Sequence Number=SeqID_140892
atgtcagttataaaattgtacatagaaaaagatgttgctggtggttttacgtttcattcagcaaattctgataaatcatgtgaaaataatttatctaataatgagtcgaaatcgtcaacaaatgtaaacaatttaaatgatgatgctgattatcttgtgtctaattcatacgttgaagagtttttagatgaagatgataatattgatgatatatctgatacagatgatgaagtcattcacatggttgaaccagttataattgttcaaccaagagaagcaatatcaattggagtcatcctggtgagaaggatatttgcggtttggagatgccatcgagttttaaggttgggcaagaattatatgttagtatgcattttgacagtaaagatgttgtaa

SEQ ID NO: 49208 - DNA, 198 bp, Glycine max
  Peptide Sequence Number=SeqID_140893
atgtcatcatgcgctcagcgcgccatcaactcgttcagcgagaagattgtctcttctgcgcttagcacgagaatggcgctaatccaaatttcatttactcgcgctaagcgcaaaaatggcgctaagcgcgccttcacggacaaaaagccctttttaagcctgaattgcagagagctaagttcaacaagagacatttga

SEQ ID NO: 49209 - DNA, 472 bp, Glycine max
  Peptide Sequence Number=SeqID_140894
cgttgcgctcactgcccgctttccagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccggtgtcattccgctgttatggccgcgtttgtctcattccacgctgacactcagttccgg

SEQ ID NO: 49210 - DNA, 587 bp, Glycine max
  Peptide Sequence Number=SeqID_140895
ggctacacgccctcgcctttagaggactgcacgtcctcaccttcagaagaccaaacatccttatcttcagaggactacacgtccttgcctttagaggacttcacgtcctcacattcagggggctacacgccctcaccttcagaggactacacgtcctcgccttcagagggctacacgtcctcgacttcaaagggctacacgtcctcgccttcaaagggctgcacgtcctcaacttcagaggactacacgtcctccacttcagaggactacacgtcctcgccttcaaagggctgcacgtcctcaacttcagaggactacacgtcctccactttagaggactacacgtcctcaccttcagaggactacacgccctcgcctttagagggctacacgtcctcgccttcagaggactacacgtcatccacttcagaggactacacgtcctcacctttagagggttgcacgccctcgccttcaaaggacttcacgtaatcaccttcagggggctacacgcccccgccttcgtatggctacatgccctcaccttccgaggactacatttcctcaccttcagaggactaaactga

SEQ ID NO: 49211 - DNA, 150 bp, Glycine max
  Peptide Sequence Number=SeqID_140896
atggcagcagcggcacataatgaggcagacattaagcaacatcatcttcggcatgtagtggatgactttgcagcaattgctgataggttggacaggctactgaacttgaggatcttgatcgaaggaacagaagcctatactgttgtttaa

SEQ ID NO: 49212 - DNA, 237 bp, Glycine max
  Peptide Sequence Number=SeqID_140897
atgcatattgttgtggtaagacaggggcaggatcatcttgagctaccttctggggtgaggaaaaaatgtggacggcagaaaccaatcaaggtacttagggacggatgcaagtggggatggggtcacgaccgaccgatcgttgccccttctctgcgcgaaacaagcagagaacgtcgctgcaaggcagccccgtatcctttgtatttgcagttttcttttactatttgtttgttttaa

SEQ ID NO: 49213 - DNA, 186 bp, Glycine max
  Peptide Sequence Number=SeqID_140898
atggaagaagatctcaagaaaactctcaaattcttagatgctacaaatgcaaccaacttggtcacatcaaagcaaattgtccctcaaatgaggaatggcctgagaaaagtgataagaaaagagaaggaaatcaaccttctaaccaaggactatgagagtgatgagaacatctctcaagaagattaa

SEQ ID NO: 49214 - DNA, 324 bp, Glycine max
  Peptide Sequence Number=SeqID_140899
atggtgggctacacaccttcaagctttgcggatttggtcttcaccgacgaaaggatcaaagtgagtctgaaaaaaggcaaatttagtcatcctgcttggacaaatgagaaaactagggcaaatgaagagggtgaggatgaagtagaagcccatgctgtgactgccattccaatacagccaagtttcccaccaacccaacaatgtcattactcagccaataacaaaccttctccttacccaccgcccagttatccacaaaggccatccctaaaatcaaccacaaagtctgtctaccgcacttccaatgacgaacatcacctttag

SEQ ID NO: 49215 - DNA, 231 bp, Glycine max
  Peptide Sequence Number=SeqID_140900
atgggcccgaaatctaccctaagactcattcttggagtcttctatccaatgctcttggggggtaggattgcatcagttatgaatgtgcctcaaaaggaaaagaaaaagataaaatcctcgatcaaagattggaggaaagcaaaagaaaaagaaaaattctcgatcaaagatcggaagagagcaaaagaaaaatatacagaaaggtcattggatcagacaatgtctgaatga

SEQ ID NO: 49216 - DNA, 225 bp, Glycine max
  Peptide Sequence Number=SeqID_140901
atggaagacgcacccttggcccactcgagaggccctttcgcgcccccgccgaagggtaggttgcgacatgatgaaaatgcacacagattaaaatggcctaactctctaaaaacaatccccagtggagtcgccaactgtcacaacctacccttcgataggagggcgacgcgaggctcacaggtattagcaccccatgcatctgtcacaaggaatgacagcctttaa

SEQ ID NO: 49217 - DNA, 261 bp, Glycine max
  Peptide Sequence Number=SeqID_140902
atgtcatcgcatgtgtgcgagaaagggaaagcaaattgggaagaaatcttggcggatatggtaggggcgcccgttaattggttcccccgatggaaggaaggaggggccggtgttttgtgcttatgtgaagggttcccaaacgtccccttgatgggaacgagggactgtattaattataatctcgtacttgccataagacaactaggctatcatatgagagaggctccattggaagagagtatcgcacctttcatcgcatga

SEQ ID NO: 49218 - DNA, 198 bp, Glycine max
  Peptide Sequence Number=SeqID_140903
atgttttgcgagaatgctccaaccatatgggatcaacataggcttaaaggagcactcaaacccgatgacccccaaggcctacacttcgaagagtccgtcgaggacctctccctcctgattcagtacccacgacctcacactcgtgtttcaaatacgtttaacgcattgcgctacaatttaacactagttcctaaatag

SEQ ID NO: 49219 - DNA, 492 bp, Glycine max
  Peptide Sequence Number=SeqID_140904
atggatagtgtaggcgtaggtagtatccagtccacatgccctgaaatcggcacatcttgtcgccttcgagggtctcccaatctccctctaggcactccatctatattcgatcatggattagctgcgctgccatcacgatctacaagaaaaaaaaaagaaaggggtagactctttcacgtagcaacacactgtctccattttctaagcccggtaatcgattaccagaggtctccacaacatactgtctccatttctaagcctggtaatcgattacacatccttggtaatcgattaccagaggctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 49220 - DNA, 201 bp, Glycine max
  Peptide Sequence Number=SeqID_140905
atgtcggttaagcgacaaataacaacgatacagatgaggagagtgagagaggaaaaaggcaaagtgggtatcgctttctgtgtgagatcaaaaaaatggaatgtaccgaaacccgtatggagccgcagacagagacagagacacgcagagagagaagagaatgtaggaagtaggaacaaacgtcgttatcaaaagcgttag

SEQ ID NO: 49221 - DNA, 492 bp, Glycine max
  Peptide Sequence Number=SeqID_140906
atgcaagcagggaatttcgatgtctatggattcatcgagccacaatccatccagagatctgggcaatcacaatttgaatcaaaaagttacatgaagaactggatgcagaattcaaaatggaatgtctacctaggcgcctacatgaatgggctagacaactacgttaaaggaataattaacatgtcagtgttgttttttaatgcatttgcattatcattactcagcaacatcaatattttaatgttccttgtattcaacaatgctttgaaaggacttaacgatactccacaacctaaatccaaggccggtgctaggtggattcttgttaaatgtaatagacaaaaaggaagcactgagtgtgactattacgtgatgcactggatgtccactataatcttaggaactttcaggaataattgggaaacgaccattggaagcacagagattgaaggcgcttcgcatccaatgggaacagtattatctcaaagttag

SEQ ID NO: 49222 - DNA, 297 bp, Glycine max
  Peptide Sequence Number=SeqID_140907
atgtgggctttccttaccggtcgtcagatcgactgggctcacttggttaggtaccgaatgcataaggcattacgggccaatgcacctctcccttatcctcaattggtcactttgtttctccgtcattttcaaattcctcttgatgatgaaccttttgttcaagtcaagcgttcctttgctataggtgctggtgctgtaacttcatttggttactgtaaagatcatgatggtcaatggctgaagaaggatgcactgcctcagcaagatgagcgtactccttctcctcctcctcgatga

SEQ ID NO: 49223 - DNA, 943 bp, Glycine max
  Peptide Sequence Number=SeqID_140908
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcagggaattcgatggttcaggtgccccttgtattggttcaccctatgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 49224 - DNA, 849 bp, Glycine max
  Peptide Sequence Number=SeqID_140909
atggccaagtttgatccagacatagtcctcgaattttatgccaatgcttggccaacagaggagggcgtgcgtgatatgaggtcctgggtgaggggtcagtggatcccgtttgatgcagatgttatcggccagctcctgggatatcctttagtgctggaagagggccaggagtgcgagtatggccagaggaggaaccagtctgatgggttcgatgaggaggccatcgcccagttgctatgtatatcggggcaagattttgcccggactgctgccgggaggcgggtgcagatcatgcacaccaacatgaccaccctgactcagatatggatgactttgctgctcagcaacatcctgcccaccgatcataattttgacctccccctgccgaagtgtatggcgcctaccaggcaccctctggatccaaataagtccaacagggccctgggatttcccgccttgatcataggactctgccagtcgttcagcgtccccgtcacacctagcaaggtgattcggccgcccatcacccgagcttttattgagaagtactgcacgcagagacaggtccagggtgatgcaccacaggccgtggacgcgccgccacctcatcaggctggtccagccggatcatttgacacggagcaatatttgcggcatttggttcgccagcaggcggccaaccaccgggcacatagccagggctttacttcttttctgtgccctactccggaccagttcagggcagaggtcgcatggcctggagattggcctgaggcccaggcaggagaggcaccagtaggggcaccagcagaggctcccgacgaggcagatgaggcccgcgaggactaa

SEQ ID NO: 49225 - DNA, 633 bp, Glycine max
  Peptide Sequence Number=SeqID_140910
atgaatatcttgacaacacacgatcaagggtgggaacaggagttaagtccttacaatcaatatgaagaagaaagaactcctaatcttgaaggtgtgtttgaggaattcatggcataccatgctagctcaaaagccaatcaaaattcaatggaaaatcatgaaattcattttggcaagagctactcaatagaaaaatttcaagggggaccagagttacaaccttactatcaaaatgaagcagaaagaggttccaatctggataaattgttaatgcaattcaagaaaacaactaaatcaactcaacgagcacttcaaagtgtagaaatccaggttggtgagctggcagaagaagtgactcaatttatgtccagacgagaaaaatactttgtagaggttgaagctcaagaggaaagccctgtaaaagagcatgagtcaagagaaaaagatgaggaacaagcacaacaacaatgggagaagtactcaacaatagaaaacaatcaagaaagtattctccaaatcaataaccttcctcatcaacggattgacaagaaaaaaaggcaaggagagtacgaggaaaccttaagtgccattctttctttaatcattaacacctttcctgaaattatttggaat

SEQ ID NO: 49226 - DNA, 953 bp, Glycine max
  misc_feature (922)..(922): n is a, c, g, or t
  Peptide Sequence Number=SeqID_140911
atgactcaactgcagaacgatacctttttgcgcgccctgatgcgccaacccaccgaatacacacccgtgtggatgatgcgccaggcgggccgttatttgccagaataccgcgagagccgtaaaactgctggcagctttatgcagctctgccagagtccttcatttgcaacggaagtgaccttgcaacccttggaccgctacccacaactggatgcagccatcctgttcagcgatatcctgactgtgccggatgccatgggtctgggcttgtattttgaagagggtgaaggcccgaaatttgagcgtaccttgcaagctgaggaggatatcctcaagctggaagtaccggacatgaccaagctacagtatgtgtttgatgctgtcagcagcatccgtaaggcactcaatggccgtgtgcccctcatcggcttttccggtagcccatggaccctcgcgacctatatggtcgaaggtaaaggcggcaccgatttcctgaatactaagaaaatgggctatgccagaccagaactgctgcatcgcattctggaaatcacgtcacaaaccgtcattcaatacctgaatgcccaaattgctgctggcgcgcaggccgtgatgatttttgactcgtggggtggcgctctgtcgcatgacgcctatctcgaattctcgcttcactatatgcagaaaatcgtcgccggcctgaccaagaccgcggaaggtaaaacagtgcccagcattgtttttaccaaaggcggcggtttgtggctggagcaacaagcggccattggtgcagatgccttaggcctggactggacggttgaccttgcacaagcccgccaacgcgtaggtgatcaagtggccttgcagggcaatatggatccagccattttgctgagttcaccagccgcgattgaaaaagagngttgcccgcattctcgccagctatggccatg

SEQ ID NO: 49227 - DNA, 321 bp, Glycine max
  Peptide Sequence Number=SeqID_140912
gaagacgtcttggtaagttgcacgtcttctatgccatatgtggaagccgcggaggagtcattggaaatggccttccaatcttttgaggtagtaagcattgcctccgtagattccctctctgggcagccttgcctgtccgatacggcaatgatggtggcccgtgtgatgttggggtatggctacgagcgcagaatgggtttaggcaagaacaactacggcagaaccagactggacacgaaggccaagtggtcacgatatgcgaggatgactctccgagtaggtcggattaggtacgaccattccctcctggtttctgactag

SEQ ID NO: 49228 - DNA, 246 bp, Glycine max
  Peptide Sequence Number=SeqID_140913
atgactcttttaatagcagccttgggattctggaaggctactgttttcgttcttaatgcaaagcctcattccgttttcgacttctcaaacttcaacaagttcgtcttgcattcttcttctactttcatggattacgtttctgcttcatgtttcattctgcgttttctgtttaatccatggaaggctagattttctggtgttgtttccttctgtgaggacaagccaattgttaggtttcgcttgtaa

SEQ ID NO: 49229 - DNA, 168 bp, Glycine max
  Peptide Sequence Number=SeqID_140914
atgaaagctatgccaagcaagccaccaagaaaaggaaggctaaaggcccaagtggagaaggataaagcccccaagtggagaaggatgaaggcccaagtggagaaggatgaaggcccagaggcagagacactatcaagactattaattgttgttggaggcccaaactaa

SEQ ID NO: 49230 - DNA, 99 bp, Glycine max
  Peptide Sequence Number=SeqID_140915
atggttttcggggcttccgtggcttccgcaatgctttcgtggcttcatcgttcttcaccgttcttcgttcgtttttcgtcgttcttcagtcttcaaccg

SEQ ID NO: 49231 - DNA, 599 bp, Glycine max
  Peptide Sequence Number=SeqID_140916
ctagtggaggattttgcacaagtgtacgccgagaaagaagcaagagggagggtgattgatgcgttgcatcaagaagcgactatgtggatggataggttcgccttgaccttgaatggaagtcaagacctcccgcgtctgttagccaaagcaaaagccatggccaaagtgtgtactgcccccgaggagattcatgggctaatcaattactggcgtgcaggaacagatgaaggcgatctatcggccttaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49232 - DNA, 1035 bp, Glycine max
  Peptide Sequence Number=SeqID_140917
atgacaacctgccacactgtctttggcaaccatcatcaaccttccgaacttgatattcatggactgcgacagtcaggtccttatactgcctttcttggttgtgtgtccgatactactcaacgttgctgcatgtgtacaaggaatgcacacgatgaggctcaaacatcggttcggatgaacgacgaagctgggacacaacattctttgcaggtaccattcgcaaccaatgtggctacattcactgtggaaaaggataaagggtccttcgggatacctctgcaggatttacacatatttgacgttcgcatgaagcatttggctgaaacgatggaaaacatggataagcataacaaaacaagacttgatgccatggaaaagactaactatacaatgctgaaggccatctgcaacttcgtcaagcaagaccacaataagtcaaccaaagatggtatcgaggatgtaggaatgagtgcaactcagaatacttctctgaatgatgaaacactacactgtcaaaaccctaagaagccgttgtccaccccgactgtaagatgcaccaaaaatgaagcatatgggaaatcgaagccaaatttgaagaatattgaaaccattttcatcccgggggacggcgatgatgactttccaaggccgttgccaatgagaatcaaggggaaattcctgggtcaggaaaataataccacatactcgtctcccaaaacaatcaacctttcaggacccaatgacgtcaacaccacaaatgagtcctccccacaagaaccatttatgagcaactacgttataggactcagagcaaagaagccagaaattgagcagcattcacaaacttggaatgctccaaaaatgcaatacattaaaggcagttcgtctggaaacatgaacaacaaaaaggcaagccagatctttcataggcctcggactaattccactaggggatacacacatacaattcctaaggacatgccctgtagcttcaagccaactattgacatgaatcttacttttgaggagacatag

SEQ ID NO: 49233 - DNA, 138 bp, Glycine max
  Peptide Sequence Number=SeqID_140918
atggataaagttgatatctttgtccctcatcctctcacaaacgcatgtttgcttattcaactttcaccggaatgtgggtggataacccttcccttgtgttcaagaatcccctacaacaagagacccacgatctcttaa

SEQ ID NO: 49234 - DNA, 447 bp, Glycine max
  Peptide Sequence Number=SeqID_140919
atgacgttgcttagaacattctgcccagcgaccgtaatgccgatctccccctgcagaagtatcagttggtctgtgtcatcccaacatagggatcacgcccacaagacacccagtggacccggaggagcccaacagggcccaggggtttccaactctagttacgggcctttgatcacgcccgcaagacacccagtggacccggagaagcccaacagggtcttgggatttccagctctgattacgggcctctgtcagttctacggagtgtctgtcaccctcagcaaggtcatcaggccccctaccaaccgagctttcatcaagaagtgctgcgcccccaagcaggcgcagggcgagacaccacagcagcctggggatagccagcagcgggcaacagacgcaccgccaccacctctagagttcacctcagctcatccacaaaaagggtag

SEQ ID NO: 49235 - DNA, 306 bp, Glycine max
  Peptide Sequence Number=SeqID_140920
atgggggtgcaaatagaaaccaggcccacttgggcctttcagaaaattcctccagaaggcggttgcttctggaggaagcaacctagctcgcctgggcgagctggggagagaagtgaaaggaaatttggttcaacccttctggtaattcgagaatcacttgaaattagtgaaaaaaattggttccgtgaagaaaatccaagccgaggcgcttccataacgtttccgtgggtgatttcgcgaagattttcaaccgctcttcgacgttcttcattcgttcttcgtcgttcttcggtcttcaaccggtaa

SEQ ID NO: 49236 - DNA, 465 bp, Glycine max
  Peptide Sequence Number=SeqID_140921
atggcaaccggttcccgattgttcctgatccccgctgcgaggcccggtctctgcaaaaacggcttcttcatttcctcttattctactcgcacgctcgaactgtgcgaatcatcatcgtcttcctcttcctctgcgctcgcggggaagagcccgaaacgtgaggggtttgggcttggtgggacgtcaaaaactgccacgtgccccccaatttcgacgcttccaaagttgcccccaaaatcatggaggcactactcacccgggcccaccaggaagcactcgcctacaccggcgttcgcttcacccacgttaacgggttcgcccgggggatccactagttctagagcggccgccaccgcggtgggagctccaaattcgccctatagtgagtcgtattacaatttcactgggccgtcggttttacaacgtcgtggactggggaaaacccctggcggttccccaacttaa

SEQ ID NO: 49237 - DNA, 297 bp, Glycine max
  Peptide Sequence Number=SeqID_140922
gaacccgcacgcacacttcaacagcctgtggagtggatactacctacacctactccatatcgactagctgagccggttcaagtgatagaggtgtcatcctctggagaggatcttgaagaggacctagaggagttacctcctgaacctgctatggacgcccttgacttacctaaggatgatgaagacccattccctaatgttgattctccagaggatgttatgtcagtatctgaggcagactctacagaggagagtggccctggagggacaacgattagtgacgactcttcatcgtag

SEQ ID NO: 49238 - DNA, 219 bp, Glycine max
  Peptide Sequence Number=SeqID_140923
atggaggattgccttgagggtcctctcttaggcaatcatggaatcaccgctccaaactcaaaagtggaaaggacacatgaacagccccaagcaataacattcacgtggctccgaaaaaggacgagaatggaggattgcctggagggtcctcttaaggcaatcatggaacacagctccaaactcaaaagtggaggacacatgaacagccctaagcaataa

SEQ ID NO: 49239 - DNA, 132 bp, Glycine max
  Peptide Sequence Number=SeqID_140924
atgttgcggtgcacgaatagctcgcccggatgcgagccggtcagcacttctgccgatattgttcaaagtaatctggattacgctcgcggcgctggagtgcccaactgcgatttttcgctaataagggtttaa

SEQ ID NO: 49240 - DNA, 382 bp, Glycine max
  Peptide Sequence Number=SeqID_140925
atgactagaggcaatccatctaacttacaaccctttgaccctaagatagataggacatttcatagattagttaggcatcattttataccttttgatcatcctgagcgttccattactgatgaatctgtgcattcagttattggtgattttgaacatcctgatttggagcattataattttgagcattctgattctgagcattctgattttgcacattctaagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcag

SEQ ID NO: 49241 - DNA, 334 bp, Glycine max
  Peptide Sequence Number=SeqID_140926
gcatctcactgaaacatgtatgcgagcggggaattctgatatctatggattcctcgagcctcagtccattcagaggtctgggcaatcgcagtttgaatctgaaagttacataaagagttggatgcagagttcacaacgcgatgtgtatcttggagcctacctaaatgggttccactgcagcggacactggcagatggtgcctaaatcaaaggctcctgctaggtggattgtcgtcaagtattttaacgaccctagaccattggagcctgagagattaaaagcattgcggatccagtgggcacagttttatctccgagttagagatcaggcctag

SEQ ID NO: 49242 - DNA, 345 bp, Glycine max
  Peptide Sequence Number=SeqID_140927
atggtgaaagttggaacctcttacgtgccgatcaacgtctcattttcgccaaaagttggcccagggcttcccggtatcaacagggacaccaggagtttgatttgccttgctgcagaagtttggtgttcccagtcgaaggcttctgtggcaggagaaaaaagctgcaccggtgcgtcagtcagaatatgtagatacaggactcactattcagggcattcctcgcttgactcctacgctcggtcgttgatgcggcgacgtgaaagtggtccctacaacggggcggaattcgattcattctggtttgtaagattgcttgccttgcggaagaacttaacagggaagtga

SEQ ID NO: 49243 - DNA, 333 bp, Glycine max
  Peptide Sequence Number=SeqID_140928
gtgctccagtggcttctgtttctatcagctgtccctcctgttcagctactgacggggtggtgcgtaacggcaaaagcacccccggacatcagcgctggcaagtgtagcggcaaattgcgcgtaaccaccacacccgccgcgcttaaagcgccgctacagggcgcgtcccattcgccattcaggctgcgcaactgttgggaagggcgatcggtgcgggccttttcgctattactccagctggcgaaagggggatgtgctgcaaggcgattaagttgggtaacgccagggttttcccagtcacgacgttgtaaaacgacggccagtgaattgtaa

SEQ ID NO: 49244 - DNA, 732 bp, Glycine max
  Peptide Sequence Number=SeqID_140929
gttctatcaagtcaaggtcaagagcctagggatcaccagtctaaaagagttagggcagttgatgggtcagctccaacggcaagcttttcgcaattttacggtaaaatctgggacctagccatggtagaagtccccacagaggccattgcctccctcgcccaatattatgatcagccgttgaggtgctttacctttggggacttccagctatcacccatggtggaagaatttgaagagatcctaggatgtcctctagggggaaggagaccatacctcttctcagggttctatccctcattagctagaatttctaagatagtccaaatttcggcgcaggaattagaccacagaaagcaagtcgaaaatggggtggttggaataccgagaaaatatttggaagcaaaagcaagaatcttggcaggtagaggcgaatgggccccattcatagacgttcgcgcactgttgatcttcggaggagtcctctttccaaatgtggatgggttggtggacctagcagcgatcgatgcttttctcgcctatcatgaccacaaggaaagcccggttgtcgctatgctagccgacctatatgacacctttgaccgaagatatgagaagagcgagaaaggaggggaaaattgggacccactcttagcaaacaaagaaggagcgtctgtcaactggttccctcaatggaaagaaggaagaaccagggttcttatttcgtgcggatga

SEQ ID NO: 49245 - DNA, 489 bp, Glycine max
  Peptide Sequence Number=SeqID_140930
atgcgtcgatggaggcagtgccgaccaacggtcggcacccaccagggcaggcggcgcgatgccgcgaccaaggtcggcacctaccgggggcgcaaacaaaaaaagccgctgcggggcagcggctttttgtctttcaggcggcgccgtagcgccagcgggtcagaggtcgacccggcgggcctgcatgaacttgttgccccagtaaccactgagcagggtgtccacgcggacgtccttgcccgagctcggcgcgtgcaggaagcggccatcaccgacatagatgccgacgtggtcgacgcggcccttgcggccgaagaacaccaggtcaccggcggcgagcgcagtgcggtcgttgatcagctcggcgttgtcatcgtgggccatctcgcgcgagacgcgcggcagctcgatgcccagcgccgagcggaacacgtagccgaccaggccgctgcagtcgaagccgctgtccgggttgctgccaccccaacg

SEQ ID NO: 49246 - DNA, 540 bp, Glycine max
  Peptide Sequence Number=SeqID_140931
atgccacccaccaggcaccctctagacccggataagtctaacagggccctggggtttccggcgttgatcacgggactctgccagtcattcggggttcccgtcacccccagtaaggtgatccgaccgccgatcacccgggccttcatcaagaagtactgcacgcctaggcaggcacagggtgatgcacatcaggccgcaaacgcaccgccaccacctcatcaggccgatctcgctggatcactaggcatggagcgttatctacagcacttggtttgccagctggcggccaaccaccacggacaggtgcagatacacgagtgtctctaccgtttcagccgcagtcagcaggggcagagttccaccccttttgtatgccctaccccggagcagtttgcggctgaggtcacatggccgggagactggcccgatgcccaggcaggggaggagcctgcagggtcccccggtaggatggatgaaccccgcatggacgaggatatgactgacctgttcgatttcttggaagggagcggagccgcatga

SEQ ID NO: 49247 - DNA, 561 bp, Glycine max
  Peptide Sequence Number=SeqID_140932
atggttaaggaggagtgtaaggaggtaagtgtctcctccaagaagttagctaagaaggaaagtcattttacaataaagacaaacattaaaaaaacttcccctcttagacaacctccacattttctcctttgtaaaaagacacttgttagcattgccacacctcttgggcttgaatttattcctcaagtaaaggagttgttggatgaggatttggtttgcaagagcttaaatccttgtgctttgttggtgcaaaaaataggtattattaggcaccaaatccctatgataggtggtatgatgaatgtgttgagtggtgcaacactcttttgtaaaatcactcatgcacccaacatcttcatgatttgtgtacatagtgactcattaggtagtgatcaagggcttcccatggaccctaagagaataaaggtccttcctgagtggcccactccaccaagtgttgaggaaagaattaatgagtttcgagaacctctggatttgaggtcaaatccttttcaagggggagggaatgatgcaatcctaccccctaagggcattggatag

SEQ ID NO: 49248 - DNA, 334 bp, Glycine max
  Peptide Sequence Number=SeqID_140933
atgaaagatattgagctggtagaggaggaacaggcacagattggtgctaatccttctagtgagacctccaataaatctgagaattataaggaggaagcacggaatgcaacacagaagcataaaccaaagaaggtagagagtgtcaacactgatgcagaagcctttgctgaaccactagaacatacgaagaaaagagatacaggccatcaaagtgtgtcattggagaataaggcaggagattcaactgtgctgaagataggaaattcgggtaaagttgtgataaaacaagacatgaagggaagaaggcatacatatgggtttaacaacaacaaac

SEQ ID NO: 49249 - DNA, 72 bp, Glycine max
  Peptide Sequence Number=SeqID_140934
atggggcctcatcagaagaacagagctggtagacttaggattggcagtggaagagggagtaagataggacag

SEQ ID NO: 49250 - DNA, 399 bp, Glycine max
  Peptide Sequence Number=SeqID_140935
atgtgcgagcacaaccagaaggaggctatcacgcagctactatgcataccgggcaagattcacccgtgccgctgcaaagagacgagtgcggatcatgcgcaccaacatgaccactcttacacagatatagatgacatgctactagcaacattctgcccagcgaccgcaatgccaatctccccctgcaaaagtatcagttggtctgtgtcatcccgacatggggatcgcacccacaagacacccagtggacccggaaaagtccaacagggccctggggtttccagctctggttacgggcctctatcagtcctacagggtgcccgtaccccccggcaaggtcacgtcatcatagggatcgcgcctgcaagacacccagtggacccgaagaagtccaacagg

SEQ ID NO: 49251 - DNA, 216 bp, Glycine max
  Peptide Sequence Number=SeqID_140936
atgtctttagaggttacttcctcgttgacatcttttgtcttgaatggaattgccatgacagaagtagtgtctagtccttggaggtttacagtagggaactggttatgtgactcagatctggttagtcctactggaattgaacgggttctaaccgaaaaagatcttttggctgattcatattcagacctagaggcttctatcctagatgaaaaataa

SEQ ID NO: 49252 - DNA, 1303 bp, Glycine max
  Peptide Sequence Number=SeqID_140937
atggcgagccaagagaagtggggcccgtttgcggatgttttagctttgctgatttttggggttgtcctctttccgaacgttgacggcttggtagacttagccgccattgatgctttcctcgcatatcaccatagcaaggaaagtccaatggtggctatcttggcagatttgttcgacacctttgaccggaggtgcgagaaaaacagtgcacggattgtctgttgtttacccgctctctgtgtatggttgatttcacacctgttccgacaagacacgagacacccgtgtccgcttcaaagctatcgctcgtgcgccgaaaaaggaagaatcgtttgggaccaacatttggctgggatggggggcagcatgatcaattggtttcctcgttggaaggaaggcaaggaaggagttcttttctcgtgtggggactatcctaatgttccactgatagggactaggggttgtattaattataatcccgcattcgccataagacagctagggtatcccatgagcggagcgccaaccgaagaaagtctctcgcctttccttgtgagggatctaggcacgcaaggtctcaaggttatacaaagaatccacaaggcgtggaggagttcgttgaggaaagacaaggagcttagggacatccgaaacggcatcattggaggttatcatgggtggctaagaattcacacgcggggcttaggttggctctccaaattgaaagttgtcgatgaggagaaattcgaagctccggaggaagatgaagaagtccgagctctaaagttagagctagggaaggcgagactcgccaaggagaagttcaaatcagctgctacacacatccggaaggagtgcaccgagttacaagaggaaaacgcggccactgcaagagctcttgaacaagaaaccaaaagggcccgcaaggaggaacatggccgagaaaaattccgaggagcattgtggggtagcaacaatgatctcaagctccgaagagaggagagagatcggtcacgggtgcatggcatgatcttaaaagaagagttagttgcttgcgcaaggtccaaaaggagtttggctcaacacttggaagccacggagcaaagcatgctagccatcataggacaatacaaggaagaattgaaccagtccatggcccatgaacaaaagctagtggaggattttgcacaagtgtatgctgaaaaagaagcaagagggagggtgattgatgcgctgcatcaagaagcgactatgtggatggatagattcgccttgaccttgaatggaagtcaagacctcccac

SEQ ID NO: 49253 - DNA, 783 bp, Glycine max
  Peptide Sequence Number=SeqID_140938
atggctatgaagaactctccacgaagaggtctagaagagacgccgcagcagaagggtctagtgccacccccaagtttgatagtcatcatttctagagtgccaagcaccagcagcgaggagatagctcacagacgttggacgtcgctggtgactcccatggctaagtttgaccctgagatagtcctggagttctatgctaatgcttggcccacagaggagggagtgcgagacatgcgttcgtgggtgaggggtcagtggattccctttgacgtagatgccctcagccagttcctgggccattgcccagctgttatgcacactggggcaggatttcgcccggaccgctacagggaggcgggtgcggatcatgcgtaccagcatgaccactttgacctagacgtggatgacactgctgctccgcaatttggtgtataccatcctgacacggatgatcgtccacgtgtcccaggttcccgtcacccctataaagtgatccgaccgctgatcacccgagccttcatcgagaagtactgcacgcccaggcaggcgcagggtgatgcacatcaggctgcagacgcactatcaccacctcagcaggccgatcccgctggatcactaggcatagagcgttatctgcagcacttggttcgccagcaggcggccaaccaccatgggcaggcaagggaggagcctgcaggatcccccagtgaggcagaggaggcccgtatggatgatgatatgactgacttgctcggtttcttgggaggaagcggagccatgtga

SEQ ID NO: 49254 - DNA, 210 bp, Glycine max
  Peptide Sequence Number=SeqID_140939
atggcagagttatgtttagtgcctgacatctccatcccctcgaagttcaaggaagatgggggcatactcctaagacgagaagctcttaatgcatttcttccaaaagagcttggctggggcggcagtcacctggtataccaacttagaagctacccggatcagctcttggaaggacttgatggctaccttcatcaagcagtatcaatataa

SEQ ID NO: 49255 - DNA, 330 bp, Glycine max
  Peptide Sequence Number=SeqID_140940
atggtggcccaagcccgggctgttgatatgctcgtggagacgtcatcatcgcgattgtggatggcagcgcgcgcccttggcgtgcctcggcactgcgcgctcctggcgtcggcctgtgggctccccattcggcccgtcttgaaacacggaccaaggagtcttggtgtgacatgtgtgcgagtcaacgggcgaaactggcgatgcgggatgaaccggaagctgggttacggtgcccaactgcgcgctaacctagaccccacaaagggtgttggtcgattaagacagcaggacggtggtcatggaagtcgaaatccgctaaggagtgtgtaa

SEQ ID NO: 49256 - DNA, 192 bp, Glycine max
  Peptide Sequence Number=SeqID_140941
atggttgctgggaatacaacaatagaaaagcctagggaagattggagtgaggaagaaagaagactagtacaatataacttaaaagccaaaaacataattacatctgccctaggaatggatgaatactttagggtatcaaactgtaaaagtgcaaaggatatgtgggataccctacaagatgaatacaaatga

SEQ ID NO: 49257 - DNA, 53 bp, Glycine max
  Peptide Sequence Number=SeqID_140942
gctaagtccgcaacattgttttctcttgaggatcaagcacagttctctttgag

SEQ ID NO: 49258 - DNA, 183 bp, Glycine max
  Peptide Sequence Number=SeqID_140943
atggttaaggaggagtgtaaggaggttattcctcaagtaaaggagttgtttgataagggtttggtttgtaagagcttaaatccttgtgctttgttggtgcccaaaataggtattattaggcaccaaatccctaaaatagatggtatgatgaatgtgttgagtggtgcaaccctcttttgttaa

SEQ ID NO: 49259 - DNA, 306 bp, Glycine max
  Peptide Sequence Number=SeqID_140944
atgggtgccatgtacctcgaagtggtcaaacgagggtggcaccccaaaatggatggtccccggacgaaattaggcctgggcggcaaggcgcagaacgaccataatttgtctctgcgtgccaccggacatgatcgcctctggatggcgaaaagaatttgtctctgcgcatttatcactcgactcgctgctcctgaacgacaaagggcgcaaaagacgttgttagtctctatgcgtttatcactcatcgagcgtgcggatgaccgtaattggtctccacatgtcattgggcccgccgcctctggatga

SEQ ID NO: 49260 - DNA, 192 bp, Glycine max
  Peptide Sequence Number=SeqID_140945
atgaacaactccaagaagtcaaatagatcaaacaaggttgcttcaaaggataagcattgcttcaagattaatacaaggttgcttcaacaaagaaagccttgcttcaagattaactcaagatcaagccttgcctcaaaacaaagtgtttccaagacttccaaggctctggtaatcgattaccaggcagtgtaa

SEQ ID NO: 49261 - DNA, 471 bp, Glycine max
  Peptide Sequence Number=SeqID_140946
atgtccttaccttcagagggctacccgccctcgccttgggtactagttaccctcaccttcagagggctacacgccctcgccatcagaggactgcatgtcctcaccttcagagggctacacgccctcgccatcaaaggactgcatgtcctcaccttcgtagggctacacgccctcacctttagaggactacacgtcctcgccttcgtagggctacacgccctcacctttagaggactacacgtcctcgccttcgtagggctacacaccctcacctttagaggactacacgtcctcgccaacagagggttgcacgccctcaccttgagaggactacacgtcctcgccaacagaggactgcacgtcctcacccttagaggactgcacgccctcaccattagagggctacgtgtcctcattttcaatgtgctccacatttgcaccttaagagaatttaaggtcctctgtccttaa

SEQ ID NO: 49262 - DNA, 126 bp, Glycine max
  Peptide Sequence Number=SeqID_140947
atgtcgcgaaacttcacggattgcctaacgatgggtgttaagtacctcgaagcgttaagcgaaggttgcatgccaccaaacaatggtccccggacgaaattaggaactaagattggtataacatag

SEQ ID NO: 49263 - DNA, 270 bp, Glycine max
  Peptide Sequence Number=SeqID_140948
atgtctgaagaagttgatatgaatgttgaaaatgaggaagatgttggcgtgaaagtagaacacgttgattgctctgatgtctttaatacttttcagttgtttgctacccatgatgaaattttacattgggctcaatcggtggctcatgaaattggatttgttgtcgtaataatgaggttagacacaaatactagtgttagaggaaggacctcatttctattaatagcttgcaaaaggagtggtgaatataggcctaagaagaatgatttg

SEQ ID NO: 49264 - DNA, 345 bp, Glycine max
  Peptide Sequence Number=SeqID_140949
atgcctacccctcaatggcatattcgaggtgaggctcaaagtcggctagattatggtctcagggtgcttcatgtgtctcccccatgggttgagagtgatgcaatcctccctaggaaaggaccagttaccagagccatgagcaagaggctccaagaggattgggctagagttgataaagaaggccttagggttctcatgaaccttaggctaagctctagcttctcaaggaagcttctcaaggagcttctcaaggaagttttctcaaagaaacttctcaaggaagttttcttaagaaagcttctcaaggaagttttcttaagaaggcttctcaaggaagctacctag

SEQ ID NO: 49265 - DNA, 288 bp, Glycine max
  Peptide Sequence Number=SeqID_140950
atgcactctatcagcttcttgctctgccagtatctcctggctaaggtgtgcgatatatatccacgcattgaattggctaacagccaaaccaaatacgccaaatacagtgattcaaaaagcattcaaatgcctaagctgcaccgcatttcagtaagttgcagatcagatgacgagagccatgagcaaaatgacggcgacagcaacgaagtctatttcgttgaagcctttgggaagagacggcaccgtaaggcgccatttggtggaggagattccgattgtggtgcatag

SEQ ID NO: 49266 - DNA, 421 bp, Glycine max
  Peptide Sequence Number=SeqID_140951
gactacatcgtcctcgcctaacagagggctacacgccctcacctttagaggactacacgtcctcgccaacagagggctgcacgccctcacctttagaggactacacatcctcgccttcagaggacccttccacgactacatgtcctcaccatcagtagggctgcacgccctcacctccggaggactacgacgtcctcgccttgaagggctacccgccctcgccttgggtactattaccctcccttcagaggactacacatgcctcgcctttagagggctacatgccctcacctttcctgcaccatattggagggcgccaactgtgcgagccccagaggcaactgctatgcatatcggggcaaggattttacccgtgcctcgccttgagagactagtgcggatcaagctcaccaaggcatga

SEQ ID NO: 49267 - DNA, 246 bp, Glycine max
  Peptide Sequence Number=SeqID_140952
atgcgtcctccacccacgagtttggagtgcatgcgtagtgattgcttagtgcaattctccattctcaacccctcttttcggagccccatgaattgcgttttcgttcatgcgtcctccacccacgagtttggagccatgcgtagtgattgcttagtgcaattctccattgtctacccttttttggagccccatgaattgcgttttcgttcatgcgtcctccacccacgcgtttggagtcatgcgtag

SEQ ID NO: 49268 - DNA, 213 bp, Glycine max
  Peptide Sequence Number=SeqID_140953
atggcacgcaacgtgtttgcttcgtgcccctatttaagggacctatatgggagagagctaaaaaggcttttagtgatagcccccaaggtggtcatatctctcttgatggtctctagaggtatcatcccctttgaagaacatattgcagcagtagggactactagcaacaataagttttcaaagagaaaagctctagatgagggttcactgtaa

SEQ ID NO: 49269 - DNA, 582 bp, Glycine max
  Peptide Sequence Number=SeqID_140954
atgtcctcaccttcagagggctgcacgccctcacctagaggactacacgtcctcaccttcagagggttacacgccctcgccatcagaggactgcatgtcctcaccttcgtagggctacacgccctcacctttagaggactacacgtcctcgccaacatagggctacacgccctcacctttagaggactacacggtctgcacgccctcacctttccagagggctacgtgtcctcccttttcagtgtgctacatccgtcaccatcagagaatttaaggtgcaccctcacctttccagaggactacatgcctcgccttgagagggaacatactccctcgccttggaggacttacatgtcctcactcatcagagggctgcacgccctcacctccagaggactacacgtcctcaccttgagaggactacatgtcctcaccatcagagggctgcacgccctcacctccagaggactacacgtcctcgccttgagagggctactcgccctcgccttgagagggctactcgccctcgccttgggtactagttaccctcatcttcagaggactacatcctcaccttcgtag

SEQ ID NO: 49270 - DNA, 393 bp, Glycine max
  Peptide Sequence Number=SeqID_140955
gacatccgagtaaaaagattttgtcgtttgaatttggtcgaagcttctgtactaaattttgagcatctcgatatattacgggactcaatcggacatccgactaaaaagttattgtcgttagaatttgctcagtgcctcagttttcaatttcgagcgcctcgatatattacgggacttagacatccgagtaaaaagttattgtcgtttgaatttgactcaggagcttccgttttcaatttggagagtctcgagatattacgggacgaaatcggacatccgagtaaaaatttattgtcgtttgaattttgctcagagcttcaacattcaatttcaagcgtctcgatatcttacgggactcaatcggacatccgagaaaaacgttattgttgttag

SEQ ID NO: 49271 - DNA, 805 bp, Glycine max
  Peptide Sequence Number=SeqID_140956
gtcgactctagaggatcccacgatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcagatttggagagcatctggaataactagtgaattacaactctattgtaccgcaattggtgcattggtctttgcagccttaatggtttttgctggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatggtaagagattatgatccgactattcgatacaacgatctattagatcgtgtccttagacatcgcgatgcaatcatatcacatcttaactgg

SEQ ID NO: 49272 - DNA, 161 bp, Glycine max
  Peptide Sequence Number=SeqID_140957
gccacttgtctaacagtatccctaatgaagagcaaattgcacatgaagttaattatatggggaatcagcccataggcaatttcaatacaagtggatttccaggatttcaccctggtaaccaattcaatagagaccaaggtggttcatctacaaggccataa

SEQ ID NO: 49273 - DNA, 381 bp, Glycine max
  Peptide Sequence Number=SeqID_140958
atggagagaagtatgatagatgctgccagtgctggagcccttggagacatgacccctgctgaagccagaaatttaattgagaaaatggcttcaaactcccagcaatttagtgccagaagtgatgctattgtcattagaggagtgcatgaagtagccaaaaattcatcaggtgagactaagaagcttgaaggtaaactagatgtcttggttaacctggtaacccaactggccatgaatcaaaaatctacacctgtcgccagactctgtggtttatgctcctttgccgaccaccacatagacatttgcccttctgtgcaacaatctgaagcaattgaacagcctaaagcttatgttgcaaacatctacaacagacctccttaa

SEQ ID NO: 49274 - DNA, 324 bp, Glycine max
  Peptide Sequence Number=SeqID_140959
atgtcgatctccccctgcggaaggattgcacccacaaagacacccaatgaactcggtgaagtccaacagggccctggggtttccagctctggtgacgggcccctgttagtcctacagggtgcccgttccccccagcaaggagtgcctgctgcccccaacaaggtcatcatgccccctactaatcaagctttcatcaagaagtattgcgccctcaggcaggcgcagggcgaaacaccacaacagtctggggatggccgacagcgggcaacagacgcaccgccaccacctctagagttcacctcagctcatccacaaaaaggttag

SEQ ID NO: 49275 - DNA, 389 bp, Glycine max
  Peptide Sequence Number=SeqID_140960
gcccacttgtgccttccaagaagttccccaaaaaggcaccgccttctggaggaagcaacctagctcgcctaggcgagctaggtggcaagctcctccctcattttcctataaatagggagaggagggaagaacaaaaatgttcaaccttcctggtagatttaaagggaaacacctttggcatattggcggcacatcccttaactcctctgttgtccctgcatcatcctgattactctgatccaatctttccaaacaggacaactaaacaagctccgaagcatttgtctgaagctgcaaatgtggattcccagaggatgaggcaacaagcaatatgctatgacagatggttttcatggacagtttcagtgtcatggggctatgctgttcag

SEQ ID NO: 49276 - DNA, 180 bp, Glycine max
  Peptide Sequence Number=SeqID_140961
atggactcgggaaggttccaagttagtgtaccaggggtatatcacaaactgcttgcccttcagtggcatatccgaggcaaggctcgaagtcagctagattgtggtggggcatttcatgtgtctccccctcgatttgagagacatgtgcatgatcagtttggggttgtcggctctcaatga

SEQ ID NO: 49277 - DNA, 84 bp, Glycine max
  Peptide Sequence Number=SeqID_140962
atggacaatagccccaggaactacagaagttttggatactttatatttaacatcaagtatttcatgaaggcaaatattgtctaa

SEQ ID NO: 49278 - DNA, 438 bp, Glycine max
  Peptide Sequence Number=SeqID_140963
atggcgttagtgagggccaacatcgaagaggactccgaagacacaatggctcgtttcctgaatggtctaaacctgaaatcagagatgttgttgaattacaggagtatgtggtgttggatgacttgttacatagggcgcttcgggttgaacagcaaattaaaagaaaaagtgcaacaaggaggaactcacccaatacttacaaccaaaactgggccaacagatccaagaaggagggaggtaattcgttccgacctgcagccacatccccgtatggaaagtcagcaacacccagtaggacatattgcttctgaatgtccaaccaggaggaccatgatcatgaaggctgatggagaaatcactagtgagtctgaaatcagtgaagaagaagtggaagaagaagagtatgaggaggaagctatgcagggtgatatgttgatg

SEQ ID NO: 49279 - DNA, 951 bp, Glycine max
  Peptide Sequence Number=SeqID_140964
atgggatcaagtcaaaagccttcgcttaaaaagaggttctatcaagtcaaaatcaagagcttagaggtcactagtttacgagagttggggcaattaatgggtcaacttcaacggcaagccttccgcaaagccaatggtaagatttgggacctagctagggtagaagtctccatggaaccgattgcatccctttcccagtattatgaccagcccctaaggtgtttcacattcgaggacttccagctagtgccgactatgaaagagtttaaagaaatcctgggatgcccactgggaggaaagaagccatatcttttctctgggaaagggcaaaggccttggaaaatcaaggcgaatgggctttcttttattgacatcttggcgcttttgatctttggagttgtcctatttccgaatatggaagggttagtggacctagcagtgattgacgcgggccgcgcctttcatcatggcaaggaaagcccggtcgtcgccattttggccatgtatgacacgttcgaccggggatgcccgtctatccgctacaaggaaggaagaatcaggattctatcttcatgcgaaggatgtccaaatgttcccttgatgggaacaaggggttgtattaatcccgtcctcgccataagacagcttggctaccccatgagaggagtgccatcagacgaaagcatcacgcctttcatcgcacggggtttcagtgaccacaacgcgagggacagagagcttaggggaagcagtaatgggatcatcggcggctatcataagtggctaagagtccggacacaaggattggattggctcccaaatctaaagactgtgagagacaatgaggttaaagcttcggaagacagtgatgaggtacaagccctaaaggcaaagcttgaaagagctcgggtagtcaaagagaagttcaagtccatagccatcaaagtctga

SEQ ID NO: 49280 - DNA, 831 bp, Glycine max
  Peptide Sequence Number=SeqID_140965
atgccgcaccaacccgcaggggctatgattgtgattcgctgcggcggggacattcccggtgcgttctgtcgccaccgttggcagaccgcccatccgccagctctcctcggtggcgctttgaagccatccacaccgagctgcgcgcccgcaagtcggcaccatgatgccgagccgcgtgccgccgtgcgtctggcgcaggccgaagtcaacagcgctgaagccacgctgcgccaggcgcagcagcagctttcccgctttgaaagcctgggcagcagcaaggccatcagccgtcatgacgtggacaacgcgcgtatgcagcgcgacgtcgcccgcgccgcgctggagcaggccaaagcccggctcgacgcacgcaacgtcaccctgaactacacccgcatcacctcgccgattgacggtcgcgtggggcacagcaacttccacgcaggtagcctggtcaaccccgcaagcggcgtgctggtggaggtagtccagcttgatccgatccgcatcgcttttgcgctggaagaaggcgcctttgccaccaaagccggacagcatgcagatatcagcgccatgaaacaggcgtggcaggtattcattgacagcaacggacagcgtatccgcggtgaactgacctcggtggataaccgcatcgacccgcgcaccgccaccgagcagccggtactgacgctccctgccgctgcggtccagcagaatggcgatggattctttgcctgggtgattgcttccggtgttaagcctggtgagcgagcgatcactgacggtgcacagcgtgtacagcccggtgctgccgtccagatactgaattaa

SEQ ID NO: 49281 - DNA, 552 bp, Glycine max
  Peptide Sequence Number=SeqID_140966
atgcaaaccaccagctccattggtgcgtttgctgtggctgtgacacgtggcgaagacaccattgccactagcaggttccatggtgtcgccagccccattggcgatttcgccatgcaagggggagtagccagtcaaactggcgagttccaagcacagggcacaggcttctcagcctttttaggctttttagttggcaggctttttcaattggcaggggcaggggtacgggctaaagggaaggtatatgaagagaatgatggtgtaatatttgaaggcagtaaaaaagcgattcagattaaacgtggaattagtttcaatgctttgaagaaaaaaattggagataaggatgtggctggtggttctatgtttcattttgcaaattctctttcatcatgtggaaataatttatctaataatgaggcgcaaccgccaagaaatgtgagcaatttacatggtgatgatgatgatgattattattattatcttgtgtctaactcatacgtggaagagtctttagacgaagatgatagtacagctggtgggagcctctag

SEQ ID NO: 49282 - DNA, 264 bp, Glycine max
  Peptide Sequence Number=SeqID_140967
atgaatgtaaaaataagagaagatatggtggtgtgctcccaaagggaaggggaagttgaaggggaatcgggacacgacaacgccctccgcgctagtgagcacctccactgcgtgatgcgtagcgatgactactctcctgactggcgggtgcagttctacgtgtttccctacgcccgcacccaatcgatgctccacgagttcagacaatgtttcttgaagaagaagatcatcgacgtgaggaaagagtcgcgaattcgagaatga

SEQ ID NO: 49283 - DNA, 278 bp, Glycine max
  Peptide Sequence Number=SeqID_140968
gtgctgtgtccaaggatgctctgattgctgaactcaaggacacatgcaaggtgctggaagcaaccatcaaagccaccacagagaagaagatggagctggaacggctgatcaaaaggctctcagaaagtggcattgatgatgaagaagcagctgagcaagaagatgaagcagctgaggaagaggtagaagcagccgaggaagaagaagaagctactgaggaagaggaagatgcagcagaggatacagaatcagatgatgattctgaagccaccccatga

SEQ ID NO: 49284 - DNA, 189 bp, Glycine max
  Peptide Sequence Number=SeqID_140969
atgactgtggctgaatatgcagtcaagtttgaggagctggtgaggtactttccccattatcaagggagagatggtgaaagttctaaatgtgtgaagtttctaaacagcttgcgacttgaagtgaaacaaatggggcatatccagagagattgtccatatgctaagaaggagcagaatggtggggtctga

SEQ ID NO: 49285 - DNA, 381 bp, Glycine max
  Peptide Sequence Number=SeqID_140970
atggttacttccatacttcaacttaactcgatgaaccttttcgtaaaagcacgagcttggttctaccccataacccagagaaaggcacttttgatcgccaattcttcatcaacatttcatagggatgaaagactcgggaatacgcatgcagtgcatggaaaatatgggtttatgatcccaacatggttggctcatgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 49286 - DNA, 459 bp, Glycine max
  Peptide Sequence Number=SeqID_140971
atggccttcagtgcgacagatgctggtttgttgctgttgccctcagggattgcgctggtgttgaccattccgttggcgggccggatggcagacagattttcaccccgacgtattaccctggcaggcttggccatattcggtgcctcgtttttagtctttgtgtttgtggcgatgcgggtgcaatactgggagatcgttgctgcgactgtggttggccgcattgggttggggcttattttgccagcgttaaatctcgccaccctgcatgaaatggaaccccagcatctgggacagtcatctgtggtggtatggggctcagtggcgccaggcgtgtttcaggcctatgcacaaggcttcttattgctgtctgtggtgtttgtgctggcgatactggtggcgatgggaatgaaggatgcaaggcgccaaggtaatcaactaccatcaggccttgaggactaa

SEQ ID NO: 49287 - DNA, 267 bp, Glycine max
  Peptide Sequence Number=SeqID_140972
atgcagtatctaggaagtgatcctaggtcgtctcccgacgagcaatggttacaagaatttatccttaatcagttttgtggaagcaatgccttcaaaggttattttgatgatgccaaagaattcaagaatcaagagaaagattcaagagaagtttcaagttcaagttttcaagaatcaagaatcatgaataatcaagaacaagattcaagaatcaagagaatacttaatcaagataagtatgaaaaggttttttcaaaagctgagtag

SEQ ID NO: 49288 - DNA, 546 bp, Glycine max
  Peptide Sequence Number=SeqID_140973
atgtctgaagctccaaaaaaacgctggtacgtcgttcaggcgttttccggttttgaagcccgcgtagccaagtcgctgcaagagcatatcaaactgcacaacatggaagaactgtttggcgaagtcatggtgccgactgaagaagtcgtggaaatccgtggcggccagcgtcgcaaaagcgaacgcaaattcttccctggttacgtactggtccagatggtgatgaatgacgccagctggcacttagtgcgcagtgtaccgcgtgtaatgggcttcattggtggtacctctgaccgtccggcaccgatcagtgataaagaagtggatgcgatcatgaaccgcctgcagcaggtgggtgataagccgcgtccgaaaacgctgttcgagccaggcgagatggtgcgtgtcaacgacggcccgtttgccgacttcaacggtgtggtcgaagaagtggattacgagaagagccgcctgaaggtttctgtttctatcttcggccgtgcaacgccggttgaactcgactttgctcaggtggagaaaggttaa

SEQ ID NO: 49289 - DNA, 603 bp, Glycine max
  Peptide Sequence Number=SeqID_140974
atggcccgcaagaagaaaacaagggagatgacgactgaggccgcaaaggaaatcgctgagaagatcccctttgaggagcaagccacacagggatccttcgtcccccatggacgtcaggatgttctcaccgctgctattggacgttcagagcaccctggacgtgtccgtgctgctggagctggtgtcactatcaagcaatactttggatcagctccacggacgtcccgcaactcttcctccctgcctcccaaagaattgcagcagttaacccaacaaatcagggaccagctagaggagtccatcacagaaaaagtgatgcggcacctcatggcatcattcagccagatgcagtcccagattcagtcccagatgcaatctcagggacttgcactgcctcccgaccctctggttggtcccttcggtcctcgagtaagcacaaaggggagttgtgttgatccctcaggaaacgaccctgagacgggtgactctgattggtgcggcttgtacatagaagcagatcttgcccacctggttgccatgggaagagtttatgagggatccactgttgttcataacactcctttgttgcctggccaagtaaag

SEQ ID NO: 49290 - DNA, 228 bp, Glycine max
  Peptide Sequence Number=SeqID_140975
atgtctgtttcaagtcttgggtctcattctccccttgaccgcattccagaatattttttcaaggtcttagctactggtgttgtggctgatggtatgccactgatgttcaacagggacaaggagccttgcttcctattctattggcagtcagaccctaccaggttcaagtcatatgacaaggatctgctgacccttgtggagagggctgacaaaacaattttggagtaa

SEQ ID NO: 49291 - DNA, 216 bp, Glycine max
  Peptide Sequence Number=SeqID_140976
atgagccagatatgctgtggtcatttcatagcacttgtatgcagacacaataacgtgggtgggtatttggcttgggcctcgtcgtctgaggcccagcaattccagtggagtctgccaagaagagtgagaaaaactttaaccaaaagaaaggaagagacatttttatcaatcaagtgtatggaggtaactaatagtcttaaaggattcaagtattaa

SEQ ID NO: 49292 - DNA, 821 bp, Glycine max
  Peptide Sequence Number=SeqID_140977
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgagaattaggctcccctgatctttgccatgtggtcaaggcaaactcaaaatcagttccaaaagagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49293 - DNA, 357 bp, Glycine max
  Peptide Sequence Number=SeqID_140978
atggaagggttagtggacctagcagcgattgacgctttcctcgcctttcatcatggcaaggaaagcccggtcgtcgccattttggccatgtatgacacgttcgaccggggatgtgaaaagagcagcgcaagaattgtttgttgtgcactggctctctatgtgtggctggtttcacaccttttttctccaagaaggggttgtattaattataatcccgtcctcgccataagaccgcttggctaccccatgagaggagtgccatcaggcgaaagcatcacgcctttcatcgcacggggtttcagtgaccacaacgcgagggtactccaaggagttcgcaaggcatgggatgcggcgtga

SEQ ID NO: 49294 - DNA, 258 bp, Glycine max
  Peptide Sequence Number=SeqID_140979
ctcatggcgtaatcatggtttctatcagctgttccctcctgttcagctactgacggggtgggcgcccctttcgccatcgggaaacctgcgcaactgcttaatgaggcaacccgggcgatcgagtgcggctttcgctattacgccagctggcgctaaagggggatgtgtgcatactggcgattactatgttggcactgtaacgccaggcgtgaacagtggctacaacggggcggaattcgcagtggaaattaatgccag

SEQ ID NO: 49295 - DNA, 276 bp, Glycine max
  Peptide Sequence Number=SeqID_140980
atgaaggccatgaaagagcaaatggccacaatgatggaggccatgatgagcatgaagaagataatggaagccaatgcggttgcagttatcgctaccagcgctgttgctaaggtgaacccgatgcccccatctggcctcaaccatctgaatcatccaacctcagctagggtaggccaaatgaaccctatttatgcgcaattcaaacaagcatgccttcccaccatatggcttgcctcccaactatacacaacccaccgtggcatacactcccgatga

SEQ ID NO: 49296 - DNA, 123 bp, Glycine max
  Peptide Sequence Number=SeqID_140981
atgggagattcggttagcgcgcgaccaatcagtcaaaaaagttttactaagttacctgagcttagcgaatcaacctcgcttagcccagtgtactgtaccaggtggatgaatgttcgtccttaa

SEQ ID NO: 49297 - DNA, 189 bp, Glycine max
  Peptide Sequence Number=SeqID_140982
atgaccaaacttggtctctgcgtgccatcggacacaactgtgtctgaatggcaaaggggtgcggataaccgtaaggtatctccgcgtatcatgggtgcggataaccgtaaggtatctccgcgtatcattgtgtgcagaatgaccaaacttggtctctgcttgccatcggacacaactgtgtctaaatag

SEQ ID NO: 49298 - DNA, 342 bp, Glycine max
  Peptide Sequence Number=SeqID_140983
atggaagtgccttttgtttgcaagccaaccgaagaacaaacagtgaggttaaagattcaccatggagggatgtttatttataatccatttattgtgtatgtcaatggtcaaatcgttgaagaagaatggggttgggatgtggatattgtgtcgtatattgacgtcacgaaggtgattaactctctcggactgaacttatggtctcctttacaaacaccagtgatgcttcgaccagtgatgaggagagcccctggaagaccaaagaaagcaaggagcaagagaaatgatgagtctacgaataggttcaagctaccaagacagtcaaaaatcagttgtttgtaa

SEQ ID NO: 49299 - DNA, 727 bp, Glycine max
  Peptide Sequence Number=SeqID_140984
atgtcgctcaaatgcggaaattccgctaataggagaaaccaagggagagtcagggaattcggcgtatttttgaaatcccctggcgaactttccgatatcgtggctggcaaggagccagattatccagtgttcggcatctactcccccgcatgcggcaacatcgaggcaatggttatccctgctgacgcggggaacgtcgtaacgtccaacaccggggcagcttcgacaactgcatcttactatggaatgggcgttcagatcatcagtgcctgcgtttgtaatgcactggcccttttgggccagttcttctggagacactggatggatttaattacggaaaaatggcttcccgtcatattctcaagcggtgaaaaaacgaggatctcattactcgatcttctggataatcgtattcaggaccttgcatatccccgggccgattttcagggggcggcatggcaaatgctaattggtattttacagtgtactgtcgcaccggaagataaagaggattggggggatatctggcaggatggtatcgattctgaaaactggatatcggcgttacagactctatctttcgctctacagttcggcgagcaaaagccttccttcctgcaaagttacgatcccctcgatagcgattatggttctatatccgggctactggttgacgcgcctggcggtaataccctaaagctcaataaagatcattttgtaaaacgcg

SEQ ID NO: 49300 - DNA, 279 bp, Glycine max
  Peptide Sequence Number=SeqID_140985
atggcgcctcaacgcctaactcacaaaaaggtccccagtgaagtcgccaactgtcgcaacatgcccttttgcgggcgagtgcgaggcgaggctcacgggtgcgttttccaaggaggaaaatgcgcggagtcgccaccaacgtttatttgtggaaaacgtctgaaaaaccgaaggaaaccggtcataaagaatattccgagttcgggagttgtatttacgtttgaggaaggtattagcacctctcacgtttgtctcaaaggacaacagcctattttttag

SEQ ID NO: 49301 - DNA, 579 bp, Glycine max
  Peptide Sequence Number=SeqID_140986
atggtggaggccatgatgagcatggagaagataatggaagccaaagcagttgtagttgttgctaccagcgctgttgctaaggtgaacccgatgcccccatctggccttaaccaaatgaatcatccaacctcagatattgtaggcaaagatttgggaagtatgggcggcccccattatgcgcaaattcaaatcaagcacgccttcacgccatatggtttgcctcccaactatacaccacccaatatggcgtacactcccaataaggatgtcaataactccgctcccatactcattgaaagccaacaacctcaatctgatcatgccactgaaaggcaagcagttggtggcatacccctgcaaaacactttggagggccctcagttttgcccacaaccacaacccttgcattttgcggtgggaagagcccctcctgctatggctgaaaagggaaagttggatcatatagaggaaaggctcaaggacattgaaggaggcgaagattatgcctttgctaacctggaagagttgttcctagtacccaaacatggtcattcccaagttcaaggtgtcggactttga

SEQ ID NO: 49302 - DNA, 308 bp, Glycine max
  Peptide Sequence Number=SeqID_140987
cgataggcaatgacattcatggggctcggaaaaaaagtggagaatggagaattggcgaacaacgctacgcaataactttgcgggctccagactcgtacgtggaggacacacgaatagcactaggcaatgacattcatggggctccgaaaaaaagtgcagaatggagaattggcgaacagcgctacgcaataacttcgcggggctccagactcgtaggtggagcacacagaatagcgctaggcagtgacattcttgggctccgaaaaaaagtggagaatggagaattggcgaacagcgctacaaaataa

SEQ ID NO: 49303 - DNA, 324 bp, Glycine max
  Peptide Sequence Number=SeqID_140988
atgtttcttcatgtcggactcagccaacaagttgtgattgcgaagcataaaggttatgtgagtggtagcttgtcggatgaggggaaggttgaacttggaggagattctggtaaatcagaaagttctttggagaaaggcttagttgatcgcagtgacgcttcagatgttgatgctaaagtagataacatggcgaggtgtttcagaaccaaccagaggatactggtattgtcagcagccaaagttgccaaaaagatgaagctaaaatttactaaagaatggattgcatatcttagattgcctcttccaattgatgtttacaaagag

SEQ ID NO: 49304 - DNA, 411 bp, Glycine max
  Peptide Sequence Number=SeqID_140989
atgactcctgaaggccatcatagatttgtttgggaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49305 - DNA, 369 bp, Glycine max
  Peptide Sequence Number=SeqID_140990
atgaaggatgacataggtcacatcttagacctcactcccaaaggagagaaaatgaaagaaagccttaagaggctaacattaacctcccatacttccatgggaaggacaatgacatattacctctcaatgccccaccacgaaaccatgattatgaagggccaagacatttatagtagccaagatgaggctactacttcacattcctctagtgaaagtgaagaagcaaaagggaaagaatctagtgaagaaatctacccccaagaagaaggacaacctttaaaggttaaggaggagcgtaaggaggtatgtgtctcctccaagaggttagctaagaagggaaagtcattttacaataaagacaaacattaa

SEQ ID NO: 49306 - DNA, 641 bp, Glycine max
  Peptide Sequence Number=SeqID_140991
tggtgcatgttgatcctgctaccaggaaggccgacggtcctcacaggaagaaattaagaacatatttagggattgtggcacgtgataaggtggacatcacctacgagaactggaaggaggtccgtactgctcagaaggacctgatttgggaggatattcaggcggaatttgatatcccagaggcttctgacaacctcacgaggaaatgggcccttgcagccgatcaggacagtgccgaggacactgtctgtgacaaatacgacatcagcaaggaaaagtgggcccagttttgccagactcgcagagacccttcttgggaggccatccagaagcagaatactgccccccacgttttgtctcatgggggttatgattatttggagcagaagctcctggctgagaagacgaagaagaaggtgcaggaagctgcacagtcaggaaacgttgatggcgtcatcgaccctccatccctggtcagacgccacgtgaagtggaagatggcccgtacgaagaagacaggggagatgacgactgaggccgcaaagaaaattgctgagaagattccatacagggatcgttcgtcccccatggacgttaggatgttctggccgttgctattggatgtccagagcaccctggac

SEQ ID NO: 49307 - DNA, 651 bp, Glycine max
  Peptide Sequence Number=SeqID_140992
tgcataactaggggcaatccatgtgatttacaaccctttgatcctgaaatagatagaaccattcatagattggttaggcatagtgtgcatcctggtcattctatgcattttgagcattctgagtattctgttgctggtgattctgaatattctgattttgagcatttgactactaattttcatactgagaacatagctcaacctccacctcatgagaggactcttagggaaatgactgcacctgatttcacttatgaaagcttgtgcattcaatatcctgatgagggtgttccatatgttctcaagactggactaatacatttgctgcccaagtttcatggtcttataggtgaagatcctcataagcatctcaaggagttccatattgtttgttccaccatgaagccccctgatgtccaagaagatcatatctttctaaaggcttttcctcattctctggaatggcaaaagattgactatactaccttgctcccaggtccattttcagctaggatgaccttaagattggctatactaccttgctcccatgaatcagaaatctacacctattgcaagagtctgtggtctatgttcttatgcagatcaccatacagatctatgtccttctttgcagcaatctggggtcaatga

SEQ ID NO: 49308 - DNA, 387 bp, Glycine max
  Peptide Sequence Number=SeqID_140993
atgaacttaatcattgttatcaacggaaagggacacgctttacgacgcccttaccgaactcgtgctagagctagagtaatgggtgaagtagaggagatacaagagaagatgaaggccgacatggaggccattaaagagaaaatggccacaatgatggaggccatgatgagcgtgaagaagataatggaagccaatgcggttatagttgccgctactagcgctgtcgctaaggtgaacccgatgctcccatctggcctcaagcaaatgaatcatccaacctcaaatatggtaggcaaagatttaggaagtacggacgaccccatgatgtgcaaattcaaaacgagcacgccttcccatcatatggcttgcctcctggggatcctctag

SEQ ID NO: 49309 - DNA, 548 bp, Glycine max
  Peptide Sequence Number=SeqID_140994
cccaacatttcattggagacccatccttgtggaaagataggtctgcagaattattgtcaaatcttaagtgtagaaccttagcggattttaggtggtatagagatactttcctaactagggtttacacaagagaagatagtcaacgacctttttggaaagaaaaatttctagctggtcttcccagatcattaggagacaaggttagagataaaatccgtagtcaatctgccaatggagatattccatatgaaagtttaagctatggtcaattaatttcttacgtccaaaaggtagccttaaaaatttgtcaggatgacaaaattcagaggcaattagcaaaagaaaaggctcaaacaaagagagatttaggttctttctgcgaacaatttggtctaccggcctgtccaaaacaaaagaaaaaacaatcctctaaaaaggaaatccatgagaataaaccgatcaatacaaagagatttccaaggaggagatactcacacaaaccatcaaccagtagaggaatggaaaatcctaaacaaaaaacaaaataa

SEQ ID NO: 49310 - DNA, 215 bp, Glycine max
  Peptide Sequence Number=SeqID_140995
atgaactatctcttcctgaaaatctgtgtactcatcgtccctgagctagtcgcgtctctctcggtggaacgaccatcctttgacggcctcgaaacgctgctggtgctctgcgctcctgaaacgatggctgtcaaactcaggagcggcgctggttcctttggtcgcggcgtccctcctagatctctttacggagagcttcctcagtggtatttcct

SEQ ID NO: 49311 - DNA, 532 bp, Glycine max
  Peptide Sequence Number=SeqID_140996
ctaacatcacatgatgctttgttggcacagaacaagttgctatctaagaaccttgagatcctaatggaaacacttggttgtaccatgtgtggtgaagctaatgagacaggccaatgcatccccactgaagaaaacactcaagaaattcatttcatgaggaatcaacagaggctagggtatactcaaggaggattttcaagcttccagcaaggtccttataatcagcaaggacagacgactaagttggaagagaccttgactcagtttatgcaggtaatgatgtcagatcataatagtattgagtcaacactaaaaaaccttgaggttcaggtgggacaactggccaagcagatagttgacaagtcattcaacagttttggagcaaatacaggcaataatcctaaggaggaatgcaaggctatgatgactaggagtaaaaagtttgtggaagctgaggatgaagagagtgtggtgtacaaggagcaaatgggtgaaaagataggtgctgaggttaaggaaaatgatgtgaagg

SEQ ID NO: 49312 - DNA, 893 bp, Glycine max
  Peptide Sequence Number=SeqID_140997
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatcacaagtacaagcacatggttattgacacaaaacacacaagcacacatagcaattacatacagattgatggtcacaataacatgcaaacaaccaagttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49313 - DNA, 288 bp, Glycine max
  Peptide Sequence Number=SeqID_140998
atgcggggttaccttatggttacccacacctttcgtcaaccaggggaaaacgagcccgttgaagctcgaagacgaacatcgttttctgcaccttttgtcatcctgacccgtcaagtcagggttatccgcacctttcgtcaaccaaaggcatacgagcccgttgacgcaaggagactaacatcgtcttctgcaccttttgtcgtcctaacccatgaagtcaggggacatacggggttaccttattgttacccacacagttcgtcaaccatgggcaaacgagccaaatga

SEQ ID NO: 49314 - DNA, 273 bp, Glycine max
  Peptide Sequence Number=SeqID_140999
ggtagccccccgcttgaccgatttatcggaatcagaggaggttttgagctcgacccaaaacaacggctaacgagcccctatcagagaaagcctttggttaaggagaggggtgaagcttgcttacttgttagagtaaggggaaagggcttttcgaaagctcaatcccttgcttgttgttttcgagccggagctcgctgggtagtgaagtggtccgtgaagattgaagcagctgttggagagaagacaccagtcagacctgcaagcaccgggtag

SEQ ID NO: 49315 - DNA, 869 bp, Glycine max
  Peptide Sequence Number=SeqID_141000
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcggatatattaatgcagcggtcaattatggtggtgatcagggtcatgtcagcgctaaaatatatacagccgaagctatgtcgtcagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49316 - DNA, 552 bp, Glycine max
  Peptide Sequence Number=SeqID_141001
atgagggcttctggtaatcgattaccaagggagtgtaatcgattaccatgcttagaattggaggcagcaggttgtagaggcctctgggatgggtcactggtaatcgattaccagatcgtgatggcgacacagctaatccatgatcgagtagagatggagtgcctagagggagcttgggagaccctcgaaggcaacacgaggtgccgatttcggggcactattcgatttacagcaacttctttggtgcatccagatgaacccatgcgcacgcttcagcgcactgtggagtggatactacccacgcctacaccatactgtctagtggagccagtccaagtgatcgaggtgacgtcgtccgaggaagaccctgaggaggatcccgaggagctacctcctgagcctgctgtggatgctcttgactttctagagggtgatgaggacccacttcctgaggtggattctcccgaggaagtcatgtcggcatctgaggcagactctacggaggatagtggcccgagagagatggcgaccagtggaggctcttcatcatag

SEQ ID NO: 49317 - DNA, 315 bp, Glycine max
  Peptide Sequence Number=SeqID_141002
atggcgattgaagatgagagctcttatgttcagcagggcctagtggaagcacttgatggagaagacaaactcgaaaagatgatggctgatggaggaaaagaaagcactactgcagaagggcacacagtgcaaattatcctcagtcttggagacaaagttgttgaggcaaagactttactgtttggaagagactctgtatctcttgatgaagtgcaggctgctctgaattcaaaggaatcaaatgaaagaaaggaaaagaagtcctctacaagaggtgaagggctgacagcaagagggaagccttcaagaaagata

SEQ ID NO: 49318 - DNA, 504 bp, Glycine max
  Peptide Sequence Number=SeqID_141003
atgaagcacttcactgacaccctcatcagtgccaacataggaaacattggaagccaagacagtgtgaggatcggaaaagtggttcatggcactattgctgcgccaatacatgtttattgctggttgctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49319 - DNA, 669 bp, Glycine max
  Peptide Sequence Number=SeqID_141004
atgaagcacttcactgacaccctcatcagtgccaacataggaacaaaagctggtaccgggccccccctcgaggtcgacggtatcgataagcttgatgccagccagattagataccccattctgcgagccattcagaagtggctttcaggtttccttcactgccgcaagaacagtgacggtgtggtcaccaatagagatgcttacctgactagaggacaccgatgtaatgttggctacatgtacctccaagctacaccaaggccacatcatcattggtgctttcattgccaagttggcacactacctggcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49320 - DNA, 714 bp, Glycine max
  Peptide Sequence Number=SeqID_141005
atgtttgttgacccagcaaatgcaaagacggctacattgggtgaagttgcggaggcattacaatacatggtgtctcctcaagggaggaatacatgcacatttgatgatctcgtgccttatgtggaaaaaattacaattttatccgaagagcaagagagagtcactgagccagtgtcacatggtcccgcatcagagcgtcaatttcctgcacaacagtttcacatgcttcagtcaagtattgaaactcaggggatagacagaagaagggacattgttgaagcggaagaatattcccaacaaatggcggagcgtggccatggaatgtattacacgccacaaacatttgctgagtatccgacccagatgtatcaatatccttttcagggtcatcacactgatacttctgcaagccagcaatcgttcggtggtgttgcggaaacacaagctcatttttcatggcccacaatgaccccttcacagcaatatcatggcccaattccaacacctaatgccccgttaggaacacaatggaatgtaccgggaccaatacctaatacgggtgacttattcggtgttgatttgcggcacgcattttctgcggagctgacgaagaagaagcggggaggcatcggggcagaagaaatcctgatcgccaagcacgaagatgggatcgacatgtggcacatcctcacgacatcacggacaccaaaatga

SEQ ID NO: 49321 - DNA, 282 bp, Glycine max
  Peptide Sequence Number=SeqID_141006
atggagtcgccaaaagctgttcgaaccttacccgttcggcgggagggcgagcgagactcgaagacggatgaagaacgaatgttccaccaagaacgtcgaagaacggttcgccaccaacgtttggaaatttcgacggaaaacgttcggaaaaacgtttcggaaaagacgcctcggcttgattttctcacggaaacgatttttccaagaaattcgaaagagagagaagtgatttacgcaaacggggcaaacattttcagcatccccccgtccgcccatttatag

SEQ ID NO: 49322 - DNA, 579 bp, Glycine max
  Peptide Sequence Number=SeqID_141007
atggaaacatgtttagcagtggaggaccttttgcaacagatgatagatcaaggccgactggaagtcggcgatgaggggagggaagagcagcatatatgtatgcagtccacagatgagagaagttttggaaggcctaagcctttggtggtatatttcaccaaagacgtaactccccaaataccccgatacccctcggtagttaaacctgttctgttcccataccgaaacagccacacagtcccgtggaggtatgcacctccaagtgaaaggaaggaagaggccaccgacatcagctctttgtcagccaaggtgaccaatatcacggtgctgagcggcgtgacccgcagtggtcgcgtgtttgcaccccccgacctgccgacacaacccgcaaatgttaaagggaagacaaagatggtggaagaacaagatgacaaaacgaccctcactccgaacgaggatattccagtgaaaggtctttcggagaaaagggatggttgtggcaagaaggaagtatcgctagaggaggcaagcgagttccttcgcattattcagcaaagcgagttcaaggtcattaagtag

SEQ ID NO: 49323 - DNA, 408 bp, Glycine max
  Peptide Sequence Number=SeqID_141008
atgagaggccctctcaaagagtcaacctcttgctttcttgtaaggttaaagtcctttggtacttgtacctattggcttgcctttagaggactacatgtcctcaccttcaaagggctacacgccctcgccatcaaaggattgcatgtcctcaccttcagagggctacacgccctcgccatcagaggactgcatgtcctcaccttcgtagggctacatgtcctcaccttcgtagggctacacgccctcacctttggaggactacacgtcctcgccaacagagggctgcacgccctcaccttcagaggactacacgtcctcgccttcagaggactacacgtcctcgccttcaaagggctacacgccctcgccatcagaggactgcatgtcctcacctttagaggactacat

SEQ ID NO: 49324 - DNA, 465 bp, Glycine max
  Peptide Sequence Number=SeqID_141009
gatgtgcgcaaaaaggcacaggccatccagaagcagaacactgccccccacattctgtctcatgggggttatgactatttggagcagaagctcctggctgagaagaccaaaaagaagctggaggaagctgcacagttaggaagcttttatggcgtcatcgaccctccatccccggtcagacgccacgtgaagtggaagatggcccgcacgaagaaaacaggggagatgacgactgaggccgcaaaggaaatcgctgcaaagatcgattcctttgaggatcaggcgacacagggatccttcgtcccccatggacgtcaggatgttctcgccactgttgttggacgtcgagagcaccctggacgtgtccgtgctgctgaagccggtgtcaccatcaagcaatactttggatcggctccacggacgtcccacaactcttcctccttgcctcctgaagaattgcagtag

SEQ ID NO: 49325 - DNA, 604 bp, Glycine max
  Peptide Sequence Number=SeqID_141010
acatgatttggaaattcccaacagtgaaaatgctcagaattgggttgtgaaccttgtgtttcaatttcacgacgatccaacggtgaataagtctgagatcgtcatttttctgagacagggatgtctaactgattatccttcagaacgacagtttgatgaatgcctgaagaagttcaaaatggcttactcaccttggccaatgtttgttgactattgtgttgactatgctggaaagaatccctcaagttgtggttgtatggtgagaaccacgcttggtcttccttgttcttgtgagctatccaaatatgttggtggttgcatcccactggattcaatccatatgttttggaggagactaagtttttcagaccaagggttatgtgagcccgaagtgagcatcaaggcagaaatagaaacaatatccaaaagatttgaagaacttgatgttagcacaaagggggcaccaaagaaacctatgagcaggaacccaaggtcaacaaagcgcgatccatcttacttggagtatgtagatgcctttgaatctatgcaaaatagcaattcatcggtgaggcgtagtgcatcatcctctgagcaaccgaattga

SEQ ID NO: 49326 - DNA, 655 bp, Glycine max
  Peptide Sequence Number=SeqID_141011
atgaaggtcacagccctcaaacaaaccagccacgacatgattgcacacataggaaaagctcgagctgcagtggaagagttgaagaggtttcttgtagctgattcgctggaggaagtgaataaaaagctggataagttctatatggttcttatcttgaggagtcttcattcagattttgatcatatgcgtgatcaagttcttgctggagatcaagtaccatcgatggattctctcatcactaggctacttcgggtgccccatgtgctgaaagaagaaaatccagctgacacgatggaaacatcagccatggttgcaactcgtgggagagggggaggccgtaacagtagaggaggtcggagtagtagaggtggacgtcctcaatgctcttattgcaagaggatgggccacactcaagagaattgttattctctacatggctttcctgataaagtagccaaggtggctcagacagaaaaatcagagtccaagttctctaatgaagagtaccaagagtatttgaagctgaaatatgagaaatccagcagtcaagcctcatcttcctctgtaccatgttactcgacggcatgtatttctcaatctattgacggtcccagtccttggattcttgattcaggtgcctctgatcatatttctg

SEQ ID NO: 49327 - DNA, 758 bp, Glycine max
  Peptide Sequence Number=SeqID_141012
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcaaccgtaaatccatcagggcgatcaacataatgaatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49328 - DNA, 432 bp, Glycine max
  Peptide Sequence Number=SeqID_141013
atgggaggaaggattaagttctttgaccgcgtgttcaatagacattggcgatcgggaacttatatcctcgtttgtcgagaggtggcaccgggagacaagtactttccatcttctagtgggggagacgccctacgtgacctcactcagactaggaggtatgcatggggagctgctggcctcatccacatgtacgatcaccttaatgatgccagtatcaacactagccgacaggttactggttacatcacattgttacagtgttggatatatgagcactttccgtcaattgcagagtgcaatgctgatctggagtacgacgaggtgtcaccacgtgcgtgtcggtggattgccacaaagaaaactgtcaagaagatatctacatcgatgtacaggcagcgcctgaactgtctcaagattccaaatgtctgctag

SEQ ID NO: 49329 - DNA, 270 bp, Glycine max
  Peptide Sequence Number=SeqID_141014
atggtgggttacacaccttcaagctttgcggatttggtcttcgctgagggtgagaatgagggagaaacccatgctgtgactgtcattcctatacagccaagtttcccaccaacccaacaatgtcattactcagccaataacaaaccttttccttacccaccacccagttatccacaaaggtcatccctaaaacaaccacaaagtctgtctactgcacttccaatgacgaacaccacctttagcacaaaccaaaacaccaccaagaaatga

SEQ ID NO: 49330 - DNA, 251 bp, Glycine max
  Peptide Sequence Number=SeqID_141015
atggacgttgttagaccgggagtagtcccgcaatccgacaatatccggaagtggtcaatgactttgggaacttgggagctagcatctttagtaagtgatccagttgattttcaagctcatcatgggaagttgctcagaattcttagagtagatgttgaggaaagatgcctagagaccctggttcagttctatgacccgctctaccattgcttcacatttcccgattaccaacttgtccccacacttgaaga

SEQ ID NO: 49331 - DNA, 630 bp, Glycine max
  Peptide Sequence Number=SeqID_141016
atgctgccaccggccgagaacagcgcgatctcgacgccggtcggatcgaaggtggccaggtcctggaccgtaaccttctggccgttgaattcgatctcgccaccggccgaacgctcggaggccaggacgctcagggtgccgaccgggaaatcacgctcggccaggatcgacaacatggtctcgccgaccgcaccggtggcaccgacgacggcgacgtggaaactgcgctgtgcattgctcatgggggaaactctcacgaaaacggggataggaaaaaaacacgcacgacagctgggttcggggaacctcctcaagcggggcgcgcggaggttccctatcgtttcccgcgttgatcgcgctcggcatgcgcgacgggccgccgtccaggccgagcccggcaaccagattatcgacggccagctgtaccatcgccgtgcgcgtggccagcgaggcgctgccgatatgcggagtgagcaccacgttgcgcagcgccagcagctccgggcgcaccttcggctcgccctcgtacacatccaggcccgctgcagccaggcggccgttggccagtgcatcggccagcgcgatttcatcgaccaggccgccgcgggcgatgttcaccagcgtcgctga

SEQ ID NO: 49332 - DNA, 255 bp, Glycine max
  Peptide Sequence Number=SeqID_141017
atgtcctcgccttcagagggctgcacaccctcgccttcagaggactacacgtcctcgccttctagagggctgcacgccctcgccttcagaggactacacatcctcgccttgagagggttgcacgccctcgccatgagaggactgcaagtcctcacctttagagggttgcacgccctcgccttcagaggactacatgtccttacctttagagggctacatgccctcgccttgagagggctacatgcctcgccttga

SEQ ID NO: 49333 - DNA, 411 bp, Glycine max
  Peptide Sequence Number=SeqID_141018
atgatctatgaagcaccaacaccgacacggacaccggacacgaacggatacggacacgtggacacctgtaatgtccaaaatatagaacgtaatacgtgtgtcgtgtcagtgtcggacactgacacggacgcgtgtcggacaccggacacgacaagacactggagtggtaaggttgcgtacaacatccctcccccataccttcgcatagcgaagagcctctgggcaatggggtacgaaaaaatgttagctaacttcaccctagagcttgcaatcccgactaggttggcaccccaaacactaaagatcccccagccactaaccaagaaattcattgcaaaagatgaagaaaatacagaagaccatggggggcatgaaccaaacccatgggagggaaatcaagagaatctatag

SEQ ID NO: 49334 - DNA, 1224 bp, Glycine max
  Peptide Sequence Number=SeqID_141019
atggcgactctgaatctgttctctcagccatggcaacctacaatttcacctttttgttgttctaatactaacaacaacaacaacgttgtttatgcttatcataatcataataattctaaattacatttcttttccaattctcgtcaattctctgttctttctcaattgtccaccaactcctcaaaatcagttagtggaagttcagggctgcagaacagttcctttgtttctggcattgagtacaggaagcgtcctctatattctgtatttcccacaaagcctgctcaagtttcctctgtggaagacctctatgaatttatttgctcgggacctttacttgacaaaataggcatcacacaagagcaggtggccgagtccatcgataattggttgttatatggccggtacctatgcagactgtttcagcttaatgaattgttccttacagagcctcaaaaggctaggatttatcattactatgtacctgtctttctctggtgtgaacagcagattactgagcatcagtccaagttcaaagatggagaagatatacctcctttagtgattggttttagtgctcctcaaggttgtggaaagacaacccttgtctttgctcttgactatcttttcgaagtgattggcaggaagtctgcaacagtatctatagatgatttctatttgatggctgaaggtcagaataaactaagagaagctaatccaggaaatgcccttcttgagttcctaaaggcgaattgcctgttgatgcagtctgcattcaatgggagaggtgatcgtgccgatccttcaacatggtcagaagttgaagggcccctgacggttgtgttgtttgaaggttggatgcttggtttcaagccccttccagttgacgcagtaaaggttgttgatccccagctagaaactgtaaataaaaaccttgaagcttactatgatgcttgggacaaatacataaagtcttggatagtcatcaagattaagaacccaaactgtgtcttccaatggcgcttacaggctgagattgccatgagggaggcaggcaagcctggaatgacagatgatgaggtgagagattttgtttcacgctacctgccggcatactatgcataccttcctacactttactcggagggaccaaatggatcagatcctcaacatctcctaactattgaaatagatgaagggagaaaccccatccttgctacctag

SEQ ID NO: 49335 - DNA, 921 bp, Glycine max
  Peptide Sequence Number=SeqID_141020
atgtcatatgttaggaggaacaaagcacttgcagcagaattgagcaagcatgctccaggttccaaggaacttcattttcctacacaatatgcacagccatttttcgttcaatgcaaggcctgccaatggaaacaacactggcgcaaccctccatatactgtagtgaaatttttgttcactacattcgtagcattgatgtttgggacaatgttctgggacctaggattcagaacaagaaggaaacaagatctgtttaatgctattggttccatgtacaatgccattatcttccttgggatccagaatgccttttttgtgcaaccagtggtcgccattgaacgaacagtcttttatagagaaagagcagctggaatgtattcagccatcccctacgcccttgctcaggttgtaatagagctaccatatatttttgtccaagctgtaacatatggcatcatagtttatgcaatgatcggattcgaattgactgcttcgaaattcttttggtatctgttcttcatgtacttcacatttttatacttcaccttttatggcatgatgactgtggctgtaacaccaaaccaacacattgcttccattgtggctactgcattctatggagtttcgaacctgttttcgggatttgttgtctcacgacctttttatattcctgtgtggtggagatggtactattgggcatgtcctgtggcttggagcttatacggtttggttgcatctcagtttggggatgtaacaagtgcagttgagttaaatgagacagtgaaagagttttttagaagatactttggttatagagatgattttgtaggagttgctgcaggtgtagttgttgggtttgcattgctatttgctactatctttgctttttctgtaaaggtcttcaattttgaaaggcgatag

SEQ ID NO: 49336 - DNA, 684 bp, Glycine max
  Peptide Sequence Number=SeqID_141021
atggcatcagatgtggcagtaaaggtaattagttttatacccaattcattattgcaattccatatgttggatcttgtctattgtctgtcatccttgctatcttcacatcaagtagaagttgcaacaccctgtgctattgctttgaatttggtaatctcaaatttgagtgctacaagtgagaaggcagttatggaagcattgaaagaaacagagacttccatgcgtattgttggaaatagaaaagattttgctgaaggtgcaaaaaaaattgaatattttgaagagacgactttgcttttgagcacaatactgtggcgctggcctccttctaggttccctgttgcaagaaaacttatagaggatggagaggtatttccacaaatgtttgtgcttgctcaatgtctattggtgaacttttatttcaccttcactgtgttgatgctctccaactatactaattctaatttctcctttgtctatagcttgagttttgtggatacacttgaaaaatggtgccgaatatgtcaaaaggatattgctgatccttttcaaggcgaaccagtatcaagggctgttctcgtgatgatccattctccacgtaattctatctcctcgcatgctagattcttattattagatgtactgaatgcgaaaggcttgtcaggcttgaaaagcttaatttaa

SEQ ID NO: 49337 - DNA, 1152 bp, Glycine max
  Peptide Sequence Number=SeqID_141022
atgaggctagagacgatatgcaagaaaaggagcgcggtgcagaaatttctgaagaaagacattgccgaccttcttaggagtgcccttgattacaatgcatatggaaggtctttacacttgaagcaggctgaaggagttctggtcgagcaaaatctgacgttttgctatgaaattattggaaaatttactacttgcatattgggtcacgttggagacctttataagcagagggattgccccgctgaatgcaaagaagctatacagtcattgatatatgctgcagcaagattttctgatctgccggaactacgcgagctcagaagcttgttcaccgggaaatttgggaattctcttgaactttacataagtaaagagtttgttgaaaagttgaggcagtatcctccttcgaaagaaatgaagatccagctgttgcatgatgtagcgcaagagttctctatagaatggaatagcaaggctttggagcagagacttcactcaccgcctcagttacatttagagaaggctaaacctgatctactaaatgatcatgaggatcacaagaacaatgatgtctccctatttgaaggaaagaaggataccagtgatgcctattggaggtcgccacgaagcagcactgaagatgacaattcatcgctggacggccataataaggcttgttcaagttcattaggaagcgtatcagaggatgaaacagaaattaagaggccattttcctacaaccttgttccacctccttatgtgaaacaaaaattgaagaaaggtgaaagtaatatgaacaaaccaacaaaatcagaagaagctctcaagctaccacacgaggataacaatactttttcagattctaaaacgtgtggcactgcaaagctagaagactcaagtggaaaggagtcagagaaagcaaagaaacaaccccaacagactaaacctgcagaagaagaagaaaaagaaaggacagtggatgggctcttaatgcattacactaggaaacaatctcctcatccttgttttcaacatgacaagggaccagaaatggtgaggaggacagcgagacatgtgcatcctagtctgccagattatgatgatttgttggctcgtcttgcagctctcaagaagacaacccaaccagcctag

SEQ ID NO: 49338 - DNA, 693 bp, Glycine max
  Peptide Sequence Number=SeqID_141023
atgacaggtagtatagggaccccaaatattaaagtattgaacttgcactttggtggaaaaaaagttggcctctcacgacaatttggtacaagaagctggatcagtaggctgcagtatactagtttggttatgtcacgacagacagttaggtttttagcatcatccaatggcccatcgacagagatccaatttgctgcaaggtcagaaggttctgaagagattagatcttcaggtctgacaagtggagttcctgctcacaaaattatgcgacacaagttcaattggggagttagatttaaaaaaacacctaaaacaaatggatcagttcctacaacttcgttggctgtctcgaagccagtagacccagtaccttcttcagggtccatccagagattcctagacaaagctgctgatgaaggcttggtaataattcagtctccaaaggtgggtttctttaggagatcacggacgataaaggggaagcgtgctccaccatcatgtaaagagaagcaaaatgttgaggaggggcaagtgatttgttatattgaacagcttggtggtgagctgccaattgagtccgatgtgtcgggagaggtcatcaagatactacgacaggatggcgaccctgttggatatggtgatgcacttgttgcaatattgccatcatttcctggaataaagaagcttcaataa

SEQ ID NO: 49339 - DNA, 987 bp, Glycine max
  Peptide Sequence Number=SeqID_141024
atgtctgcacaagggcttttctataggatggttcttgttcatcgattctcaaactctggaactcaaatggggatatacttgagcaagacaaggcggtgcctagttcaagccacacccccatcttcagttattctgaatgcagatggaagtggcaaattttctgagaagcttcatgtcccaaaccttgattcagggaggggtgctccttttgtcattcagggaagtgctgttggtataattggaggagtgtctgtggatgccactctcaaatttttgagaaaacttgtggagtttagttcacaagatggagttaattccaccccttttgtactgtgttctgatcctctcttgagtaaggagcttctgtcctatgaaaggagttattttgtttctagcactagtaaagcagaaaatttgaagcttgattcttctccaatcgtgcaaactcttagaaataagagggtttttcttgagaattcagggactagttgcatagttatgccctgtaatgtgtcacattcttggtatgaacaagtgtcggagggatgttctgttcctgtttttcacatggccgagtgcgttgccaaggagctcaaggaagctaagctaaagccacttgaagccggtagtcctttgcggattggagtgcttgcaacaaatgcaactctagcagctggtttttataaggagaagcttcagaatgaaggatttgacgttgtactgcctgatagagcaacaatggagcatacagtaatacctgcaattgaagctttgaacagaaaggacatggaaggggcatgcaatctattgagaattgcacttcaagttcttttggtgagagcagcaaattttattatcctggcttctgatgatatgcgggacctcttgcccccagatgatcctcttatcaagaaatgtattgatccaatggatgcattagccagatcaactatcaaatgggtaaaatcctctgggcaaaatacatga

SEQ ID NO: 49340 - DNA, 3078 bp, Glycine max
  Peptide Sequence Number=SeqID_141025
atgaggaagaggatagacgagcgaatcagaactctcatagagaatggcgtcaaaacaaggcataggtccatgtttgtcatcattggcgacaagtctcttgatcagattgtaaatcttcattacatgcttagcaaggcacagatgaaatccaagccaactatgttatggtgttacaaccacaagcttcaactaagcagtaaaaaggaaaagcgtcataggcagattcaaaaattgaggctgaggggtcttttggatcacgaaaaagttgatgcattttctttgtttatggaaactaaagatataacttactgtttatataaggattcggaaaaaattcttggtaatacttttggaatgtgtatacttcaggattttgagacattgacacctaatctcctagcaagaaccatagagacagtggagggaggagggttgattgttctgctgcttggttctctatcttccctgaccagtctgtacaccatggtcatggatgtccataaaagatttcgaaccgaatcacactctgaggcagctgggcgctttaatgaacgcttcctattatcaattgcttcgtgcaaggcatgtttggtcatggatgatgagatgaacatattaccaatttcatctcacataagatctattacgccagttcttgtaaatgaggacgctgagggactctcaaaagcaaaacagggcctgaagaagcttaaagaacaactgagtgaaaattaccttgttggattgattaggaagtgttgcacattggaccagggtcatgctgttgttacatttctggatgcaattttgagcaaaacacttcgtggtaccgttgccttgttggctggtcgtggctgtgggaaatcagctgcccttggtttatctattgctggtgctatcgctgccgggtattcaaatatctttgtaactgcacccagccctgataatttgaaaaccttgtttgaatttatactcaaaggttttgaggcacttgactacaaggagcatattaatgtggtgaaaagtgggaagaatacgtatatactgccacacgagcatgaaaagctttcactagctgaactgttggttgttgatgaagctgctgctattccactgtcgatggtgaagtctttacttggaccatatctggtcttcctctcttctactgttaatggttacgaaggtactggacactctttaacactaaaacttttgcatcaattggaagcgcaaagcaatacattttccaagagcacagagggcactgattcaggttatctgtttaagaaaatagaactgagtgaatccatcagatatgcttctggggatcccattgaaagctggcttaacaaattactttgcttagatgtttcaaatgccatccctaatcttagcagcaggttcctccctccatgtagtgagtgtgatctatactatgttaatagggatactctcttttcctatcacagagatagtgaattatttttgcagcgaatgatggccttatatgttgcatcagattacaagaattctccaaatgatatacaactgatggcagatgctccagcacaccacttatttgtgctacttggacctgttgatgaatcaaagaatcaacttcctgatattttgtgtgtgatccaggttagccttgaagggcaaatatctcgtcagtcagtaaaacaaagtttgagcaatggtcatataccttctggagatcaaataccatggaaattctgtgagcaataccaagacacagtttttccttcactttcgggcgctcgcattgttcgcattgctacacaccctgatgacatgaagcatggatatggttcgcaagcagttgagcttttaatacgctactatgaaggtcgacttactcctatctctgggattgacgttgatgatgaagtgcagacttcgcaaattagggttactgaagctgcagaaaaagtttcactacttgaagaaaatataaaaccaagaaaagaacttcctcatttgctagtacatctgcgtgaaaggcgcccagagaagctccattacattggcgtctcctttgggctaaccttggacctttttcgcttttggaggaagctcaaatttgctcctttctacattagccagattccaaatactgtgactggtgagcattctattatggtcctgaaacccctaaacaatgatgaaattaaagttgatggatcaaatcagtggggctttgtcagcccattttaccaagattttaggcaaagattttttagacttctagcttccaattttcgtggcatggaattcaagcttgctatgagcatcctggatccaaaaatcaattttgaagagcaagatccttcaaagactgcttctcataaatttatggggtcagtcagggaatatttatcaccacatgatatgaagcgactaaaggcttatgtttccaattttgctgactttaaccttcacctgattttggatttagttcccatccttgcacgtctctactttgaagaaaagcttcccgttaaattgtcatatgttcaagcttctgtgttactctgcattggcctgcaaaatcacaacattttgtacattgagggacaaatgaagttggaaaggcaacagctattgtctgaatttaggaggataatgaagttgttctacaattatctaaatggccttgcatccaaggagattgaatctaccttgccccgaatgaaagaaatcgtcatggaacctcatagtgtgtctgtggatgatgacctcaataatgctgctaaacaagttgaggatggcatgaagttaaaagcagaagcacccgttactcctgaattgctccagcgatatgcgattgtggaaggagaatctgacttggagacagttttacaaaacaacagaggaaaaatacccattggtggtcttatcagtgtaaaatccagtagtaagcctgagatgatgaagagaagtcgaaagaatgataaaaaacggacaagatttttttggtcacacaaccattttttttggtggaattgctcatacaaccataagctaagcaaaaggagaagaaccatacaagattga

SEQ ID NO: 49341 - DNA, 234 bp, Glycine max
  Peptide Sequence Number=SeqID_141026
atggggttggttggggatgcgttcaagtggcttcgtgccaggtggaactcgatgctagaatcactaagtcaaggggtgtcgattttgggctggccaatggcgacaaagcagttttataacctcaagttgctggagagagaggtcgaggttgcaggaggaaagaactttgagacaaaatgtgaagacattgtggtttggggattagagggtggtagagggagaggatgttggtag

SEQ ID NO: 49342 - DNA, 1245 bp, Glycine max
  Peptide Sequence Number=SeqID_141027
atggtgtacgttcagaagaaggcgtatgcatatacatttgcttcatgtgcttaccgcgaaaagaaggagtttttcttcaccgtgttaattattctgagtgtgattacacccggattgagcagcacaacaactagtttcaatgtgttgcagtatggagcagttggaaatggacaaaccaatgattccccagcctttctaaaggcgtggaaagccgcatgccagagcaactcacatatatctcgcctcatcataccagcaaaacggacattcttgctgaagcctactaccttcagtggtccatgcaagtctaattatacctacattcagctttcagggaacattattgcacctaaaacaaaatcggaatattctggattccacacgaacacatggcttggcttctcattcgtcaatggtttagctatcagtggaaaagggaccattgatggtcgaggctctgcctggtggcaacagccttgcgtaggaaatccactacccgcagtaacattcaatagatgcaatcgtcttcaacttaaaggatatacaagtattaatcccgcaagaagccacatgactctaacaagctgcaagaaaggcataatctctaacatccgtctaattgctcctggaacaagccctaataccgatggcattgatatttctggctcaacagacattcaagtacttaattctttcattgcaacaggtgacgattgcattgctattagtgctggatcctccaagatcaaaataactggtataacatgtggtccaggccatggtatcagcattggatcattgggaacacgtggagagaccgacattgtagaggacgtgcatgtggagaattgtactttgaccgaaacattaactggagtaagaatcaagacatggcagggtggagctggatatgctaggaggatcacgtttgaaaagattagatttgttcgagccaataaccccattatcattgaccagttttattgccctcatagatcggactgccaaaaccagactcgagcaatcaagataagtgatgtaacatacaaaggaattgttggaacatcattgacggacaaggcaatcaatttgagctgtgaccaaaatgtaggctgctccaacattgtgcttgatcatgtttacataacaccttcagttccagggcagaaggttttttcctattgccataatgcacacggaatagccacacacaccaaaccatccgtaaagtgcttgctgaagtag

SEQ ID NO: 49343 - DNA, 816 bp, Glycine max
  Peptide Sequence Number=SeqID_141028
atgggctccaagaacccgtcagtgattgcaatggagcaagtgggactgtatatagcattggaggattggcgtggaaattacctgagggacaaagcatggacgactacttgctcttttggattggacatgatgattcagcttttgctaatgttgtgctcacattcaatgcctatattacctggtgttgggattttagttggaactcttggtgttgctggttatcttcacataatcaatcagatgatggagctcattactggggcaggcaagaaggcatatactttggttatgggaagaccgaacccagctaaacttgctaactttcctgagtgcgatgtttttctatacgtttcttgtgcccaaactgctctgttggatagcaaagagtatctagctccagttattactcccttcgaagcaatgatagctttcaatagaggaagccaatggacaggagcctatgtcatggaatttcgagatctaattaatttgcctcaaatggaagttggaaaccaggaagaagaagcacggttttcattcttgaagggtggatatgttgatgactttgaaaatcaagaaaatgctgaagaagaaagggaaactctcgctctagtaaatgcaacagaaaaggcactgcagttgcagaataactcgaatgctctaatgaaagggaatgcaagatcaggagtggaatttttggcaaatcgatcttatcagggtctgaatatgtctagtgagaacgcctccccagaaccatatctcattggacggagaggaagggcatctgggtacgaggatgagaagaaaaaacaatga

SEQ ID NO: 49344 - DNA, 360 bp, Glycine max
  Peptide Sequence Number=SeqID_141029
atgcaacaccaacacggaggtttcagattcagattattggtctatctctcttccaccgccggtaaaatgagcggggcattattgggagggaaaaaaaagttaacccagcaataccaaacacgcccatgttcctccaaatcaaccgaacatcaaaactacacctcttcttctcaagaggatttagtgtacgtgggaaaactagtggcgggttcttttgcgggtggggctgcaatcaaatatggcagtgctctattccctgagataactactcccaaccttgtggtggctctacttctcattctaactcctgtgcttgtcgctgtttttcttttgatcaaggaaagtcgtacaaacccatag

SEQ ID NO: 49345 - DNA, 888 bp, Glycine max
  Peptide Sequence Number=SeqID_141030
atggaaggaatttctatagctgctatccaagcatgtacaagaaatggtccaaaatggggaggaaccacctccaccttatgtttgcctccaccttatgcaataaactatggaacatcaagctcacttttggataaggttcgtcaagttgcaagggaatttttcgagcagccaatggaacaaaagaagataatttctaaaggagtggaagaatttgaagggtatggtgctgatccagttcctgaagaaggccagtctttagattggtcagatcgtttgtttcttgatgtatctgaagacacaaggaagccaagcctctggccagaaaatccatcatccttgagggatgctgtggaagaatacagcgcaaagatgagagaggcaacaaatcttatttctaaagcaattgcaaagtcactggatttagaagaaaattgcttcctgaatcaatttggtgaacaagctctgctgcaaggacgcatttctcaacggggtaggaagacgaaaagtaaaaaaatattatatgagaaatatgctcctaggtcgacaattaaagatggtcaggttgacagtcatttaaatgacaaatttgtccttttttgccacataatgactaatggaattttcaagagtcccgtgcatagggtactagcaaactccaagagggaaagaatatctgttgcgatgttctataccccggagccaaacaaagaaattggaccagaacaaagtttggtgaatgaggaacaaccaagatattatgctgatacacattggaaatactatcagcgaggaatgagagcaatccatgtagcaaaagatatcacagttgtagctagactgctagagtctagagctctgaataaaataaaacctatcgatgctaattaa

SEQ ID NO: 49346 - DNA, 786 bp, Glycine max
  Peptide Sequence Number=SeqID_141031
atgttctcttacactacacccttcacttcaccctctctactctctctctctctctctctctgcgatctgcttcgtgttgtagctagctcctcgaaaatgctggcacgcctcgccgcgagtcgcttcaacgagatccgtcagattttccgtcagccttctagggctttctcgaccgctctgaactaccaccttgacacaccggacaacaaccctaaacttccatgggaattcaccgaggccaatcaagcaaaggttaaggagattttgtctcactatccatccaactataagcaatctgctacaattcctcttttggatcttgcccagcagcagcatggtggctggctccctgtttctgcaatggatgcggtagctaagattgtagaggttcctcccatacgggtctatgaggttgccacattttactccatgttcaaccgagctaaggtgaaagcttattatgcttttatgctttcaatgttgctaatccacattaatacaggccaaagcttatctggaccaacttgctttcaggttgggaagtaccatctgttggtttgtggaacaacaccttgtatgataagaggttcacgaggaattgaagaagccttattgaaacacttgggagtgaagcgcaatgaagtaacaccagatggtttgttttctgttggagaaatggaatgcatgttgagggcgagccctggtgcagcggtaaagttgtgccttggtgacttgttggtcatgggttcgaatccggaaacaacctctttgcatatgcaagggtaa

SEQ ID NO: 49347 - DNA, 1272 bp, Glycine max
  Peptide Sequence Number=SeqID_141032
atggatggcattgaggatgatgcaaggtatccccctaacccatatggttatggttatcagaattctctatattcccccccagttgatactgaatatgccctagatgataatgatgaaaatgaagagcatgtgcagttagaaggggaagatgaggttgatgttgatcaaagtaacaaccttcagcttccccaaaaggatgatgatgaagaagatggcatggatgggggtggtgatgaaaatgatgatgatgaggaggaggaggcggaagagaataagcagattgattattatcccactaagagtgatgaagatgaggtagaatggcacccaaaaaagcaaaagctcaagagtttgatttcgacctatgaacttgcgcctagagtgccagcaccatcagttgcagctacagctccctcagttcctaaaccatcttctggtggtaggaattcactaactgactggactgagcgagagacgtttgttcttcttgatgcatggggtgataggtttcttcaacatggaaggaagagtcttcgatgtgaggaatggcaacaaattgcaaaaatggtatcacaagtttcaaaaattgaaaggacagatactcagtgtagaaatcgtctggatacattgaagaaaaaatacaagaaagagaaggctaaatttccagatagtgatggtggagcttgcaaatgggtttattttaaaagtatggatgagctaatggcttctcctccgcaacaagctggtctctcttgtggtgtagactcaggagagtatgtttttatgaaccccagagttcatttgaaccatgcaaatgggttggatgaaatgagggatagtcctgacaatacagaatctactggtgaagaaggttctgatggacctcaagcaaagaaaagaaagaagagaaggggcagtggtgaagcttcttccttcaggttacttgctgattccattcagaaattcagtaagatatatgagaagatagaaaatagtaaaaggcagcagatggtggaactggaaaaaatgaggatggatttccataaagagttggaaacacagaagaggcagattttagagaatctgcggtgtgagatttcaaaactagagcagagaaatgatgacaacgatgattctgctgagaatgggttctacaatgttcataattatcctctccctcccaagtcccacctcaacagttaccctgctatccctccacatgcccctcgcgatgcaggaacccatgtgggcatgtggcatgtcccatgctag

SEQ ID NO: 49348 - DNA, 324 bp, Glycine max
  Peptide Sequence Number=SeqID_141033
ttgactgaacgaaatggagaagagcactacacagaggagcaggaggaacagaatggagaggaaggaagccaagaggaggcagttgtagtggatgcagattctacagatggtgcagtactcgttaatggtaacgaggctgacgaagagtggggtacgaataatgaaggagcccctgcttgcgccacatcactaggtcccatcaagacagttggttccagcttctgggatttctatctgaggtcttctcaaggtgccacgaagagattttatggactgtgccctgaattttgtcattttgcgcgtggtatgaacaatattccttag

SEQ ID NO: 49349 - DNA, 1173 bp, Glycine max
  Peptide Sequence Number=SeqID_141034
atgggtgcttctcttcctccaaaagaggccaacctcttcaagcttattgttaaatcctacgaaaccaaacaatacaaaaagggcctcaaagcagccgataccattttgaaaaaatttcctgaccatggagaaactttatcaatgaagggtttgacattaaattgcatggatcgtaagtctgaggcatacgaactggttcgccaaggattgaagaatgaccttaaaagtcatgtttgctggcatgtttatggtctcctgtatcggtcagacagagaatatagggaagcaataaagtgttatcggaatgcactgaaaatagatcctgacaatattgaaatcttgcgggacctatcacttttacaggctcaaatgcgagacttatctggctttgttgagacacgacagcaacttctgacgctcaagtcaaatcatcgcatgaactggattggctttgctgttgctcatcatttgaactctaatgcatcaaaggctattgaaattctggaagcgtatgaagggacattggaagatgattatcctccagaaaatgaatggtgtgagcatggggaaatgcttttgtataagatctccttgctagaagaatgcagattttttcagaaagctcttgaggagttgcaaaagaaagagttaaaaattgtatgtgttttattagttgaggttgataagcttgcatataaagaacaggaggttttacttctagttaagcttggccgcttagaagaaggggagaaattgtaccggacattactttccatgaatcctgacaattatagatattatgaaggcctccaaaaatgtgttggattatattcaaaaaatggtcattattctcctgatgaaatagatcggttagatgccttgtacaaaacacttgggcagcaatataagtggtcttctgctgttaaggagaaccccctcccccagtatggtgatttcctgttgaatgttgaatgggaaattaattgtgaaatgagaataccactggattttttacaaggtgacaaatttcatgaagcagcagataattatattaggcctctcctaactaagggagttccatctcttttctcagatctttcttcgctatacaatcaacttgggaaggagttaggagagaggggagagaaagttagtaacggttggaatgcttaa

SEQ ID NO: 49350 - DNA, 726 bp, Glycine max
  Peptide Sequence Number=SeqID_141035
atggaaaaagagccaccttcaactcttatgtggactttgttcttgttggctcagcattatgacagacggggccaatatgaaattgctctttttaaaatcaatgaggctattgatcacacacctaccgtcattgatctgtattcagtcaagagtcggatactgaagcatgctggtgatttggttgctgctgctgcatttgctgatgaagctaggtgtatggatcttgctgatcgttatgttaatagtgaatgtgttaagcgcatgctgcaggctgatcaggtcgctttggcagaaaaaactgctgtgttgttcacaaaagatggtgatcagcacaacaacctacatgatatgcagtgcatgtggtatgagcttgcctctgctgaaagccattttcgccaaggtaatcttggaatggctctgaagaaatttctggctgttgagaagcattatgcagacattacagaagatcaatttgattttcattcatactgcttaaggaaaatgacgttgcgtacatatgttgaaatgcttaaatttcaagaccaattgcattcacatgcatactttcataaagcagctgctggagctatcagatgttatatcaaattgcatgattctcccccaaagtcaacagccgaggaagataatgacatgtctaagttgcttccttctcaaaaaaagaaaatgaggcaaaaacagaaaaaggcagaagcaagagctaagaaa

SEQ ID NO: 49351 - DNA, 609 bp, Glycine max
  Peptide Sequence Number=SeqID_141036
atggatgttacttccctgggttcaaatagcaatacccaaaccgaccaacaccctctgttgatggagcagccggaaacccgtaatggacaccagcatgtaattgacattacaaggaatggtgaagctctaacaacatcatatcgtaatgatcaacactctgaaatgcatttaacacagaatcaagatcaaccagctggggatgcacaagattccagtcatcaaacaacttcatcttctgcccccagattaaactctagaaattcagcttcattgagaagaggtgatggatatggtcatcgtggaaggagtccattgaattctggactgtggatctctgttgagcttgttgtcactgtgagaatgaaaatccccaggccccattatttgcatggattgtgggctatgggtctggttgtgttgccacacttcccattctctactggcgttttcgaaaccgtaatcaaagcaatgaacaagatacctctcaagcatctcaaggatcttctggaagcaatcctccagatcgttcttatacttccatctatgtttctcatgtctcagatgaggagaatggtcacgctacacaatcagcctcaagaaacactataa

SEQ ID NO: 49352 - DNA, 313 bp, Glycine max
  Peptide Sequence Number=SeqID_141037
ggatatctcgcttagcactgccatacctcttgggcttgaagttactcttcaagtaaaggagttattggatgagggtttggttgcaccactcattgagttggtgaggaaccatgttccctcatgggaagatgcccaggaaaagggtgtcaagagaacgagcccaaagtatcaagaacatcgagatttgaggtcaaatcctttccaaggggaggggatgatgcaatcctaccccccaatggtattggataaaagactacaagaggattgggctagagctgctaaagaaggccctaggattctcatgaatctcagg

SEQ ID NO: 49353 - DNA, 286 bp, Glycine max
  Peptide Sequence Number=SeqID_141038
attcaaaggactaaccgctgagaattctttgtcccaacacattagagggtacatcctttgtggtacaagtagagggtacatctacttggggattgttatactgagaacaagagagggtacatctcttgtggatcagttcaagtggagggtacatccacttggttttttcaaagagaacaagggagggtacatcccttgtggatcagttcaagtggagggtaaatccacttggttttttcaaagagaacaagggagggtacatcccttgtggatctttggcttgtaa

SEQ ID NO: 49354 - DNA, 297 bp, Glycine max
  Peptide Sequence Number=SeqID_141039
gtgtgcgatatatatccatgcattgaattggcttacggcctaaccaaatatgtcaaatacagtgattcaaaaagcattcaaatgcctaagcagcgtcgtattacaagtctcaagatagagaatgaagcttccttggatttgaggacaaatccttttcaagaaggagggagtgatgaggacataaccaaggaccatgaagcacttgaaggtcccatgaccagaggcagacttaaacaagcccaacacgtcatagagacaaggctggtcatttgtatagctgccattgatgatgattga

SEQ ID NO: 49355 - DNA, 321 bp, Glycine max
  Peptide Sequence Number=SeqID_141040
atgtgtcttaatgcggtcctggttgagtttagtcctacaagaggaatctacggacgatgcttgatcaggattaggctaaactatcatgaggaatcgagatctcccacaggcaatttagttcctctggacatagaaattgaggctacattgcgaaggaacagagctgagaggagaaggaaacttctgcaagacagaacagttgcatccattcttgaggaggagacttatttctctgacttattatcacctgattcaccatcatcaagggaatctgccactcaattacctaaagtcattaccatggtagaagagcatgaatag

SEQ ID NO: 49356 - DNA, 252 bp, Glycine max
  Peptide Sequence Number=SeqID_141041
atggattgttacatcagagccttttttagaactctccgtttgagattcattccttttcagtcaaatccttctccttcaataggttatccttctctaagtcaaggtgtcgcaacctacccttcggcgggagggcgacgcgtgactcgcgggtgcgtgttccaagaaaggaatgcgcgcggagtcgccaccaacgtttatttgaggaaaacgtcggaaaaaccggaaaagacgtggtctacgaactttaagtga

SEQ ID NO: 49357 - DNA, 183 bp, Glycine max
  Peptide Sequence Number=SeqID_141042
atggaggctttctcgctgcaaaattcatttcttggttggtactcttggtttgtgctaaaggtggtgttctttgtggctgatttagggattgcctttgtggataactgggcggtgggtaaggagaaggttttttattggatgagtaatgacattgttgggttggtgggaaacttggctgtatag

SEQ ID NO: 49358 - DNA, 147 bp, Glycine max
  Peptide Sequence Number=SeqID_141043
atgttgatgcacaatccgcccatttgggccctccagaagattcctccagaaggcggttacttctggaggaagcaaccctgctcgcctgggcgagctgagctcgcttgggcgagctgggcggcaaccacctcccctattttgctataa

SEQ ID NO: 49359 - DNA, 543 bp, Glycine max
  Peptide Sequence Number=SeqID_141044
atgtcgtctgaattggctcagagcttcaaaatttcgagcgtctcgatatatgacgggactcaatcagacatccgagtaaaaagttattgtagtttgaattatagctcagagcttcaacattcaatttcgagggtctcgatatattacgggactcaatcggaacatccgagtaaaaagttattgtcgtttgaattggctcagagctcagagcttcaacattcaatttcgagcgtctcgatatatgacgggactcaatcagacatccgagtaaaaagatattgtcgtctgaattgctcagagcttcaacattcaatttcgagcgtctcgatatattacgggactcaatcagacatccgagtaaaaagttattgtcgtttgaatttgctcagaggttcaacattcaatttcgagcgtctcgatatattacgggactcaatcggacatccgagtaaaaagttattgtcgtttgaattggctcagagcttcaatattcaatttcgagcgtctcgatatatgacgggactcaatcaaaaatccgagtaa

SEQ ID NO: 49360 - DNA, 501 bp, Glycine max
  Peptide Sequence Number=SeqID_141045
atgagattcaaacacaccccaacacaaatatttaaccctgagatactctttggagtatggtggcgtatgaagctgaaacaaattctagacattgagagacaaagagggatttcagaagatcacatagagaatttagtttctattgtgattattcaccgtccttattttatggaacaaggaaaactctggtctagaaatgaagctcaagtctggggaacctttgaagtatatcccttggaagaaagttatcgtcatcagctagcaaggcatctctgtgagatcaacaattactcatacaaaaatgtagatccaaatctgcccagttcatctcaaaggccaaaggaaagttatcctactgataggataataccccagaatactgatgatggtcaaatccgaacagagttttatgttccagaacctgagtttcaaaaggcagaagatttagctgatgattattcctcattagaacaagatggaaagactataatgctcaattaa

SEQ ID NO: 49361 - DNA, 414 bp, Glycine max
  Peptide Sequence Number=SeqID_141046
atgaaggcctgggtgatcggcggtcgaatcaccttactaggtgtgacgggaaccccaaatgactggcaaagacccgtgatcaatgctggaaaccccaaggccctgttagacttatctgggtctagagggtgcctggatggcatacaccagctgacacttcagcagagggaggtcggagttatgatcgctgggcaggacgttgctgagcagcaatgtcatccatatctgggtcaaggtggtcatgctggagcgcatgatccgcacccgcctcccggcagcggtctgggaaaaatcctgacccgcgggtcacccaggaactggctgaggacgtctacatcaaaaggaatctactggcccctcacccatgaccgcatgtcccgcatgcccccctccgtggaccaagcattagcgtaa

SEQ ID NO: 49362 - DNA, 498 bp, Glycine max
  Peptide Sequence Number=SeqID_141047
atgggttgcatcagttacaatcccgctctcgctataaggcaacttggctaccctatgagaggggcaccactagaggaagagctcgcgcatgtcatttcacgaggtttcattaagaccaacgtggagacacttcagaaggtccgcaaggcatgggaggtggtgcaaaagaaggacaaagaactcaggggcaataacaatgggcccatcggtggctaccgtaagtggttgaaagcacacgtgcaaggtttggattggctcccgagtttgagaaccgctaaaagcgaagaagttgaggcaccagaggaagatgaagaggtgcaggcccttagggcaaaactcgagcaagcccaaacagtcaaagaaaggttcaaatcagcagctcttaagatccgaaaggagaatgccgaactaagagatatgaatatagctaccaccaaggccttggaacaagagaacaagagggctcgtagggaagcgcacggccggaacaagttctga

SEQ ID NO: 49363 - DNA, 528 bp, Glycine max
  Peptide Sequence Number=SeqID_141048
atggtgacgttttatggatgcaagctaaacatgtttcagaacatgtttagaatagggaagaagacaaaaaattacacatcagacgagttgtccccatttatcaagtttctgtgggagccttacacagcaactgttatgtcagtgttgcctccaatttgtttggttggaagtgtagcatggtgcgcgatggtaccattcatttgtttccatgttgttgagtggcaccaacccgatagagttttgcgacaatttggaatgcaacaacctattctcgagtgtccttcgcaaccaccgaatatccatggcataacgctgaaagacaaacaagatggaaattggggacaactgttcgccccaatgatcagtcaatggaacaatcgagttgagtttagggttgatgtttatcctcgacaagagggcctattgagttttaactccgactacatggtcaggtataggcgaaaaatgaagatgtttgtcgacccgaaggatgcaaacacagctacattggtatttatttgtttttga

SEQ ID NO: 49364 - DNA, 269 bp, Glycine max
  Peptide Sequence Number=SeqID_141049
tgctcaaggggttcccatgaaccctaagagaataaaggtcattcctgagtggcccactccaccaacaccactcattgagttggtgagaaactgtgttccttcatgggaagatgcccaggaaatggggaaggacccagagtatgaagaacctcgggatttgaggtcaaatcctttccaaggtggagggaatgatgcaatcctatcccgcaagggcattgggaatcttcttaaggaagcttctcaaggaggtgagcttggttatgagaggg

SEQ ID NO: 49365 - DNA, 525 bp, Glycine max
  Peptide Sequence Number=SeqID_141050
tctagtgaaagtgaagaagcaaaaagggaagaatctagtgaagaaatctacccccaagaagatggacaaccattagtggttaaagagaagtgtaaggaggtaagtgtctcctccaagaggttagctaagaaggaaactcattttacaataaagacaaacattaaagaaactttccctcttagacaacctccacattttctcttttgtaaaaagacacttgctaacattgccacacctcttgggcttaagtttattcctcaagtaaagaagttgttggataagggtttggtttgcaagagcttaaatccttgtgcttttttggtgcctaaaataggggttcccatgaaccctaagagaataaaggtcattcctgagtggcccactccaccaagtataagaaaaatttggggcttccatgacttaacaaacttttacaaaaggtttgtcccatatttttctatacttgtagcaccactcattgagttgttgttgagggaagaagcccatagtttcaagaagctctag

SEQ ID NO: 49366 - DNA, 312 bp, Glycine max
  Peptide Sequence Number=SeqID_141051
atgagagttgttgctgaagcactttctgctagtcttcgggtgtcgcatcacgtggtatacacgcactcgatcaatagttgcgccgatatggtagacgcctttcaccgaagattctattcagtagcccgcaaagtaacctatatggagcttgcggcgactaagcatatgcgggaaccacacacctggctcgagctagcgaacaaccttgctctagcaaatacagcgactcccgcgggtataggcactcaccctaatctgcagctactaatcgaattgcagaatcaagtctacatcgagggtgctcgaatctga

SEQ ID NO: 49367 - DNA, 113 bp, Glycine max
  Peptide Sequence Number=SeqID_141052
gaaatctccgccccgttcgtaagccatttccgctcgccgcagtgacgaccgagcgtaggggcgagtcagtgagcgaggaagcggaatttcctgttcagcccgggggccactag

SEQ ID NO: 49368 - DNA, 480 bp, Glycine max
  Peptide Sequence Number=SeqID_141053
atgaaagaatgcgctttacggtgccctcaccaaacgcgtgctagagctagagtaatgggtgaagtagaggaggtacaagaacagatcaaggtgggcatggaagccttgaaagagcaaatggccacaatgatgaaggccatgatgagcataaaggagataatggaggtcaatgtggctgcaatagtcgctatcagcaccattgctgaggtgaacctaacctccccatatggcctcaaccaaataaatcatccaacctcagatatggtaggtgatgaggacaaggcaaggaataagggcaaggaacctttagaaggacttggaggacctatggcaagggctagaacaaagaaggccaaggaagctcttcaaaaagtgttaaccatgctatttgaatttaggccacaagttacaagtggagaagcttcaggattgttaattgcaccatgttccaagaagagtagagggtgccacttttgttga

SEQ ID NO: 49369 - DNA, 450 bp, Glycine max
  Peptide Sequence Number=SeqID_141054
atggctgatcaaggaggaaaaggaaatagaccaccgaggaggactcttgcactgcttagtctaattggctcacatccctttgctggaatggatcatgaggatccatacacacatttgtctaccttcatggaactatgtagtactatgggagcatctaatgaagatgttgaagctgtctaccttaaagcttttccattttcattagcagttggaggaactatggtgtccaagagtccggaggaagctattgtaatcattgactctatagcagccagtgattatcaaagtcatcatgatagagctctaactcaaagaaaagcacatggtgatggacaacaagaagaggaggcccattatctgcaaaaccaagccattaggcctcaacaaaactttcaaggaagctaccaaggctatagaggtggctcaggttcaaatcagccttatggctag

SEQ ID NO: 49370 - DNA, 288 bp, Glycine max
  Peptide Sequence Number=SeqID_141055
atgcacggagtcgccaccaacgtttatttgtggaaaacgtcggaaaaaccgaaggaaacgggtcaaaatgaaaattctaagttcgggagttgtatttacgtttggaggaagttttttgaggtggacaagagcagggcttttgctcctacgtaccctccattgaagaggaaatcagacctacgtagttcttccttatgcgtgaatcaagtgattgttttttacttgaaaggtgatcattttaaggcgctggaccttaaaaatgatccattttacttggtaagaaactga

SEQ ID NO: 49371 - DNA, 222 bp, Glycine max
  Peptide Sequence Number=SeqID_141056
atgacactctcacttaggaaaactaggcagcaagtgtcgaggttaccctatcgtccacaggaaactccccccccccccctaatggggatcaacctgagtctcaaggaagttccaaaccaagtgacatgcccccaactacaagtatttttcctcttgaaaaactacgagtacttgctgacaaagtttgtaatattttcatggaatatgaagtatgaaacatga

SEQ ID NO: 49372 - DNA, 137 bp, Glycine max
  Peptide Sequence Number=SeqID_141057
atgccaccgaggaaactctccgcaaagagatctaggagggacgccgcggccgaaggaaccagcgccgctcctgagtttgacagccatcattttaggagcgcaaagcaccagcagcgttttgaggccattaaaggatg

SEQ ID NO: 49373 - DNA, 276 bp, Glycine max
  Peptide Sequence Number=SeqID_141058
atgtcagtgcgtagcgctgttcatgtgtcctccattatcaagcgcgaagcctctgatgactgggaaacacgttcttctgttgttttccgaagaaaagaagaaggagtagagacgagagtcgtcatcatggaaagggcaggacggacgaaatcagtgtcctatctttgctatccttttatctctgatgagagatacttggcgccctttgttgcacaatatgtgaagtcccgagacgtgccgagaatcaaaaggaagcaggcttacgcgattctttaa

SEQ ID NO: 49374 - DNA, 459 bp, Glycine max
  Peptide Sequence Number=SeqID_141059
atgggcttcggcatcgcgctggcggtcgccttacacaatattcctgaaggactggccgttgccgggccggtttatgccgccacgggttcaaagcgaacggccgtgttttgggcagggatatccggcatggctgaaattcttggcggcgtgctggcctggctgatcctcggcagcctggtctcgcctgttgtgatggcggccatcatggcagcggtggccgggattatggtcgcgctttcggtggatgaactgatgccgctggcgaaagagattgacccgaacaacaaccccagttacggcgtgctgtgcggaatgtcggtgatggggttcagcctgctggctttgcgctcgtgcgcctggcgatactcgatcagatcttcaatcgtcacgaccggcatgttgtgcagacgcgcgaaggtgatgcactctggcgcacgcgccatggtaccgtcgtcgttg

SEQ ID NO: 49375 - DNA, 291 bp, Glycine max
  Peptide Sequence Number=SeqID_141060
atggcttctaaaacaaggaaagggattcatctaagctcaaaagggctcaggttcaaggctaatcctttcctcagaagcttgcatagagaagcattgcaatcattcctgcccatatgtatgtgctcaatttcagaagatgacatgcctttcaacaagaacaagccaaggagacttcctatgggtgctttgtggcaagcgatatgcccagagagcaaaacatcaagccaatggtactccaatctttcctgcttggctcacaatcttctcacaaaggtagaaatctcttcttga

SEQ ID NO: 49376 - DNA, 735 bp, Glycine max
  Peptide Sequence Number=SeqID_141061
atggatgtggcgattgccatccgtacggccgtgattaaggacagcaaactctatgtgcaggccggcgctggcattgtggccgactcggtgccgcagagcgaatgggaagaaacccaaaacaaagccaaagcggtgattcgcgcggctgagctggaaaaggagcctgatatgttgttgatgattgataactacgactcttttacctataacctcgtgcagtattttggcgagctggggcaagatgtacatgtgcacagaaatgatgaaatcacactcgaacagattaaggcgatgaagcctgaaaaaatcgtgatttctccaggcccttgtacgcctaacgaggcaggtatttctgtgccactgatacatgagtttgcgggcaagattccgctgctgggcgtgtgcctgggtcatcagagtattggtcaggcctttggcggcaagatcatcaaggctaaaaccttgatgcatggtaaaacttctttgatccaccataccaataccggcgtgttcagaaacctgcccaacccttacaccgcgacgcgctaccattcgctggtcatcgagcgtgagaccattccggattgtctggagatcacggcatggacagaagatggtgagatcatgggcgtcaagcataaaaccttggctgttgaaggtgtgcagtttcaccccgagtctattctgacggagtatgggcatgagctgctggataacttcctgaaaggctattaa

SEQ ID NO: 49377 - DNA, 348 bp, Glycine max
  Peptide Sequence Number=SeqID_141062
atgcaatggcggttccaaagtcagaaaagatgcaaagacaacctgaagctaacaagaagcaagcgtagaaccatggtcacctcaaggaaaatgaaaggtcagactagggttttgttctctaccgaaaccgcgaggcaagttggaagattccgcttcagtcgaagggttcctctcagtgtggggttgcaacggagaacaacggcgctttgcgcacactccggacatcttgtcaaagatcccaacggtcaaatcctggaaaattgtcttgtgaagctgcagaccaaatttcgagaagatccaacggttaacaaaagtaaggaatcttttttaccgagacagctcatgtag

SEQ ID NO: 49378 - DNA, 426 bp, Glycine max
  Peptide Sequence Number=SeqID_141063
atggcttacgaacggggcggagatttcctggaagatgccaggaagatacttaacagggaagtgagagggccgcggcaaagccgtttttccataggctccgcccccctgacaagcatcaccaaatctgaccctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtatgcagttcgctcccacctggactgtatgcacgaaccccccgttcagtccgaccgctgcgccttatccggtaactatcgtcttgagtccgcccggagagacatgcaaaagcaccactggcagcagccactg

SEQ ID NO: 49379 - DNA, 255 bp, Glycine max
  Peptide Sequence Number=SeqID_141064
atgaatgaagttctttcaaagttacgaggcctccaaacctatgttggtgaacgctttgattccttgaatggtcgtatcgatgccattgatgctcgctttgaaggaatggatacccgcatcactcagcttgaggaggatgaattaaattgtcatcatcaaaaagggggagattgtagaagcaaagactttgatgttttgatgatgccaaaggatcatgcgtttctcaagtttaactcacagataatcaaagaataa

SEQ ID NO: 49380 - DNA, 603 bp, Glycine max
  Peptide Sequence Number=SeqID_141065
atgggtgatcaagaggagacacaggaacagatgaaagccgacatgtcggctctgaaagaacaaatggcctccatgatggaggccatgttaggtatgaggcagctcatggagaagaacgcggccaccgctgccactatcagttcggctgccgaagcagacccaactctcttggcaactgcgcaccatcctccctcaaacatagtaggacggggaagggacacactggggcacgatggcagccctcacctgggatacaaccgagcggcttacccttatggattgccgcccaactactcaccacccgtcttgcaagacgatgcgggccatattgcttctcccgtccttgaaagagagcctcctcaacagcccgaagaaggccacaaagaccctcaagactacgctcgaagggatgtcgagttctatcccccggtccccgaagggccggcacccagtacgttgcctcaacccaacatcgcgacacaaccaatagttttgtccacggaaggaccgttcccggtaactgaagaaaggaggaagctcgatctccttgaggaaacattgagggccgtggaaggatttggggactatccgttcgtgacatga

SEQ ID NO: 49381 - DNA, 414 bp, Glycine max
  Peptide Sequence Number=SeqID_141066
atgattatgaggggccaagacatttatagtagccaagatgaggctactacttcacattcctctagtgaaagtgaagaagcaaaacgggaaaaatctagtgaagaaatctacccccaagaagaaggacaaccattagttgttaaagagaagtgtaaggaggtaagtgtctcctccaagagtttagctaataaggaaacttattttacaataaagacaaacattaaagaaactttccctcttagacaacctccatattttctcttttgtaaaaagacacttgctagcattgccacacctcttgggcttgagtttattcctcaagtaaagaagtttgatcaaggggttcccacggaccctaagagaataaaggtgtcgagggaaggagcccagagtatgaagaacctcgggatttga

SEQ ID NO: 49382 - DNA, 135 bp, Glycine max
  Peptide Sequence Number=SeqID_141067
atgcctagggcacataaatccacaacacaccatagtgcctatttcgggaaaagagctctggagacaggaagaggagtagcttttgcagggatacctaggtttttccaacaagagggttctgaggacaaagcttag

SEQ ID NO: 49383 - DNA, 117 bp, Glycine max
  Peptide Sequence Number=SeqID_141068
atggtggatgggagaaaagaagaagaaggttgcctatgccacatgtctccatttgagtggagcaagaagggcccactttcccttttggctgtgacccatactcagccacaaaagtga

SEQ ID NO: 49384 - DNA, 405 bp, Glycine max
  Peptide Sequence Number=SeqID_141069
atgactaaaagaagagaaaaattcatcaagaaaagaagaattgacaggcgtcagaatttcaataatggaagaaaatcacaagatgattcacaagtccttaggtgttacaaatgcaaccaaattggtcacatcaaggccaattgcccttcaaatgaagaatggtcggagaaaagtgaaaagaaaagatttgatgaaagaagaactaagaaagcctacattgcatgggatgacaatgattcatccgatggttcagaaaaggagattaatcttctaaccaaagattatgaaagtgatgagaacatctctcaagaattaaaagcaaggagaaaaagtatgatcctcatctctgaagatctagacactttaatcttgaaaaaggtaatatcaaaaccattctcttattaa

SEQ ID NO: 49385 - DNA, 460 bp, Glycine max
  Peptide Sequence Number=SeqID_141070
atgaccaaccctctcaatgagtcaatctcttgctttctcataagggtggacccttgggtactagtacctatcgccttcagagggctacatgacctcgccatcagagggcttcacgtcctcgcctttagagaactacacgtcctcgccttcagagggctacacgtcctcacctttagaggactacacatcctcgccttagaggactacacgtcctcgccttcagagggctacacgccctcgccttcagaggactacacgtcctcaccttcagaggactgcacgtccttgccttcagagggctacatgtcctcacctttagaggactatatgtcctccccttcagaggactatatgtcctccccttcagaggactacgcgtcccagccttcagaggactacacgacctccgagggctatacgccctcgcctttagaggactacacgtcctcacttttagagg

SEQ ID NO: 49386 - DNA, 321 bp, Glycine max
  Peptide Sequence Number=SeqID_141071
atgaggttagctaagaaggaaagtgtctcctccatgaggttagctaagaaggaaagtcattttgaaataaagacaaatattaaagaaacttcccctcttggaaaacctccacatcttctcctttgtaaaaagacacttgttagcactgtcacacctcttgggcttaaggttattcctcaagtaaaggagttgttggatgagggtttggttcgtaagagcttaaatccttgtactttgttggtgcccaaaataggaataatcaacatgaaaatacagaaaaaggggttcccacggaccctaagagataaaggtcattcctga

SEQ ID NO: 49387 - DNA, 99 bp, Glycine max
  Peptide Sequence Number=SeqID_141072
atgactaaagaaaataggggaggagcttgccacccagctcgcccaggcgagccaggttgcttcctccagaagcaaccgccttctggaggaacatcctag

SEQ ID NO: 49388 - DNA, 435 bp, Glycine max
  Peptide Sequence Number=SeqID_141073
atgcagcaagtgcaaagtttcagagctacaagaaatatctcacagtcacttgatgcaatcctccataggaagggaccagtcactagagccatgagcaagaggctccaagaggattgggctagagctgctgaagaaggcctgtcataccctaatttcgtccggggacctttgcttgatgacatgcgacctttctttggtccttgtgaggtgcttggcatccatcattgggcaatttgtgaaattccaggacatgccgaaaaaccaaaaaaatatattgatgcacaatccggcttccgcggcttccgtaatacttctgtaaaatttccgaaaaccatgggtaagcatattccacttaacattggtgaaagggaaaagaaaaaagatgaaaatcaaattcgaaaacagttccgtaaggcttccgtaacttttccgtaa

SEQ ID NO: 49389 - DNA, 414 bp, Glycine max
  Peptide Sequence Number=SeqID_141074
gaatcgcacccacaaagacacctagtggacccggagaagtccaacagggccctggggtttccagctcgggttacgggcctttttcagttctacggagcgcttgtccccccagcaagttcatgccattgtgacatagggatcgtgcccgcaagacacccagtggacccgaagaagtccaacagggtcttggagttgccagctctgattacaggcctctgtcagttctatggagtgcttgtcgcccccagcaaggtcatcaggccccctactaatcgagctttcatcaagaagtactgcgtccccaggcaagcgcagggcgaaacaccacaacaacctagggatggccggcagcgggcaacaaatgcactgccaccacctctagagttcacctcagctcatccacaaaaaggttag

SEQ ID NO: 49390 - DNA, 91 bp, Glycine max
  Peptide Sequence Number=SeqID_141075
agcttgtagaacggttggacatgatatttgtcagggtgttggtttggtcagcagtccaggggtaaagggatgtcccacattatttccatga

SEQ ID NO: 49391 - DNA, 201 bp, Glycine max
  Peptide Sequence Number=SeqID_141076
atgggggcatatgcaaaagatgggaaactgctgatacatttcttccaagaaagtcttactggggcagttgtcactaggtatactaacttggaaggacctaatggttgtaactacagagcatatgcaagagggggcacagatctttcaaagaatacgcctaaaggtggagggatctggcagcacaagtggttccctcaatga

SEQ ID NO: 49392 - DNA, 311 bp, Glycine max
  Peptide Sequence Number=SeqID_141077
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctgattgttctgagcaagagtggcttggtgttgggtgagcttgtggactgcttcctccaagcgttcgagtga

SEQ ID NO: 49393 - DNA, 225 bp, Glycine max
  Peptide Sequence Number=SeqID_141078
atgtggttggacatcatctcagtggatttagtccatatgttctggaagagactttgctttttagaccaagggttatgtgaggtcgaagtcagcatcaaggaagagattgagaccatatctaaaagatttgaggaacttgatgtgtgtgacaaagtaactctcaagagtaaacttcgagatattgcataccctgatcaaaactctatgtgccctcctccgtcaaag

SEQ ID NO: 49394 - DNA, 207 bp, Glycine max
  Peptide Sequence Number=SeqID_141079
atggagcaagttagcataggacaccagaattggggtgagttctacaggcttttttactgcaaaattcctttcttggttggtgttttggtgggttttgtggttgatttagggatgacctttgtggataaatgggtggtaggtaaggagaagggttgttatttgctgagtaatgacattgttggattggtgggaaacttggccgtatag

SEQ ID NO: 49395 - DNA, 216 bp, Glycine max
  Peptide Sequence Number=SeqID_141080
atggaaatgttacggaaacattacggaatcgcctcggcaaatttaagagaatacgaagtgccaagaaggcagaaccctttcctcttcactcctccccctatttatagcaaaataggggaggagcttgccacccagctcgcccaggcgagcaaggttgcttcctccagaagcaaccgccttctggaggaagaatctggaaggcccaagtgggcctga

SEQ ID NO: 49396 - DNA, 462 bp, Glycine max
  Peptide Sequence Number=SeqID_141081
atggaaaaaaggaaaggagggatccctcttctcatgtgggggctacccaaacatcccgttgataggaacgagggaaacttagggggcattcgtaatggcatcattggtggttatcatgaatggctgaaagtttgtacacgaggtttagatttgctctccaagttaaagattatcaacgaagagaacttcgaagctccgaaagaggatgaagaaacgtccggaaagagtgtgccgggttacaagaagaaaatgcagctaccgcaagagcccttgaacaagaaaccaagagggctcgcaaggaagagcatgaccgtgacaaattctgtggagctttgtggggcagcaacaaccaacatgttagctatcatcaccaagtaccaagaagaactaaatctagccacgacccacgagcatagggtggcggacgagtatgcccaagtgtacgcggaaaaggaggcttga

SEQ ID NO: 49397 - DNA, 141 bp, Glycine max
  Peptide Sequence Number=SeqID_141082
ggatttcctatctgttgtacctctcgttacaatctttcaaagaaatgaacgtggattcgaggctttagtcctcacgggcaggatcatcttgggctaccttctgaggtggggaccaaacatggacagtagaaaccaatcaag

SEQ ID NO: 49398 - DNA, 234 bp, Glycine max
  Peptide Sequence Number=SeqID_141083
atgaatgtattgcttagggctgttcatgtgtcctccactttcgagtttggagctgagtttcatgattgcctaagtgcggaccctcaaggcaatcctccatactccacctttgttcggagcaccatgaataagaaaaaagaagaagtagagatgagagtcgtcatcacggaaagggcaggacggacgaaatcagtgtcctatctttgctttcctcttatcttcgatgagaggtaa

SEQ ID NO: 49399 - DNA, 267 bp, Glycine max
  Peptide Sequence Number=SeqID_141084
tatgacagaaattgtctgcgcggaagatgacgtaaatctccgcgtgtcaacgggcttgttggccgcgattgacaaaagtatgacagaaattgtctgcgcggaagatgacgtaaatctccgcgtgtcaacgggcttgttggccgcgattgacaaaaggtatctccgcatgtcacgtgactccagtttcagtatgacagaaattgtccgcacggaagatgacataaatcttcgcgtgtcaacggacttgttggccgcgattgacaaagg

SEQ ID NO: 49400 - DNA, 336 bp, Glycine max
  Peptide Sequence Number=SeqID_141085
atgatggaggccatgatgagcatgaagaagataatggaagccaatccggttgcagttgtcactaccaacattgttgctaagatgaacccgatgcacccatttggccttaaccaaatgaatcatccaacctcatctatggtaggcaaagatttgggaagtacgggcggcccccatgatgtgcaaattcaaaacgagcacgccttcccaccatatggcttgcctctcaactatacaccacccaatgtggcgtacactcccaataagaatgtcaataactccactcctatacccattgagagccaacaaccccaaactgctcatgcacatgtctcttaa

SEQ ID NO: 49401 - DNA, 245 bp, Glycine max
  Peptide Sequence Number=SeqID_141086
atgaggaagtgtggaagggtgagacttccttcttttattgttgaccacagagtggtacctggagatatgtcgcgggggtcaggagaccttggggacgtcaggcgagctcctggcagtcaacagataaaaggaacaaagaccacaaagcaaggaggcttgtgtggtggctggccagctgaggctaagatggtctctggtaatcgattaccaagggagtgtaatcgattaccaggcttgaaaacgag

SEQ ID NO: 49402 - DNA, 348 bp, Glycine max
  Peptide Sequence Number=SeqID_141087
atgactaaagcacgtcaaaagggggtacggaaagaaaaggaaggagatgcttgccacccagatcgcccaggtgagctaggttgcttcctccagaagcaaccgccttctggaggaacatcctggaaggcccaagtgggcctgaactttatggattgcgcactaacacttccttttaattttcggcatgtcacggaacttcaccgattgtgctacgacgcttttcttttggcttccgacatgtttgggaacttcacaaattgcctaacgatgggtgccaaatacctcgaagtggtcaaacgagggtcgcatcccgacaacggatggtccccggacgaaattagggtatga

SEQ ID NO: 49403 - DNA, 384 bp, Glycine max
  Peptide Sequence Number=SeqID_141088
atgtaccctccactagaattgatccacaagagatgtaccctctcttgttctcagtcaacccaagtagaagtaccctctacttgttccacaaaggatgtaccctccaatgtgttaagacaaagttctcaggcgggagaagagagacacaaaaagaattcaggcggttggtccttggcgaattctttttggcaaagggagaagggaatgaaaaagatgaatagcacaattttgttttcaaggtttggaaaaccagaaaactttggaaagcttttggcaaaggaagaagaagaagaagttcaaagagattcaatggttgtaaaggattactcttcatgtctggtcaagagaaccattagaagagttataacctttagaaaaacttga

SEQ ID NO: 49404 - DNA, 483 bp, Glycine max
  Peptide Sequence Number=SeqID_141089
atggcttccaaccccaacaatttaggcaagaaaggatgcatgggcagaaacatgtcagcattgataggttggaggaatcatccaaatctgagatggacaagtcctccacaacaacaacaacatgtccctccaatacaacaacaacagcagtcacaacaaagacaacaagcaactgaggcccctcctcaaccttccttagaagagttagtgaggcaaatgaccatccagaatatgcaatttgaacaagagacaagagcctccattgagagtctgaaaaatcagatggggcagatggctactcagatgaaccaagctcagtcccaaaattctgacaaattgccttcacaaattgtgcagaatccaaaaaatatgagtgccatcaccttgagatctggcaaccaaattcaagtgcctccaccagtagcagcacctgcacctgaaccgtcaagcttccttgtacacctgacaaagaggatgagatag

SEQ ID NO: 49405 - DNA, 348 bp, Glycine max
  Peptide Sequence Number=SeqID_141090
atggtcattattatcaatgcggaagcttgtggttacgtgagcctgaactactaccaatatatagatgttgtttatacaaatgagcacatcttaaaagcttactccccacaatggtggcctcttgggaatgaagcggctattccttcttctaatgacgcatggacacttatccctgacccaactacaattcgtgcgaagggttggcccaaatcaacaaggataaggaatgagatggattgggtcgaaccatctgagcaccgacaaaaatgcagtagatgtggagccgaagggcataacaggcgtcgttgtccaatgcaatttgagcgtgggagttgttcaaatcattga

SEQ ID NO: 49406 - DNA, 359 bp, Glycine max
  Peptide Sequence Number=SeqID_141091
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggtcagacccattccatccaggcctctttgttgggggacgctggaggatttcaaagtcccacacgtgaaccactgcccccacattgttcctttaaaatcggttgtctcggatgacgcttgccctggcgcttgctttgttcaacgcgatgctactactcttagttag

SEQ ID NO: 49407 - DNA, 357 bp, Glycine max
  Peptide Sequence Number=SeqID_141092
atggcaagtaaagtatcggagcagactatggaaggtttggaagaaactggggctgaagctggagctggtaaagatgaagttggagctacagtagaagtagaaggagctgaggtagggagagcacaagatgaaggagcctcagacctcttgcccttagccttgcggggccctcgaaaagtaaccgtgcggtcatcgagaagtgactccccagaccttgcactaggcggtgatgagggtaggaaagccaagcctcgaggagtcatgttgggcaatcagagtaatctgactcgagatgaggtacccgaggttcatatccatcctctgaatgatgtcataaatcaacctagccttgtctaa

SEQ ID NO: 49408 - DNA, 573 bp, Glycine max
  Peptide Sequence Number=SeqID_141093
atggagatagaggagatgcaacaagggttgctaaggctttcaagaaatcatcaccaaggatatgtaaatactggatcaacaacaattgtgtacatggtgaacaatgccttaacgaaacttcaagaacataagaaggttatcactggcatcgcaattcctgttggatccgacaaactttattctggcagcactgatgggacagttaggatatgggactgccatactggtcaatgtgctaaagtcatcaatcttggtgctgaggttacctctttgatcagtgaggggtcatggatttttgttggtctgcaaaatgctgtcaaggcttggaatatccagaccatgtcagagtttactcttgatggacccaaaggccgagtccgtgccatgactgttggcaacaatacactctttgctggtgcagaggatggtgtcatttttgcttggagaggaagctctaaagccgattctccttttgaactggttgcgtcactcactgggcacactaaagcagtggtttgtctggcggttggatgcaagatgctgtactccgggtccatggaccaaagcataaag

SEQ ID NO: 49409 - DNA, 105 bp, Glycine max
  Peptide Sequence Number=SeqID_141094
atgccttctatcaatgagtcacactacgctgatgatgtacacgatcatgggaacaccaccagcatcccctctgcagtcagatatgcagtcagaggtcatgtctag

SEQ ID NO: 49410 - DNA, 456 bp, Glycine max
  Peptide Sequence Number=SeqID_141095
atggacaaaagagaagaagaatttgtagaggttgaagctcaagagggaagccctgtaaatgagcatgatttagaagaagaaaggcatgaagaccatgaggttccaattattctaggacaaccctatctgtcaattgctagttgtgtattaggcataggtgaagaatgcctagtcagtgaaaatgaaggagaggagctagcttgtattgaagagctggatgttccagaacataagtctactggtcatgtgatgtttgaaacattagaaaatagtagaccaatggaaaatcctaaggtagaactgaagacccttccagcacatttgaagtatgtatttaaggaggacaatgaggctaaacttgtaataataagcagctccttgcagaagaaagaagaggatcaactgattcagattctgaaaagtcgccaaagtcgctattggttggcacatctctaa

SEQ ID NO: 49411 - DNA, 159 bp, Glycine max
  Peptide Sequence Number=SeqID_141096
aatttcccttccttggattatagggttaaaccaatctcgtgcttttacgaaaaggttcatcaagtcaagttgaagtatggaagtaaccatcttgcaaaaattggtgcaaaagatggatcatgttacattgttgcttcgtctactgtcaaacacatttag

SEQ ID NO: 49412 - DNA, 480 bp, Glycine max
  Peptide Sequence Number=SeqID_141097
atgggatcttcgatgaaacgattctcgtcatcctttattgtttttaagaagcatggtgatgataaggagtcgctcaaattcgcactaaggcgaagaaggaatcaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49413 - DNA, 669 bp, Glycine max
  Peptide Sequence Number=SeqID_141098
atggggcatatgtacgcctgtcgtggctatgggatatctatcagacaagatgcgaggcccgatagtggattgttgcagcttgtgcttatctgctacacttgtgcaacacatgttcatgtagtgcatttggacacttttcgagacttggctcatagtgggagctatgcctggggagctcctgcgctggtgcatatgtatgaccagttaaatgaagcttctcagaacactacacgacagattgctgggtaccttactttattacagatatatgagcattttcccagtgtgcatgacggtgtcactgatgatggctacgatgagacgtccccacgtgcctgccggaggcttactacgaaggcttgtatgaagggattactagcatcgtcgtaccagacacgtttagatgctttgacaatcactaacgtttcaagagattacatggagtggttcttcatgatatctaatctgttcatgacaaccacacaggcaggtgatcagcccagacatccacctgtcccacagcatgaggcatacgtggagccagctatctcggaggtcccaatggcagcagaaggtggactgtcacaggcatctgatccccccagacatgtagtggatgcttgtgaagcgattgcagaaaggttggagcgtgtgctcaacctaagaatg

SEQ ID NO: 49414 - DNA, 222 bp, Glycine max
  Peptide Sequence Number=SeqID_141099
atggctgtggaagaagattcacctgcacagaaattgttagatgaggaaggtgctacggttcttcgagggaaggttgtggaggggcctcaactgttggttgtttctggggttgttgctgttgttggattggtggaggaatgtatggtctgcttgggccagcagcattttggaaggaaggagcaggctgctgttgttgttgttgctgagggctggaccatctga

SEQ ID NO: 49415 - DNA, 87 bp, Glycine max
  Peptide Sequence Number=SeqID_141100
atggctcaaaagaaagtcttaaactcaaaggctgtgagccatttctatcttgcactttgtgggatgattattgcttgtagtttttga

SEQ ID NO: 49416 - DNA, 837 bp, Glycine max
  Peptide Sequence Number=SeqID_141101
aaacgcctcaccaatttggttgatgggagcatcgatgtggctttggtgaaagagttctatgcaaacctatacatctctgagggtccttcaccaaagcaagccaaggtcagaggccatctagtgaagatcgacattgacagcctcaacacattcctagagacacctgtggtgttggcagagggtgagactttgcccacatactctagatactgtaggctgccttcagatcctagggagattgaggctgccctatgcataccaggccgagggttcatcttgaacgctgagggccatcctgggaggatccagaggaaggacttgatgactttagcccaggtgtggagtgttctttcatactccaacctggcccccacatcgcacacctttgacctgacagtggacagagctaggctgatctttggcttagtctctcgcatggatattaacataggagctctcatttctagccagatgacttctatagcccagtctaactcttctagacttgggtttcctgctctgatcattgccctatgtcgagccagaggggttgtctctgacagcctcacttttgagcgcctgagcccgatcattaacttgacctacattaggaagaactgttggaatcctgatgatctgagagttgctatccgaggggctaggagggcgagggcgagggcgaggccagctgatcttccttccacatctatagctcctactcagtatccacttcagcagctttttcagtcccaactcagatggattctcagcgctttgaacccatgcttcagagcattcatcagggacaaatccattccttccattaagaagttctga

SEQ ID NO: 49417 - DNA, 935 bp, Glycine max
  Peptide Sequence Number=SeqID_141102
catgtgccaatgctgccgtccaccgagccggtcttgagcgcgcccagcatggtggccaggtcgcccaggggccggatgtcgaccttgtcggccacgccggcgttctgcatcaggtccttgagcgacttgatcttgccgctgtcgaaatcctcgcgccgcacgatgacgttggcgtaggtcagcttgcggtcgaagccgaacaccaggatggccggcttgccggccagcgtcagggccggcgcggcggtggccgcggtggcgccgaagacgatctggccggccgccagcagctggttggtgcgcgggccgctctgcgaattcaggtattcgacctccagccccgcttcgccgaaatagccctttttgagcgccacgtagccggccgcgaagaacgggtcgatgctgccctgcccgtagaccacgcggcccagcttgggctgggcgaaggcgacacggccgccgatcagggtgacgccggccagcgccccggtagcggccagcacgcggcggcgggtggtgaagtgggggctcgtgctcatgtcttcctcggtctcgatcgggtgtggttgtttggcgtcaacaataccgcagcggcgcctgacgtccaacaatggaaaacgcccggttgcccgggcgttctcgtcgtgccacgcaagtgtagaccgtggcggcttatgccgcggtcttcttgggcgcggccttcttcacggctttcttggcggcggtcttggtcgccgtcttggtggccgttttcgtggcggtcttggtggcggtcttcttcaccgcggccttcttggccggcgccttcttcgccgccgtcttggtggcggcgccggcggtcttggccggggcacggccgcggccgggtttctccggacgcggttcgaactcgaagccgatcttgccgtcgggctggcgcaccaggaaagccttga

SEQ ID NO: 49418 - DNA, 255 bp, Glycine max
  Peptide Sequence Number=SeqID_141103
atgggtgccaaatacctcgaagtggtcaaacgagggttgcatcccaacaacggatggtccccggacgaaattaggaatgaccataatttgtctctgcgttttgttggacacgatcgagcctgggcggtgagacacaaaatgaccataatttgtctctgtgtgccaccggacacgatcgcctctggatggcgaaaaggtgcgcggaatgaccataatttgtctccgcccacctctcgacttactgtccccgaatga

SEQ ID NO: 49419 - DNA, 516 bp, Glycine max
  Peptide Sequence Number=SeqID_141104
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggtttgcacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 49420 - DNA, 189 bp, Glycine max
  Peptide Sequence Number=SeqID_141105
atggtgaaagttggaacctcttacgtgccgatcaacgtctcattttcgccaaaagttggcccagggcttcccgctgtccctcctgttcagcagacggggtggtgcgtaacggcaaaagcaccgccggacatcagcgccggcaagtgtagcggccacgctgcgcgtaaccaccacacccgccgcgcttaa

SEQ ID NO: 49421 - DNA, 402 bp, Glycine max
  Peptide Sequence Number=SeqID_141106
ccacagatagacggaaacggacgcgacgacgatcacagggcgctgacgtgttcgcccggcgtaatgcgacaaccgccagacagaaagcaccgaggatcccgagtattgagtaatgctggagcgatcgtgccagatcctcgcgcgtgtaaaggaagcggcgagtggttaaggctcgccgccgctggaggaaattatgatttgaatattcggcagccagtagaacagcagcggcaggatctggttctcgtgtgccgcccggcagcgcagcgtgataccgccgcgttgttcttccagcagctcttgttccggcagaagatcccggcgcaggaagagcgcgcggacattctcttcaggggtaaaaagggttttctgaatatcaaaccagcgaatctgactcaatga

SEQ ID NO: 49422 - DNA, 351 bp, Glycine max
  Peptide Sequence Number=SeqID_141107
tccaaactcaggagcacaggtcacttgagcaaacagaccaatggcttgcacccacttccggtgaaagttgaaaatcctgatgagtcattagagacatctaacaacagctttcaaaattgccccatgtgtggcatctcttgtcaatgtcaggattcaacaagcgattctcctcaaatttcagccagcccacatccattagactttgcaccttatgcttcagggtcatacagtgctcaatggaatgccctagggctcctccatgatatgcacatgttgcgttcgagtcgtatcctcagaaaaatggaggtggtgttcgtcattggaagtgcggtagacagactttgtggttga

SEQ ID NO: 49423 - DNA, 315 bp, Glycine max
  Peptide Sequence Number=SeqID_141108
atgacaagcagagaccaagtttggtcattctgcacccttgtatcatccagaggcggcgggcccgatgatacgcggagataccttacggttatctgcacccttttgtcatccagaggcggcgggcccgatgacaagcagagaccaagtttggtcattctgcaccctgaggctgacacagtcttctgcaccttttgttcctccgggaacaacaagtcatttacatgcggaaatttcatggtcacccgcgactctcgtcaaccgagaggagcgaaattagtgtcatacactgattttcgtccggggacctttgcttga

SEQ ID NO: 49424 - DNA, 777 bp, Glycine max
  Peptide Sequence Number=SeqID_141109
gttctcgacgctggcgcgcacggtcaccgggtggccggaggcgagcaggcgatagccgatgcctgcattgaccagcgtgtagtcgggcagcttcagggtgttgtcggcgtcgtaccagacatcgccgtaatagcgcacggcggcgtaggtctccagcccatccacccatggcagctggtaggtggcatgcagtactccgctccagcgcgcagcacctgcggtgcgcttgccttcctgcgaggcgctgcccggagacaacttgtcgtaggtcgggtccagccaggtcacgccgccccccaccgtcagcgcgtctgtcacgtgcaggtcgccattggcttcgatgccttcgtacagcgtgatgccgtcctgcaccaggcgaggcaggctgccggcgatcagctggtcgatgttggcgccacgttccagccggaacgccgccagattcgcattccagcgtgccgcctcgaccttcgcgccgatctcgtactgcttgctgatggtcgggtcgagcacgtcgccggcgttggcgtagctgttgcccacgcggctgcccgcttccagcgattcgatgtagctggcgtagagtgtgaccgcctcgctgggcttgaacatcacggcgtaggtcggtgtgaccgggtaggtgtggtagcggcccttggtctcgtagtcgttgtagcgccagcccgccaggaccgaccagccgctgccgagatcgacggtatcgctcgcgaacaccgcctgctgcacggtctcgtcgccgcgggtcatcacccgtaa

SEQ ID NO: 49425 - DNA, 112 bp, Glycine max
  Peptide Sequence Number=SeqID_141110
ccccttgaattgcgttttcgttcatgcgtcctctacccacgagtttggagctatgcgtagtgattgcttagtgcaattctccattctctacccctttttcggagcaccatga

SEQ ID NO: 49426 - DNA, 612 bp, Glycine max
  Peptide Sequence Number=SeqID_141111
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggtatctgccttgagtatcccgtttggtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49427 - DNA, 381 bp, Glycine max
  Peptide Sequence Number=SeqID_141112
atggaaaaacggctttgccgcggccctctcacttccctgttaagtatcttcctggcatcttccaggaggaagtctccgtaccccgttcgtaagccatttccgctcgccgcagtcagggggaacgaccgagcacatcccctttcgccagcgttggcgattcataatagcgaaagtgcccgcaccgatcaggcccttcccgaacagttgcgcagcctgaaatggcggggacgcagccctgtagcgcaagcgcaattaagcgcggcgtgtgagtgtagcgtcagcgtcttaggcaccccaggctttacacttgccagcgctgatgttccggcgtgtatgcttgtgtgccgaattgtgagcggaacaccatcccgtcagtactga

SEQ ID NO: 49428 - DNA, 75 bp, Glycine max
  Peptide Sequence Number=SeqID_141113
atgacatggctggactttgtggagtgtccaaaggttcaagatgaaaaaatggaaaaccttgagatggacttgatg

SEQ ID NO: 49429 - DNA, 753 bp, Glycine max
  Peptide Sequence Number=SeqID_141114
atggcgggcctgttgctgctcggcatcctgggctaccgcaagctgccggtgtcggcgctacccgaaatcgatgcacccagcctggtggtcaccacccagtaccccggtgccaatgccaccaccatggcttcgctggtcaccaccccgctggagcgccagttcgggcagatttccgggctggagttgatgacctcggattcgtcggcgggcctgtcgacgatcatcctgcagttctcgatggaccgcgacatcgacatcgccgcgcaggacgtgcaggcggcgatccgccaggccaccctgccctcgtcgctgccctaccagccggtctacaaccgggtgaatccagccgacgcagccatcgtcaccctgaaactgacctctgacacgcgcccgctgcgcgacgtcaacaactacgccgactcgatcctggcccagcgcctgtcgcaggtgcagggcgtcggcctggtctcgatcgccggcaacgtgcgcccggccgtgcgcatccaggtcaatccggcgcagctgtcgaacatgggcctgaccctggaagagctgcgcagcgcgcttacccaggccaacgtcaatgcacccaagggttcactgaacggcaagacccagtcctacagcatcggtaccaacgaccagctcaccagtgccgccgagtaccgcgacaccatcatcagctacaagaacggccgtccggtgcgtttgtccgacgtggccaaagtggtcgatggtgtggagaacgactag

SEQ ID NO: 49430 - DNA, 875 bp, Glycine max
  Peptide Sequence Number=SeqID_141115
ggcgttgccgccggcgcactgtggggcgtggttttcctcgcgcccgccgtgctgcagtcgttcaacgccctgcaactgtcgtccggtcgctatctggtctacggcctgatcgccgtagccatgttgctgcctcgatggaagcggcaggcgccgcggctgggccgcgccgaatggatcggcctgctgtggctgagcctggccgggaacctggtgtatttcctgttgctagtcacggcggtgcagtgggccggtggcgcggcggcgtccttgattgtcggcctgattccggtggtggtcaccctggttggcgtgcgcgagcagggggcggtgccgctgaggcagctgctgccggcgctgggcctgtgcgtgctcggcgtgggactggttggctgggaagcgctgatgtccgagcacctggcaaccccgtggcggcagcgcctgatcggcctgctgtgcgcgttcggcgcgctgttctcgtgggcgttgtactcgatcgccatgactggtcgctgctgaccggcgtgacgactggcggcctggccctgctgctggtgccgatggccttcatcggccacaccggcagccattcggcggcgcagtggagtggtttctgggcgatcagcgccggtgtggcagtggtggcctcgatcctcggcaacgcattctggaaccgcgccagccgcctgttgccgctgaccctgactggccagatgatcgtgttcgagactttgttcgcgctgctgtatgccttcgcctggcagcagcgctggccgacgctgctggaggcgctggcaatcgtgttcctggtagccggcgtgatgctgtgtgcgcatgcccaccgcacaccgcgggcgatcgccgaacatgccggctga

SEQ ID NO: 49431 - DNA, 189 bp, Glycine max
  Peptide Sequence Number=SeqID_141116
atggaggatgcacaagcagggctaggcaatcaattcgtggggctacgaataagatttgatgatggaggatgcacgaaaagcgctaggatgcatgaacggcaatcacttcatggggcttccaataagttgttggaggatgcacgaactagactaggcaatcaattcatggggctccggactcaatggtga

SEQ ID NO: 49432 - DNA, 196 bp, Glycine max
  Peptide Sequence Number=SeqID_141117
atgggtgccaaatacctcgaagtggtcaaacgagggtcgcatcccaacaacggatggtccccggacgaaattagaaagtggctaaggaacttagcatctctatctgacacaatggtcctaggcaaaccacggagtctcacaacttccctggaaaagagttttgagatgtggaaagcatcatccaccttatggcaag

SEQ ID NO: 49433 - DNA, 678 bp, Glycine max
  Peptide Sequence Number=SeqID_141118
atgggtgatcaagaggagatgcgggaacagatgaaagccgacatgtcggctctgaaagaacaaatggcctccatgatggaggccatgttaagtatgaagcagctcatagagaagaaagcggccaccgccgccgctgtcagtttggctgccgaagcagacccgactctcttggcaactacgcaccatcctccctcaaacatagtaggacggggaagggacacactggggcacgatggcagccctcacccgggatacaaccgagcggcttacccttatggattgccgcccaactattcaccacccgtcttgcaagaagatgcgggccacattgcttctcccgtccatgaaagagagcctcctcagcagcccgacgaagtccacaaagaccctcaagattatgctcgaagggatgtcgagttctatcccccgatccccgaagggccggcaccaggcacgttgcctcaacccaacatcgcagcaccaccaatagttttgtccacggaagggccgcccccagcaactgaaagaaagggaggaagctcgatctccttgaggaaaagattgagggccgtgggaaggatttggggattatccgttcgcagacatgacagatctttgcttagtacccgatgttgttattcccccgaagttcaaagtgccggacttcgacaagtataa

SEQ ID NO: 49434 - DNA, 417 bp, Glycine max
  Peptide Sequence Number=SeqID_141119
atgaccggccctctccatgagtcgaactcttgctttctcataagggtggacccttgggtactagtacctatcaccttcagaagactacacgtcctcgccatcagagggctgcacgccctccccttcagagggctacacgtcctcgccttcaaaaggctgcatgccctcatcctcagaggacttcctgtcctcgccttcaaagggctacacgccctcatcttcaaagggctacatgccctcaccttcagaggactacacgccctcgccttcagtggactacacgtcccccttttcagaaggctacacgctctcgcctttagagggcgacacgtcctcgccttcggagggctgcgctctccctcgccttctgagggctacgcgtcctcactttcagtgggctccatatccacaccctaa

SEQ ID NO: 49435 - DNA, 219 bp, Glycine max
  Peptide Sequence Number=SeqID_141120
atgtgggtgcaagccattagtctgtttgctcaagcgacctgtgctcctgagtttggacttccaagatcgttcaatcagagattactcgtcttgcgcgttggtggggctgccgtaaaacaacaagaatcctctacaacaagagacccacggtctcttaatcccttttcagaaataagaagaagagaagaagagatctctcttaaaagagatggattgtaa

SEQ ID NO: 49436 - DNA, 72 bp, Glycine max
  Peptide Sequence Number=SeqID_141121
ggatatcgaatgttcgagtggttgaagctgaagcaactattttcgaagtaacagaaagaaaagcgacgactg

SEQ ID NO: 49437 - DNA, 678 bp, Glycine max
  Peptide Sequence Number=SeqID_141122
gtgagggtgtgcagccctctgttggcgaggacgtgtagtccactcaaggtgagggcgtgcaaccctctgttggcgaggacgtgtagccctctccaaggtgagggtgtgcagccctctgttggcgaggacgtgagggcgtgtagccctacgaaggtgaggacatgcagtcctctgatggtgaggacatgcagtcctctgatggcgagggcgtgtagccctctgaaggtgagggcgtgcagccctctgttggcgaggacgtgtagtcctcttcaggtgaggacatgtagtcctctgagggtgagggcgtgtagccctacgaaggtgaggacatgtagccctacgaaggtgaggacatgcagtcctctgatggcgtgggcgtgtagccctctgaaggtgaggatgtgtagccctctgttggcgaggacgtgtagtcctcttcaagcgaggacgtgtagtcctctgagggtgagggcgtgtagccctacgaaggtgaggacatgcagtcctctgatggcgagggcgtgtagccctctgaaggtgagggcgtgcagccctctgttggcgaggacgtgtagtcctcttcaggcgaggacatgtagtcctctaaaggggataggtacaagtacccaagggtccacccttatgagaaagcaagagatcgactcatcgagagggccg

SEQ ID NO: 49438 - DNA, 382 bp, Glycine max
  Peptide Sequence Number=SeqID_141123
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacaatgcacaacctccacctcgtgagaggactctaagggaaatggctgcacctgatttcacctatgaaagcttgtgcatccaataccctgatgaggatgtcccatatgttcttaaaactggactgattcatttgcttccaaagtttcatggccttgcag

SEQ ID NO: 49439 - DNA, 267 bp, Glycine max
  Peptide Sequence Number=SeqID_141124
atggaaactaacaaagggtccccagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaaggttcgggagttgtatttacgtacggggaaggtattagcaccccacacgtccgtcccaagggacggcagcctttaa

SEQ ID NO: 49440 - DNA, 261 bp, Glycine max
  Peptide Sequence Number=SeqID_141125
atggcacgcagagacaaaatttggtcattctgcaccctttgtcatccagaggcggcgggcccgatgacatgcggagacaaaatttggccattccgcacccgtttgccattcagacacagtcgtgtccatggcacacagagacaaaatttggtcattctgcaccctttgtcatccagaggcggcgggcccgatgacatgcggagatttacatcatcttccgcacttacaagatctgtcatactgacttttgagtcatgctga

SEQ ID NO: 49441 - DNA, 630 bp, Glycine max
  Peptide Sequence Number=SeqID_141126
atgcttccttttgagttccggcatgtcacagaacttcacgaattgcctaacgatggatgccaagtacctcaaaatggtcaaatgaaagttgcatgccaccaagcaaagatgttttcaattattcacagggagaaggatattagggagctaactaagcaacgtgaccttgctcaatcaaaggttgaggatttgcttcacatggtcggaaaggatcagatatctggaaaagtagtttctattttgaaagggaagatatctaggaagatgattgttcagtatcagagtcatccagcatttgtggtcctcatcgtcctaatacacacattagagacttcaacaatcctcattataatggtagagatagtgatcctgatggtagtgattacaaccaagaagttatacccacttcttgcaatgaacccaaaagcggttagtcttttaagtccagtgataaaaaccaagaagttatactcacttcttgcaatgaacccaaaagcggttagtcttttgagtctagtgatcaaccaagaagcaaatccgcttcttgaaatgaacccaaaatcggttaatcttttgagtccagtgtttaaccaagaagaccttctcttgaaaaacagtcaccaagagtag

SEQ ID NO: 49442 - DNA, 260 bp, Glycine max
  Peptide Sequence Number=SeqID_141127
cgcttctgttttcaattacgagcgtctcgatatattatgggactcaatgggacatccgtgtaaaaacgtctcgagatactacgggacacaatcggacatccgagtcaaaagttattgtcgtttgaatttcctcaaagcttctcttttcatttacgagcgtctcgatatattacgcgactcaatcggacttgcgagtaaaaacgcttctgttttcaattacgagcgtctcgatatattatgggactcaatgggacatccgt

SEQ ID NO: 49443 - DNA, 402 bp, Glycine max
  Peptide Sequence Number=SeqID_141128
atgggtgatcaagaggagacacagaaacagatgaaagccgacatgtcggctctgaaagaacaaatggcttccatgatggaggccatgttaggaatgaggcaactcatggagaaaaatgtggccaccgctgccgccattagacgaggaaggagcacactggggcacaacagcaacccccatttgggatacaaccgggtggcttacccttatggattgccacctaattacacgccgccagtcatgcaagatgatgcgggtcatgtctcttccctcatccttgaaggggagcctcatcgacagcccgatgaggtccacgaagatcatcaagagtatgcccaaggggatgtcgagttctaccccctgatccccatcgagggaccgacacccaacactttgccttag

SEQ ID NO: 49444 - DNA, 627 bp, Glycine max
  Peptide Sequence Number=SeqID_141129
gcgttccggcatgccgttagcggcattgtggaaccagaaaatctccgcgccctcattgccgtcaatacgcgccagcggttcatagctgtttgcgtcgctgtatacgtaggtcagtggcacatcgtcgtgtatttcctgcagcagacgaaaaccgtcccagacgaagcgggtgagggtcgctgctccggccggcttgccgtgcagcaaacgctgcacgcgcttgctgatgcggcgcccgagcggatcgtagcggaaactcacctgcacctgaggcttgttgcgatcgcgcggttcgctgacgacttcgatcaggcgatgctcgtcatcatagcggtagcgccagcgcgtctgaccgtcatccttttcactggtgcgaccgtgtacgtcgtagcgccagcggatgccgttaagctgcgtaacacggttgtgcgtaaccgctgctgccgcgctacggtccagtggattgcccgcgccatcccagcgccacgtatcattaccgggctgagcaccttcctgcaccagcagacggcccgcgctgtcgtagtgccagagcgtctggctgaaaggattgtcgtcgcgctgttcgcggatcaggttgttgccgtagtcgaaatcacgccggcgtga

SEQ ID NO: 49445 - DNA, 96 bp, Glycine max
  Peptide Sequence Number=SeqID_141130
atgacatggctggactttgtggagtgtccaaaggttcaagatgaacaaatggaaaaccttgagatggacttgatgtttaacgaaaggattgattaa

SEQ ID NO: 49446 - DNA, 198 bp, Glycine max
  Peptide Sequence Number=SeqID_141131
aacaagagagggtacatctcttgtggatcagttgaagtggagggtacatctacttggttgttcaaagagaacaagggagggtatatctcttgtggatctttggcttgtagaggattttacaaggttgaaagaaatcttaagaaccgttggttgcttggggactggatgatggcacggattgtggccgaaccagtataa

SEQ ID NO: 49447 - DNA, 482 bp, Glycine max
  Peptide Sequence Number=SeqID_141132
atggtggttgatcagtatgaaacaccgctgggtattcggtattttaatttcgatgcggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49448 - DNA, 715 bp, Glycine max
  Peptide Sequence Number=SeqID_141133
atgtcttccaggaaaagaaagagtgtcggttcaaggcccaccactcaatatgatacaagaagattccactattttgaggcatggaccagatacactgataatgtcctgggaagacatatattagctgagaggaaagtggaaatatattatacagagctggatgaatttaaggctgaattggagaggcgtaactttcataagtgcctcaccaatttagctaacagtagcattgacctagcattggtgaaggagttctacgccaacctctacaatcctgaggggccttcaccaaaacaagttagaatacgaggccacttgataaggattgatgcagacaacctcaatgcctttttagaaatacctgtggtgcttgctgagggtgaatctttacccgcttactcaagatactgcaggatgcctactgacattagggaaattgaggctgctctgtgcatacccagccgagggtttattttaaatgctaaaggtcaccctgggaagatcctcaggaaagatctaaccactattgctcaggtctggagtgttctctcatactccaacctggctccaacttcccacacctcgaatttgactgtggatagagctaggttaatctttggcctagttactcagctggacatgaatgtcgaagctctcatctctagacagatcacatcaatggcccagtctaactcctctagactcgggttccccg

SEQ ID NO: 49449 - DNA, 585 bp, Glycine max
  Peptide Sequence Number=SeqID_141134
atgacggggatcaagggagccccgtatcggagatgtttggataccctgagtgagactgatgtgtgctggatgccctatgctcagattgtggtgtacgttcgacctaagcgggttcttcgacagtttggctaccttcagacggtccccatgccaccggtttgtgattctttgacgggtgatgatatagatgaccggtggctgcatttttcagaccatttggtgcctttaggggagctctgtgtagttcctgtacaggtggcgccagactacatggagtggttttttcggatatcgcacccattcgtcacgtggaccgaggaaactgttgcgctgagacatccgcctccccctcatcatgaggagttcgtcgagccacccatccccgaggtttcagtcgcgaccgatctccctacgcattcagtggatttaggagcgattgctgaggatttggagcgggtcatcaacctcgggatggtcattgagggcactgacttacatgacatcatgactcgttgtctgaggagagctagaggtgacgctgcagatggaagtcttaggccgcgccagagacgccgcatagattag

SEQ ID NO: 49450 - DNA, 324 bp, Glycine max
  Peptide Sequence Number=SeqID_141135
atgtcgtgcaactcattcaaaaccgcagttccggtacggcatatcaacgcccggttatttttgcgaagtgatccgtcacctcgagggcgatcgggcgggcctcttgcgctattacgccagctggcgaaaggcggatgtgtgcaaggcgattacagttgggtaacgccagggtgttccagtcgaagtgcgttcatgtggcaggagaaaaaaggctgcaccggtgcgtcagcagaatatgtgaatacgactcactattccgggcgaatttcgctcactgagctcgctaccgctcggtcgttcgactgcggcgacgctcagaactag

SEQ ID NO: 49451 - DNA, 830 bp, Glycine max
  Peptide Sequence Number=SeqID_141136
atggtgaaagttggaacatcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcggttgatgttccagcttttgagcaggatccatatcttccttgacatcctaccccacagtgataattacttgatccacagactatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49452 - DNA, 480 bp, Glycine max
  Peptide Sequence Number=SeqID_141137
atgaccatgattacgccaagctcgaaattaaccctcactaaagggaacaaaagctggatgtcaaggaagatatggatcctgctcaaaagctggaacatcaaccgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49453 - DNA, 54 bp, Glycine max
  Peptide Sequence Number=SeqID_141138
ccgttctacaagccttgagccagaattccaacttaccataaaccttgacccagg

SEQ ID NO: 49454 - DNA, 423 bp, Glycine max
  Peptide Sequence Number=SeqID_141139
atgaacccagatttcaccaaccacgaggcgggtgctcgcgggaggcgtgccctcggcctaatggcttcgggcgcacttgcgttcaagactcgatggttcacgggattctgcaattcacaccaagtatcgcatttcgctacgttcttcatcgatgcaagagccgagatatccgttgccgagagtcattgtatcgccggggtttgtgtttgtcgcgaggacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 49455 - DNA, 243 bp, Glycine max
  Peptide Sequence Number=SeqID_141140
gaattcctgcagcccgttggggataagccactagttctgagcgctcgccgcatcgaacgaccgagcggtagcgagctcacacatccgccctttagcgccgctggcgtaatacgcgaaaggcccgcaccgatcgcccttcgcgcaacagttgcgcagcattcattgaatgcagcaatggcagacagcgttccgactgtgaaagcggcgcagtgtaagcgcaaggcggcattaagtggtggttag

SEQ ID NO: 49456 - DNA, 432 bp, Glycine max
  Peptide Sequence Number=SeqID_141141
atgaaggccgatctatcggctttaaatgatcaaatgacttccatctcggaggtcatgttaaaacttcagaaagctatagaggataaagccgcggcaaccgcctccagtacagttagggaagcggagccggtgctgcagcccgccttaaatccgggccgagacagaaacacggcagtgtttggtcgaaggtatagcccgcaagcttatccttatggcttgcctccggacttcactccccgtgccaccccggaagatttaagccaagcccttactttcgaggggcagctcccaccttatgacaactatcccgggcaagacgatgaggaaggagatacccatctcggtccccggctccacctcaaagatccgtccccccatgaactaccccaaccaaacatagtccgccatatccggcttcacccacacccgtaa

SEQ ID NO: 49457 - DNA, 579 bp, Glycine max
  Peptide Sequence Number=SeqID_141142
atggataacaaagagggagtgcaagaacagatgaaggctgacctatcggccttgaaagatcaaatggcttctatcacggaggccatgctaaagcttcaaaaaactatagaagataatggcacggtggccgcttccaatatagctagggaagcagaaccggtactacaacccgtaataaacttgggccgagacagaaacacgacgggtttcaatcggaggtatagtcctcaagcctacccttatggtttgccgctggacttcactccccgtactgctccagacgatttgagccatgcccctaccttcgagggacaactccctcctcatgccgactatcctctacaggaagatgatgaaggagatgcccatttaggccctctacttcccttcaaggaaccagccccccatgagttgccccaaccaaaaatagtctgctacatcccatctccatccgcactcgttaaggaacttgttccctttgcaaaagacaagggaaagattgatctacttgaagaaaggctgggagcggtagaaggcctcggcaactatccgttctcggatttagcatatatgtgtctg

SEQ ID NO: 49458 - DNA, 884 bp, Glycine max
  Peptide Sequence Number=SeqID_141143
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtggcaaagaacttggctgaattttgtctgtgttctaatgctttctggaaggcaggatttaagagtgatgaactagggtatttggcaggagaaaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49459 - DNA, 216 bp, Glycine max
  Peptide Sequence Number=SeqID_141144
atgactcgttgttccccccctggaggaacaaagggtgcgagatatcgtaaggtctctcgcgtgtcatcgggcccgcctcctctggatgacaaaagggtgcggataaccgtaaggtatctccgcgtgtcatcgggtccaccgcctctagatgacacaagggtgcagaatgaccaaattttgtctcagcgtgtcatcgggcccgccgcctctagatga

SEQ ID NO: 49460 - DNA, 94 bp, Glycine max
  Peptide Sequence Number=SeqID_141145
gtgcccaaaccataacttggatgatgttgcacaaatgcatatcttctatagtggtttgaaacctcaaaccaagatgatccttgatgcctcatga

SEQ ID NO: 49461 - DNA, 864 bp, Glycine max
  Peptide Sequence Number=SeqID_141146
atggcggaaccatcaaagaagcgcaaaggttcttcgagtagaagccaacggcactccgacgctcaggatactccaattccttcctccatttcctcatcctcattgttctcatcggaagaacaacgtacacggtgcacaaacctcttctcctctcattctatcattgaccctaagttcatagatatggatttcttttctgatgagagtttcaaatgcattcaagcatttcataactcaaatctcattccctttatgtctttaaaactgcctgtgtattctgaattggtaaaagtcttttattctaaccttgaaattcaagaaagtaccttgatttttgaggtctataggataaagatggtcattgaccaatccctcttctatgatttaacccaattgtctagtgatggcgtatcatttgaaggtgcactggatgatgattggaaattcgatttttctgtgcatgatgcttgccggttggtttgcaccaaccaaacggatatgactggaaggctgcttgccagttcattggctcttgaaagctgcatcctccattatctaattgtccgtatcttactccccagatcttcaaaccttgcacaagtttctaaagaagatctaatagtcatgtgggccattcatactggccgacaaattgattgggcacatctagtccggtatcacatgcataaggcattgcgattaaatgctcctttgccctatcctcaattagttactttgtcccttcaacattttaacatccctcttgattctgaaccttatgttccaatcaagagatctttcttgatcggtgctgctatggttgcctcctttggttaccgcaaagagcgtgatggctctgggtaa

SEQ ID NO: 49462 - DNA, 167 bp, Glycine max
  Peptide Sequence Number=SeqID_141147
agacaccacagcagcctgggaatggccggcagcgggcaatagacgcaccgccgccacctccagagcccctcagctcatctacaaaggctgaagcgttgcctatgacccatggccgactagcagacgaccaagtccaaagccaaaggaaaatgaatcctgagccctag

SEQ ID NO: 49463 - DNA, 303 bp, Glycine max
  Peptide Sequence Number=SeqID_141148
atggcaagggtgtgtagccctctgaaggtgaggacatgtggtcctctaaaggtgagggcgtgtagccctacgaaggtgaggacttgcagtcctctgatggcaagggcgtgtagccctctgaaggtgaggacatgcagtcctacgaaggtgaggacatgcagtcctctgatggcgaaggcgtgtagccctctgaaggtgaggacatgcagtcctctgatggcgagggcgtgtagccctctcaaggcgaggacgtgtagtcctctaaaggtgagggtactagtacccaagggttcacccttatga

SEQ ID NO: 49464 - DNA, 489 bp, Glycine max
  Peptide Sequence Number=SeqID_141149
atggagggggatcaatcatacacacagtggcatatgcagatgatgttgtcaggattacagtacaaatactcacccactttcattaaccatgatgcacatgtgccgaagccggctaatgtgaacgcagatgatccgttgcgtgaattgatgaagtacagtttcgatctttacgacaagccacttcaaatcacctttgatgggagatttcttggaattgtagatgcatctacatcgatattcatcacatattcagatgttattgaaataatagcaggagacaaaagtctgaacatatctgtcatacaattatggttaatgtatattcatgagtggagtcagatattcagtcaaggtttcatgtatgcattccttgagccacagtcgttggtttgttcaaaggatagacgcagcgaatgcgaacaatatcttgaaagatggcttaaggaatctgaccgagaggtgtacattggaccttacttccatcagtaa

SEQ ID NO: 49465 - DNA, 210 bp, Glycine max
  Peptide Sequence Number=SeqID_141150
atggcattgaagaaaaagcacaatcgagttatggcaagcctgactttgttaggcaaaatgtctcgtatggccatggacactgagaaaaactcatcttttcctttctggacaaagtatgacaagctggagtattcaggtgttgaactcgctgaaagacctggtcaccaactaacagtatcggtgcactttcatgctcttgacatccattaa

SEQ ID NO: 49466 - DNA, 459 bp, Glycine max
  Peptide Sequence Number=SeqID_141151
atgggatcgagtcaaaagccttcgcttaaaaagaggttctatcaagtcaaaatcaagagcttagaggtcattagtttacgagagttggggcaattaatgggtcaacttcaacggcaagccttctgcaaagcctacagtaagatttgggacctagctatggtagaagtctccatggaaccaattgcatccctttcccagtattatgaccagcccctaaggaatgggggtagtcagagtaccaaggaagtgtttggaggaaagggcaaaggcccttggcaaatcaaggcgaatgggctttctttattgacatccttggcgctttcgatctttggagttgtcctctttccgaatatggaagggttagtggacctagcagcgattgacgctttcctcgcctttcatcatggcaaggaaagcccggtcgtcgccattttggccatgtatgacacggggatgtga

SEQ ID NO: 49467 - DNA, 84 bp, Glycine max
  Peptide Sequence Number=SeqID_141152
ggtaaaggaaataaagctatgaaagtaagcacagaaataaagtgcaagaagctagcggactcaaagagtagttggactctttag

SEQ ID NO: 49468 - DNA, 435 bp, Glycine max
  Peptide Sequence Number=SeqID_141153
atggcatccttcagccaccttcagtcgcagatgcaatctcagggagttgcagtgcctcctgagcctgtggttggtcctagtccctccggtcctcgagtgagcacaaaagggagttgtgttgatccctcaggaaacgatcctgagaccggtgactttgacaggtgcggctcgtacatagaagcagatcctgcacgcctggttgccatcgggagagtttatgagggatccactgttgttcataacacgcctgcacgcctgagtgtggaggaggcacttcacaccttccttgcttggccgacacatctggtcaagtctttatcacagcaggtagctgtgtctccgccaaaaccacctccgaagcccgatccggaggtcgatgatccgctttatctgatgacattgaccatcccagagcttttcttgaggccttattag

SEQ ID NO: 49469 - DNA, 264 bp, Glycine max
  Peptide Sequence Number=SeqID_141154
atgggcgaaagcctgacggagcaatgccgcgtgaaggtagaaggcctacgggtcatgaacttcttttcccggagaagaagcaatgacgcagccgcggtaagacagaggatgcaagcgttatccggaatgattgggcgtaaagcgtctgtaggtggctttttaagttcgccgtcaaatcccagggctcaacccctggacaggcggtggaaactaccaagctggagtacggtaggggcagaagggaatttcccggtggagcggtga

SEQ ID NO: 49470 - DNA, 255 bp, Glycine max
  Peptide Sequence Number=SeqID_141155
atgtctcagcatatcactgttatagttgtggattctgttccactgcagcggacattggcagatgatggtcatcctgcccaaggaacacttagttgtctgggtcttgatgatgctccacagcctaaatcaaaggctcctgctaggtggattgtcgtcaagtgtaatagacaaaaaggaactactgagtgcggctactatgtcatgcactggatgtccaccatcattttaggaagttttagaaataattgggaagcg

SEQ ID NO: 49471 - DNA, 211 bp, Glycine max
  Peptide Sequence Number=SeqID_141156
atgggcgttttagggcgggatctaaaagttctccaacgtgttgcggagccttcggccgtgagagggtctgtcttttggcttcctcagggccgagctgggcgaagcggtagcgaagctcaggtggtgatgcaagtgcgcggtgagcgtagtagccccctcgggcatgctctttgtacaaccaagcgaagagctagtgagggccggaaatatc

SEQ ID NO: 49472 - DNA, 444 bp, Glycine max
  Peptide Sequence Number=SeqID_141157
atggaaacaaaaaagaaatacggatcaagggatctcccaatcatgtggctccgctccctcctaagaaatcaagtaaatcggtcatctcctcgtcctcgcgggcctcatctgcctcgtcgggagcctctactggcgcctctactggctgaggctcaactggtaaagacaatcatgggtctgtacatgcgcccggtggttgagtcctgtgatcaaagcgggaaatcccagggccctgttggacttatccgggtccagaggggggaggtcggaattatgatcgctaggctggatgttgctgagcagcaaagtcatccagatctgagtcagggtggtcatgttggtgcgcatgatcctcacccgtcttccagcagcagtccgggcaaaattcttccccggtatacacagcaattgggcgatggcctcctcatcaaggggatcctctag

SEQ ID NO: 49473 - DNA, 561 bp, Glycine max
  Peptide Sequence Number=SeqID_141158
atgaaatacatttttcttttattattttctgcatcttctttggcaatagcacaaaaaccatgtggatttaaagacggattacaggaaggaacctgtaagcagttttttgaaaacgggcaggtcaaagaaatcgctgaatggaaaaagggaaaactagatggtgatgcaatcttttactatgaaaatggaaaagttcaggcaaaaggagaatacaaaaaggattacaaaataaaagaatgggcatactacgataaaaatggtatcctgacttctaaagaggttttcagaaacggagaaaaaaatgtctatgacaatacttctaccggtacgttttattcaccttccggcaccatcaccgaaatttcaaattataagttcggaaagctgaatggtgaaagcaaggttttttacgagaacggaaaatcggtgaaacaaattggctactacgaaaacgggatagccacaggaaaatggaaaatgctttatccatcaggaaaagttcagcgtgaaacagagttcgccaacgataaatggaacgggaacacgcgttcattaccgtga

SEQ ID NO: 49474 - DNA, 168 bp, Glycine max
  Peptide Sequence Number=SeqID_141159
atgaccaaacttggtctctgcttgtcatcgggcccgccgcctctggatgacaaaagggtgcggataaccggtcagtatgacaaagattatggggcggccgacaaaagcaaagctctcgctcctacgtatcctccaatgaggaactcagacctacgtagttctggataa

SEQ ID NO: 49475 - DNA, 507 bp, Glycine max
  Peptide Sequence Number=SeqID_141160
atgaagcacttcactgacaccctcatcagtgccaacataggaacaaaagctggtaccgggccccccctcgaggtcgacggtatcgataagcttgatgaacacttcgccttgcacatcgtttacgccaatcatgggtgtaacaccaatagtcacggatgggaatataggtttggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcggtgaccgctacacttgccagcgctga

SEQ ID NO: 49476 - DNA, 264 bp, Glycine max
  Peptide Sequence Number=SeqID_141161
atgaaggccttaactttcggaatatttcgccacctcttggacactggagggaggtctactgtctttcagggggtgttctgtggctatcttggcatggtcgcgctcttggagggctctgacagggagtcaacttcggttgcaactctttcactggacgcgggaggggtatacttcacggaacgaccttattactttgatatgcaaatggcgttggcttgggcgctgtctggggatacatgggtgtggagccggtccctttcctag

SEQ ID NO: 49477 - DNA, 1290 bp, Glycine max
  Peptide Sequence Number=SeqID_141162
atggaaggacaaataagtgattcattaagtaaacaacaatgtttgaagacaacattaaccaacgagcttcaaaatgtccaacctccagaaatgtatgcattcgatatgcaatgcatttatagagtaccaccagtcattcgtgaaactaatcccaaagcttacacacctcaaattgtttcaattggccctttacacaaagcacgtgatgctggaaaggaagacatcatttttgagtcaatggaagagcttaaagtgaagtatctcaaggcatttctaaatcgaacccaaatacctatgggaacctttgttgtcacacttcaagcgttggaagacaaaattcgaagttgttatgcagtgcgtattaaatataacagcgatgatttcttaaagatgattctcattgatggttgcttcataattgagctttttttgagactctatagatacaactattggcggggaaaggaccctgtgttgctaaaagactggatgcgaatgcaaattaagagcgacttgatactactagaaaatcagcttcctttctttgttcttaaacaactttacaacctcgctggtatgaatcaggaatttccctcctttcttcatatttctttcaactgcttgaagcgtgtgggatgtggaacatggtgcccaacagagtccccaaagcacttcaccgatcttatgagaactagcataatatcatcatcaaaatttgttcttagaaaagaagaagaatgcaaagtaataaaacatgtatacagtgcaggccaactgcgggaggcaggtcttaaattcaaggtcagtccaaatgaaaatgaatgcttacttgacttgacctattctagtgacggtgtgttgacaatgccaatcttgaatatagctgacgattcagaagtgttcttcaggaatatagtggcatttgaggaatgtcacctttcagatgatacaaacatcattactcaataccgaaagattctagattttcttatcaacactgaaaaagatgtgaatgtactagttgataagaaaattattgtcaattggatgggtgatgctaatgcagtggctacaatggttaacagtctgggctcaaatattgggatgccacgtttcaatccagtgtatttctctctctgcaatagcttaaatgatttctatgaaagtccttgcaacaagtacaaggctatcttcaaacacgattacttcaacactccttggaaaatagcatctacagttgctgcaattgggaagggaatgggggagtggaaaggggtggggagagattga

SEQ ID NO: 49478 - DNA, 594 bp, Glycine max
  Peptide Sequence Number=SeqID_141163
atgaccaccctgactcagatatggatgactttgctgctcaccaacatcctgcccagcgatcataatttcgacctccccctgccgaagtgtcagctggtgtacgccatcctgacgtggatgagcattcatgtggctcagttaatcgctgatgccatctatatatttgcaggtatggcgcctaccaggcaccctctggacccggataagtccaacagggccctgggatttcccgccttgatctccggactctgccagtcgttcggcgtccccgtcacacctagcaaggtgattcggccgcccatctcccgagcttttatcgagaagtactgcacgcagagacaggtccagggtgatgcaccacagaccgcggacgcgccaccacctcatcaggttggtccagccggattgtttgatacggagcagtatttgcggcatttggttcgccagcaggcggccaaccaccgggcacatgtacggacccatgattgtctttatcagatgagtctcagcctgcagagccagggctttacttcttttctgtacggacccatgaattgcgttttcgttcatgcgtcctccactttcgagttttga

SEQ ID NO: 49479 - DNA, 393 bp, Glycine max
  Peptide Sequence Number=SeqID_141164
atgaatttaagaggaagacaagtggagatagctgatccattgtgcccgttctgtaacaatttggatgaagatgcagcgcaccttttcttcaactacagcaaggtacttcccttgtggtgggagacagtctcatgggtcaaatcagtgggtgctttcccaaaagaaccgaaagaccacttcatgcatcataacagatcgaatgctacacgaacaaggctttttgtatcactagaggatgatagcaacacactaatagcagtaccagatatcacacaaataacaacatcagacaataattccaaccaagaggaaatcatgactacaaatagcagaggcaataacagaccaaaacgcaacacacacaggcccaagtacctcagtgacttcgtataa

SEQ ID NO: 49480 - DNA, 258 bp, Glycine max
  Peptide Sequence Number=SeqID_141165
atggaaaaaaacggagcacctaacaacgtatcttcacagaccaagaactacgagatcgccctttcattctggggtgacggtttgaaaaaggatcttagagtgtctagggttgtgccaggagggtctcttaatgccttcctttttcttctcatcggagttatttcacaaagacttgccatggtaaagaagaagggggaacaagcacacttggagagcgcagtacaacggatagttgtatgctgcgttcgggaaggatga

SEQ ID NO: 49481 - DNA, 240 bp, Glycine max
  Peptide Sequence Number=SeqID_141166
atggctaccattgcattatcaagtagatatgggagcaagttagcatatgacactggaatttggggtggatcctacaggctttttgctgcaaaattccttccttggttggtgttttggtttgtgctaaaggtggtgtttggcattggtcatgtggcaggaatgacaatcacagcaagggtttctccctcattctcatcctcttcatttgccccagtttttgcattcatcaaagcaggatga

SEQ ID NO: 49482 - DNA, 358 bp, Glycine max
  Peptide Sequence Number=SeqID_141167
actagctggtgccgagagaccagtggtccacgttgatcctactactggcaaggccagcggtccccacaagaagaaattaagaacatattttgggattgtggcacgtgataaggtggacgtgacgtacgagaactggaaggcgacccctactgctcagaaggacttaatttgggtggatattcaggcttctgacagtaggacgaaaaagaagttacttcagactgttggcaagagatggaggcagtttaaagcagacctcacgaggaaatgggcccttgcagccgatcaggacagtgtggatgacattgtctgtgagaaatacgacataagcaaggaaaaatgggcccagttttgctag

SEQ ID NO: 49483 - DNA, 577 bp, Glycine max
  Peptide Sequence Number=SeqID_141168
aacatgctttacggtgcccttaccaaacccgtgctagagctagagtaatgggtaaagtagaggaggcgccagagcagatgaaggctgacatggaggccatgaaagagcaaatggccacaatgatggaggccatgatgagcatgaagaagataatggaagccaatgcggttacagttgctgctatcagcgctattgctaaggtgaacccgatgcccccatctggccttaaccaaatgaatcatccaacttcagatatggcacatgaaattccccaccacaatctagccgacttcgagccttgcctcggatttgccactaaagggcaagcagttggtggtatacccatgccaaacactttggagggccctcagtttcgcccacaaccacaaccattgcattttgcggtgggaagagcccctcctgctatggctgaaaagggaaaggtggatcatctaaaggaaaggctcagggccattgaaggagatgtattgtcggaagatgggggcattcccaagttgaaggtgccggactttgacaagtacaaggggactacttgctccaagaaccatctaaagat

SEQ ID NO: 49484 - DNA, 522 bp, Glycine max
  Peptide Sequence Number=SeqID_141169
atggaggggctacgtctagatgattcatctaccagtcgctgcaggcagcatgcatggtctctcgtggcggaggcgaaagtgacgaatttctgtttcatctcggggaatcacacgacatggaaacctgccccgcggtggaagagttacttcaacggctcatggactgggggcagctcgaagtgtccgagggagatagggaagaaccgcatatttgcatgcagtcggcagaaaggaagattcccccaacccccaaagccctacaataaggtcgttccatggaagtatacccctcccgcttttggagaaagagctgcaaccgaggttgactccttgtcagccaagtggccgggtgttcgctccccctcactcggtgaattgccctccaaggggaagacacccatgatccaagagcccacagacacggccaccccctcaaaagaagtggatcccccggtggtaaaagaagctgaaaagaaagaaggtcttcaaggaaaggcggtgaccttgggaagaggctcatga

SEQ ID NO: 49485 - DNA, 447 bp, Glycine max
  Peptide Sequence Number=SeqID_141170
atggaactactcattttaagagctggacttagagaggaggaaagaacaagcatagctaggttccttagtgggcttaatacgaaagtgagggacaagaaagaaagaccaagcccaaggaaatttagagggctgacttcaaaatccaaggaagatgagggtaagaccatagagaaacctaccctaagactagttcccaagcaaagactagcaatattaaatgtttcaaatgtctatgggagaggtcacattgcctctcaatgtcccacaaataaaaccatgattatgaagggtcaagacatttatagtattcaagaggagactacttcttccccttccttagtggaagtgaagatgaagcaagggatgaagagtctactgaggaagtctatccctatgaagaaagtgacactaatgattagaaggctccttggaggccaactcttgtga

SEQ ID NO: 49486 - DNA, 441 bp, Glycine max
  Peptide Sequence Number=SeqID_141171
ttaaaacgtcttgaaatttcacaacccgcgctttcgaaaacccttctacactctcgattctctttctcctcccacctgaaatctgccagaaaccgctcggtcgacacccacattgccccacattcatttcgatactatcaaaaaccgctggctagaacccacagaacctcctatcgaagaaaagtcgaagaaaaccctacactgctgttggaactgtgtgggtcgaaaaaaccctacactgctcttggaatagtcgagggtgctcaaagctcaaagctttctacgcttccagttaacaagcttgacgagagttacacaccgagcaaagtttccatccgtgacgatgatggttttcacaacttgaaggagattaagaccgtggaactcgtgaaggcaactgggtgggtttatctatccttgtctggagctgatcctaggtaa

SEQ ID NO: 49487 - DNA, 309 bp, Glycine max
  Peptide Sequence Number=SeqID_141172
atgttgctaagtagcaatgtcatctatatctgtgtaagagtggtcatgttggtgcgcatggtccgcactcgtctctttgcagcggtacgggtgaaatcttgccccggtatgcatagtagctgtgtgacaacctccctctctggttgtgctcgcacagttggccctcctcccatatcagggggtggcctaggaaccatgtggagcacactgaaaatgaggacacgtagccctctaaaggtgagggcgtgcagtcctctcaaggtgagggcgtgcagccctctgttggcgaggacgtgcagtcctctcaag

SEQ ID NO: 49488 - DNA, 471 bp, Glycine max
  Peptide Sequence Number=SeqID_141173
atggcgcctaccaggcaccctctggacccagataagtccaacagggccctgggatttcccgccttgatcacaggactctgccagtcattcggcgtccccgtcacacctagcaaggccgcggacgcgccgccacctcatcaggctggtctagccggatcatttgacacggagcagtatttgcggcatttggttcgccagcaggcggccaaccaccaggcacatgtacagactcatgattgtctttatcagatgagtctcagcctgcagagccagggctttacttcttttccgtgccctactccggaccagttcagggcaaaggtcgcatggcctggagattggcccgaggcccaggcaggagaggcaccagcaggggcaccagcagaggctcccgacgaggcagatgaggcccgcgaggatgaagagatgaccgatttacttgatttcttaggagggagcggtgccacatga

SEQ ID NO: 49489 - DNA, 108 bp, Glycine max
  Peptide Sequence Number=SeqID_141174
atgagtaaggtaggaaggtttgaaggtttgggaatggagggacgtcgcaaggaggaagaggctgcacaggggtttctgaaaaacgtggtggaggcagcctattggtaa

SEQ ID NO: 49490 - DNA, 255 bp, Glycine max
  Peptide Sequence Number=SeqID_141175
atgagttcgaatttggtacagccatgccctcctagcttccaactagggtattgtcggttggaggtacgcccagaggtttacacgacaagcataatatccgacgatgagtcccgcgaaggtaataccggggacccgaccgtcgatttcgagcaagaagcaagtcagacagaggatgaagaagacgaagatataggacttcccccagagctagagaggataattgctcaggaggatctagagatgaggtcacattaa

SEQ ID NO: 49491 - DNA, 183 bp, Glycine max
  Peptide Sequence Number=SeqID_141176
atgaagatgtctagaaaattcagtaaaaatttcagctcaaaattcgaatttttggagttcaatattcacttaggatcaacatttcagccagcaattcaatcaccaaaactcaaattcacaatagacacaatcataaagaaacctaaaagttcaagaaaaggttcacaatcaaagactctctaa

SEQ ID NO: 49492 - DNA, 324 bp, Glycine max
  Peptide Sequence Number=SeqID_141177
atgtaccctctcttattctcagtcacaacaacccaagtagatataccctccaatgtgttaagacaaagttctcaggcggttagtcctttgaaactatgtgaagggggaaacaaaagaattctcaggcgggaagaatcaaaagaattctcagactgtgtcattttgaattctttgacatgggagaagggagacacaaaagaattcaggcggttagtccttcgttcttttggaaaagggagaagagagacacaaaaagaattcaggcgattagtccttggcgaattctttttggcaaagggagaagggattgaaaaagacgaataa

SEQ ID NO: 49493 - DNA, 249 bp, Glycine max
  Peptide Sequence Number=SeqID_141178
atggaggtacttatggcagaacgggccaatctagtctttcacaataaagtgataggtggaactgccattaaacgacttattagcagattaatagatcactttggaatggcatatacatcacatatcctggatcaagaattgatgacctttttaacaataccttctaaaggatggctagtccaagatgctgaacaacaaagttttattttggaacaacatcatcatttatgggaaatgtacatgcagtag

SEQ ID NO: 49494 - DNA, 102 bp, Glycine max
  Peptide Sequence Number=SeqID_141179
atggctaggttgagtttcaattgcacaaacaacatagctgagtatgaggcgttcgcccttgggatccaagcggcaattgacttcaaggtcaagttgctcaag

SEQ ID NO: 49495 - DNA, 642 bp, Glycine max
  Peptide Sequence Number=SeqID_141180
atgttggtgagctgcccctcctccgtaccatatgtagaagcagcggaagaatcattggaaacagctttccaatccttcgaggtggtgagttgtgcctctgtggaaacgagtccattgctgtcttgtctctctaatgcggccctaatggtggcacgggtgatgctcaggcacggttatgagcctggaatgggtctgggcaaggacagccacaggaatgctgatgtggtcgacattagggggaacccgtacaaatatgggttggggtacgaacccgggaaactgggaagaaggaatgcaccgtcaagactccgggcagatagggcatggcccggccatgttagccagtgtttcacaagtgccgggataatgttcgaggaagaggtggcggcaataggagaggaatctccacaagattcgccaagcttcgtgcgaccatgccatcccaattcccaagtggggaactggcgcgtgatgagccagtcggaagtctatatcgctgattcaatatgtgagggtcgattctttgaggatcctaacaacgagggtttgataatcgattttgaccgagaagtaagtcaaacaataaatgaagaagaggaagaggacgtcctttcaccagagttagagaggttaatcgcttag

SEQ ID NO: 49496 - DNA, 294 bp, Glycine max
  Peptide Sequence Number=SeqID_141181
atgtataatcgatatgggaaaaagacactagagatgggttttgaagatcagaagatcaattttgatctttttgaagaaaacaagtcggtgccagagcataatatttgctttcctttcgctaagcacaagcctcgcgctaagcgcatcttttgtcatgtgctaagcggagagtctctagcgcttagcactcaacccttgcatctcaagctgatttggtccgctaagctggccaaggctaagctaagcccatttcaattcgatctaaattcggctaagcgatggcctgctcactaa

SEQ ID NO: 49497 - DNA, 267 bp, Glycine max
  Peptide Sequence Number=SeqID_141182
atggaacgagatgagaaaagattggagtaccgtttctgctgtttgtcggaagaaaacactggggaagaggacaatgagggtggaattggtgctgtggatgcgctaattttaatcggtgaaatcaaaagaaaaatgaaaaagaagaagattgcaatttacgggagtcgatttgatgaagaaatgagtgagataggaaggtttggaggtttgggaatggaggtacggcgcaaggaggaaggggctgcgcaggagattctgaaaacgtga

SEQ ID NO: 49498 - DNA, 168 bp, Glycine max
  Peptide Sequence Number=SeqID_141183
atgacaatcagaggaggagatagggggaactgcttcaagctcaggcgaagaaggtggattcaccactggagattgtgggtgtgggctcaggcggagcagccttgttgggtctcaccaatggaagttgagcttcaagccaagctacttactcaagaaaatgttccatag

SEQ ID NO: 49499 - DNA, 969 bp, Glycine max
  Peptide Sequence Number=SeqID_141184
atggatgagcaaagactggagaggcagcttgataacaacattttcatcgacggggtgaaagtgttcgttaatagaccgaagttcgaaagggggaaggtggtaaacactcgtgaaaaagggacctttattcgtggtgagggggatattccacaggtatacaaagatggtaatggggataaagctgatcaggtggaaaacaatatccgggataaacctcgatcatatgctacggtagtgaaggaacctgtacatggcgaaacagaacctatgaagtcgttggtagtgatgcctgggtccgataagacgaactatagcccagtcatcctgcaatcaaccaaggcgaattctgagtggatttctaaggcctggacagcaagactaaagaacaggggaatgtttgagaggttggaggaggagttgaaatgggtggttgaagacgattctagtccttgctactgggcggacgactgggtcatcttccctgacatggatgagtccaaggctgctcgtctcatagaccaagagaaggacaacgggtctactcccatatcggagctccaaaaatggtctccggagataagacccacacatagactcacctgggttcttctctggggtctccctctgacagtgtgggaagaggagcttatggcgaaggtgttggcggaagtgggggaggtggttgaagtagatgaatacgtggaggctaggcggcgactggatgtggcacgtatcctcgtacgcacgcagaaggaaccttcgcttcaggcgaatattccggccattattgacgggatcgagtacgtcctccaagttgtggaggacacgacgagcctgggtaggtcaaagaagtgtccttaccatgtatcctggcttcccccttccccatactcgacccagccaaacaccccggcatcaggggacgtgctccccccaagggtcttttccggcgtcgatttccccgacgga

SEQ ID NO: 49500 - DNA, 552 bp, Glycine max
  Peptide Sequence Number=SeqID_141185
ggatcgcgcccgcaagacacccagtggacctggagaagtccaacagggtcttggggttttcagctctgattacgggcctctatcagttctacggagtgcctgttgcccccagcaagcgggcaatagacgcaccgctgccacctccagagcccctcagctcatctacaaaggctggagcgttgcctacgacccatggccgaccagcaggcgaccaagtccaaagccaaagataagcaaaatcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49501 - DNA, 357 bp, Glycine max
  Peptide Sequence Number=SeqID_141186
tgctggagctgttgatgaatcctggataggctgctctggctccacaactggtgtagatggctgggtctcctcaggagtagtctcctcctctgctggtgctggtgctggccacctgagcatcaaactcctccatgctcataatggagggcaagcccaagccctgaaggctctgcttgataatggactgccccctgtggatgctctggagcatggagtgcagcatctgtggtgtaatggagctgtggaagaagaaggagctggtgtctctgatgctgaagtggaaggggcctcaaatctcttacccctggccttcctgggtcctctgaaagttactgttggatcatcaagattccaaca

SEQ ID NO: 49502 - DNA, 327 bp, Glycine max
  Peptide Sequence Number=SeqID_141187
atgaattcaagattcaagagaagaaatcaagaagacttcacaagggaagtatttttcaaaggactaaccgccagagaactttgtcttaacacattggagggtacatcctttgtggtacaagtagagggtacatctacttgggttattgtaactgagaacaagagagggtacatctcttgtggatcagttcaagttgagggtacatccacttggttgttcaaagagaacaagggagggtacatcccttgtggatctttgcttgtaaaggattttacaaggttgaaaataaatctcaaggaccgcaggtcgcttggggactggatgtag

SEQ ID NO: 49503 - DNA, 285 bp, Glycine max
  Peptide Sequence Number=SeqID_141188
atgaagaaggatgatcaggagatagttgttattgacatggaacctaaggctttacttcattttgtttatagagacactcttttggaagatgaagagctctttatgttggattcgtcattctttccttcgttgtctgaatcatttatagcaaagttgttagctgctggagaaaagtatgccgtgatgcatgctgatggttttgagtatcttaagaaaaattacccattactgcaatcagaactgctaaagactggagtaggatgcgagaaagaagattatatatag

SEQ ID NO: 49504 - DNA, 543 bp, Glycine max
  Peptide Sequence Number=SeqID_141189
atgacgggcattgcccaggtcctgcagcaggccgttgccggccagttcctgacggcgcaacaaggtcagggcattgagcgatgccagctcggcattgagtttgttgcgttggtcgctgttgagtggcttgccgttttccttgccgctcttgaggctgaggttgatctgctggttgatgatcaggctgttggcatccgacagtgccttttgcagttcgccttgttgcgtactgcgctcgctgagcatctgctccagctgtggcacgttcagggtggcgtagcgttgggccaccggcaggggcttgctggccttgagcttgatcagctcgcgctggctgtcggcggtttccttgggcgcgccagccaattgctgcttgagtgcctcaagcttcttttcgctgtcttctttgctgagcagcaggtgccagggtctgttccagcacctgttgctgggccttctgctccggtgtctgttgcgcagccttggggtcggcctcggcacccttgggctgggaaatcttgttcaggctgctctggatgctag

SEQ ID NO: 49505 - DNA, 555 bp, Glycine max
  misc_feature (14)..(14): n is a, c, g, or t
  Peptide Sequence Number=SeqID_141190
ttccaagagccatnctacgagcctgataaggcgaaagaactacgaaggaccagtcttggtcagactttagtcatttcgagaaggagccaacttgaagaggcgaaggtggacaaagcgagcgaatcagtacagaatttgggtggactcgttggctccccaaagaggtgggcattggcatcgatccggatcgtcaaaaaggaagcattatcccgggtcgcggcgagagtccctgcctacgaagatttaaaagaaaagagtatgattagagatagggggccaaaggacacagaccgacaagctagatcatcgggggaggtaagaaccactttctactcttgttaccggggaaagctccaacttgaggctttaggcaatgagagtagtgggggctattactttacttcactcacttcagagacagaaaaaaagaagaaaggagcggagcagcttcgccgtctaggggatggagcaaaacgccactatctacactatttctttagtagccagaccagtagagactggattagcgatcaaagggtagaactcatgctttga

SEQ ID NO: 49506 - DNA, 195 bp, Glycine max
  Peptide Sequence Number=SeqID_141191
gtcagattaaggtttcgttctgtaccgaaaccacaaggcaaattggaagattccgcttcggttgaagggttcctctcggctgtgggtgatggagaaattgcttgggacgttagaaatggttttggaggaaagaaaggagaagaaatgacatttttcctaagctacacgaaagcaaaggctgaaacgctcaaatga

SEQ ID NO: 49507 - DNA, 223 bp, Glycine max
  Peptide Sequence Number=SeqID_141192
aactcccacaggcaatttagttccaatggatttagaaattgaagctacattaagaaggaacagggttgagaggagaaggaagcttctgcaagacagaacagtcgcatccattcttgaggaagaaactcatttttctgattcattatcacctgattcaccatcatcaagggaatccactactcaattgcctgaagccactaccatggcagacgagcagaactag

SEQ ID NO: 49508 - DNA, 627 bp, Glycine max
  Peptide Sequence Number=SeqID_141193
atggcacctcagaaattcaaaattattccgcacaaagtggatgcacatgtggcaaagccggctaatgtggacgcagatgatctgatgcgtggcctgataaagtacagttttgatatttacgacaagccagttgaattcgaatttgatgggagtaactttggaattgtagatgcacctacatcgatattcctaacatattatgatgttagtgaaataatagcaggagacaaaagtttgaacatatctgtacaacaattatggttgattcaaatcttgggtcaaggttccatgtatgcattccttgagccacagtccttggtggtttcaaaggatacacgtggcgaatgccaacaatatcttgaaagatggcttaaggaatctaaccgagaggtgtacgttggaccttacttccatcagaaacctgatatgcatatcaaagccgcaattaatagtgtaatgacaaaattaaagacgagttcgtctcctgaaagtaaggcagctgcacctaagtggattgaagttaagagtcaagttcaaaccggatgttatgaatgtggatattacatgatgcattggatgtggaacatcataaccagcgagatcaagagtgattggtccatgtactaa

SEQ ID NO: 49509 - DNA, 51 bp, Glycine max
  Peptide Sequence Number=SeqID_141194
atggatacccgtctccgtgtgattggtgatcccatgaatggagttcaacgg

SEQ ID NO: 49510 - DNA, 740 bp, Glycine max
  Peptide Sequence Number=SeqID_141195
gactacacgtcctcgccttcagagggctacatgccctcacctttagaagactacatggcctcgcctttaagaggactacacatgctcaccatcagaggactacacgtcctcgccttcagagggctacacgccctcgccttaggagaaccacacgtcctcgctttcagagggctgcatgccctcgccttcagaggactacacgcccccaccatcagagaactacacgtcctcgccttcagaggactacacatcctcacctaaagagggctacacgccttcaccttcagaggactacacgtcctcgccttcagaaggctgcacgccctcgccttgagaggactaaacaggactacatgttctcacctttcagaggactacacgtcctccacttcaaagggctacacgccctcacctttagaggactgcacgccctcgcctttagagggatacacgctcacaccttcaaagggctgcacgccctcgccttcagagggctacacgccctcaccttcagaggactacacgttcttacctttagaagactatgcatcctcgcctatagagggttgcgtatcctcaccttcagaggactgcatgtcctctccttcagaggactacacgtgtcgccttcagagggccacacgccctcgtctttagaggactacccgtcctcgccttcagagggcaacacacccccaccatcagagaactacatgtcctcgcctttcagaggaatacat

SEQ ID NO: 49511 - DNA, 210 bp, Glycine max
  Peptide Sequence Number=SeqID_141196
atggcaatcaattcatggggttccgaatatggttttgatggtggaggatgcacgaaccgcacttggcaatcaattggacttgattgtggaggatgcatgaacgacaatcaattcatggggcttcgaataagatttgatggtggaggatgcacgaacagcactaggcaatcaattcgtggcactccggactcgatggtggaggatgcatga

SEQ ID NO: 49512 - DNA, 354 bp, Glycine max
  Peptide Sequence Number=SeqID_141197
atggtggaggatgcacaaacagcgcttgacagtcaattcatggggctccgggctcgatggtggaggatgcatgaatggcaatcaattcatgggggatgcatgaacgacaatcaattcatggggctccaaataagatttgatgatggaggatgtacgaacagcgctaggcaatctattcgtggggatccggactcaatggcaatcaattcgtgggactccaaactcgatggtggaggatgcatgaacgacgatcaattcatgggactccgaataagattagatggtggaggatgcacgaacacaacttggcaatcaattcgtggggctccggactcgatagtggaggatacttga

SEQ ID NO: 49513 - DNA, 306 bp, Glycine max
  Peptide Sequence Number=SeqID_141198
atgtgtgccaaattaccttccaagttggccttggattcattcggttggggtggtcctgtcaacactgcaccagaagttaaaattcatggtggaggggcaattgattatagtttcgggagaagaagacatacttgtgcgttatccatcttctacgccttatgtggaggctgcaaaggagtcattggaaacatccttccaagcattggaagttgtgagaaatgcttaggtggagtctcccccggtgtagtcgcgctcatctggtgccactttgatggtagcttgggtgatgttggggcacagatatga

SEQ ID NO: 49514 - DNA, 432 bp, Glycine max
  Peptide Sequence Number=SeqID_141199
atgccgagaaaaaacagcagcgttgccagcggttttttcgccatgaatgccggtgccgccagccagtcgttgaccagcagcagcgcgccaatcactgccagcacgcccagcgcttccagcagtagcacgggtttgggcaacgtcgccagattacgcatggttcagggctcctcagtgttcatctgtttctgctgcagctgcccttactgcgtacgagcaaaagagttagccacgaagttaaccagcgagcgcgacgattttaattatcagtacgtcgatatccaggcgaccggcatcaccaaagccgatctggaagcgcgtgccggcaaaccggtttctaccgtgccgcagatcttcctcgacgaccagcacatcggtggttacaccgaatttgctgcgtggaccaaagaaaacctcggcatcgaagcctga

SEQ ID NO: 49515 - DNA, 144 bp, Glycine max
  Peptide Sequence Number=SeqID_141200
atgaggtgggtccttacactagtggtatcagaggaggtcgaacctttcggccacacttactcacttgttgtgttccatgagttatcgagatttgattgttgtagtcatattggatttgtttttctaatgtctgctataccatga

SEQ ID NO: 49516 - DNA, 330 bp, Glycine max
  Peptide Sequence Number=SeqID_141201
atggactcgagaaggttccaagttagtgtaccaggtagcagtcaccccagtaagactttcttggaagaaatgtatcggcagtttcttgatgcaagctccattggagcttgtaggcctaggatcttcttcatcaatggattcctttgcttcttggaagatgaatggcagcggaatggagaaagggagagagagaggagacgccacttcaaggagaagatgagtctagaagaagctcaccaccataggaggccatggataagagcttggaggaagaatgagatgaatgaagggagagggagagaagagcacgaaattttgtgctctaaatga

SEQ ID NO: 49517 - DNA, 435 bp, Glycine max
  Peptide Sequence Number=SeqID_141202
atggcctctaggaagagaaaggcaactgcctttcgacctcagaagccctacgacacaaccagatttatttctgagggcgcctgggaaagatatgagcagaacgttcattcccggaacatccttccagagaggaacattaatttatatgtcacggagtatgatgagttctgccgtgaactcgagaggaggcggtggcataaagccttgacctggcagcctgatggtcacattgatgtggccttggccaaggagcaggttcgagtacgggggaagctgataaagttttatggggacacgctcaacacatttctggagacccccatggttttggagccaggggagcgatacactgcctacaccaggagtgccctggaggctcttaaggaaggatttgactactctggtgtagacctggagcgtcttgtcatattctaa

SEQ ID NO: 49518 - DNA, 306 bp, Glycine max
  Peptide Sequence Number=SeqID_141203
atgtggggcatcccttttatccttgagccaaaccaaaccccgacatgtatcatgtctagccattctacaaaccttgagccgaaaatcctgactcaccataatccttaccctcggaagcaaaaaggaaaagaaggaaaatttccaatcaaagagaaagcaaaaaaagaaaagaaaggaaattcccaatcaaagagtgggagaaagcaaaaaggaaagaaaggaaattcccaatcaaagagtgggagaaagcaaaaaggagagaaagaaaaaaagaaaagaagaagaagaaggaaagaaagcccctga

SEQ ID NO: 49519 - DNA, 481 bp, Glycine max
  Peptide Sequence Number=SeqID_141204
atggctaccgcaccaaaagagacttcatctcctggttcaccttctgtaccatcatctccatcatccaccaaagcaccatcaaaccaggaacaacctgaattccatatccaacccatacaaatgattcctggtcaagcccctgttcctgaaaaactgattcctaaaagacaacagggaatgaagacctctgaaaaccctagccttgcaacaagtcctagggaagtagacatggagatggataagaagattcgcagtattgtgagtagcattttgaaagatgcctctgttcctgatgctgagaaagatgttccaacatcttccaccccaaatgtttctgtgcctgatgctgagaaagatgttccaacatcctccactccaaatgctgaagccctcccttcacccagtgaagaggaattaacagaggaagaggatcaagcaacagaggagacccctgcaccaagggcaccagaacctgctccag

SEQ ID NO: 49520 - DNA, 780 bp, Glycine max
  Peptide Sequence Number=SeqID_141205
atgcgattgctcggtgaaatctcactgggcgatccagtgacaaggtactggcctgaactgacaggtaaacagtggcagggcattcgcatgctggatctggcaacctataccgcaggggggttaccgttacaggtaccggatgacgtcactgataacgcctctgtgctgcgcttttatcaaaactggcagccgcagtggaagccgggcaccacgcgtctttatgccaacgccagcatcggtctttttggtgctctcgcggttaaaccctccggcatgagttttgaagaggccatgacgaagcgggtctttaagccgcttaggctcgaccatacgtggattaacgtaccaaaagcggaagaggcgcattacgcctggggataccgtgacggtaaagcggtacacgtttctccagggatgctggacgctgaagcctatggcataaaaaccaacgtgaaagatatggcgagctgggtggtggcaaacatggcccccgatgcccttcaggatagctctctcaaacaagggatagccctggcacagtcccgctactggcgcgtgggtgccatgtatcaggggttaggctgggaaatgctgaactggccggtcgatgccaaaaccgtggtcgggggcagcgacaataaggtggcgctggcgccgttgcctgccaaagaagtcaatcccccggtaccgccggttaaggcctcctgggtacacaaaacgggttcaaccggtgggtttgggagctacgtggcatttattcctgataaacagctcggcatt

SEQ ID NO: 49521 - DNA, 186 bp, Glycine max
  Peptide Sequence Number=SeqID_141206
atgtccttttgcgggcgagcgaaggcgaggctcacgggtgcgctttccaaaggaggaaagatggtcggaaaaaccgaaggaaaccggcgttggaccttaaaaagtgatcctttttacttgttgaagactgaagaaaacgaagaacgaacgatgaatgtcgaagaacggttgaaaatcttcgcgtaa

SEQ ID NO: 49522 - DNA, 171 bp, Glycine max
  Peptide Sequence Number=SeqID_141207
atgcatgatgtgatcgaggaacaagccagaggactatcagcgacaatgcatcaccaaaagaagaaaactctagatgaggcttcactgttatcaagcgagtcggagacccagcatgaccacaaatcaacctccactccttatggctcatatagacccgggtatagggcctaa

SEQ ID NO: 49523 - DNA, 989 bp, Glycine max
  Peptide Sequence Number=SeqID_141208
atgataaaggagtggcaagtctataaagagcatgccagcgaaaaatcattgcgcttgttcagtcatcaggcgagtctgcctacccagcaatctccggctgcgttacaagaccagttgggagtgtttttaacttcagaacggtaccgttttaaaatccagcagcaggctaatggcgatacgctcatcgccgcaaagctgggtacacatcaacgtctgggctatatctttacccatgcagccatcgtcgtgatctgttttggtggtttgctggatggtaatttgccgttcaaggtgcaagagctgctagggatgaagcaggttgaaacacgcgatatttcttcccgcaaagtgcctgccgagagccgcttgggtgtcaataatttgtcgttccgcgccaatatgaccttgcctgaaggtgagcgggacaatgtggcctttgtgcgtgtgcgtgatggttatttagtgcaagatctgccatttaccgtagcgctcaaggattttcgcattgagcattatgcaacggggatgccaaagtcgtttgagagcgatatcgagatcattgaccctgaattgagtaagccgattgaggcgacgatacgcgttaaccatccttatattcatagaggaattgccatttaccagtctgactttcaggatggcggttctcaactcaagtttaaattgtgggatttgtctgccgccaattcggatgggtttgatgttgacggggtgatcctgcaaaaaggctccctgggcgacggcgcacaaaaaatgacggtagagtttaacgagttccgccagttcaatattcttaacctgtctcctgatggtaaaggcaagccacacaatgttggtcctaacactaccttgaaattgcgcaatgccagtggccaggcacgtgagtacgtcaattatatgcaaccactgcagctggatggccgggcttattttgtgtctggcatgcgggagacggtgcaggatgagttcaa

SEQ ID NO: 49524 - DNA, 213 bp, Glycine max
  Peptide Sequence Number=SeqID_141209
atgatgctaagtagcaacatcatttatatctgtgtaagagtggtcatgttggtgcgcatgatccacactcgtctctttgtagcggcgcgggtgaaatcttgccccggtatgcatagtagcggcgtgatagcctccctctttggttgtgctctctcatttgccctcctccaggatcagggagtggccccagagttgataaaaggaaactactag

SEQ ID NO: 49525 - DNA, 156 bp, Glycine max
  Peptide Sequence Number=SeqID_141210
atggcacagaatgaccataatttgtctctgtgtgccatcggacacgatcgtctctggatggcgaaaagggtcagtatgacagagattgtggggcgaccgacaaaagcgaggctcttgctcctacgtatcctcaatgaggaacttagacctacgtag

SEQ ID NO: 49526 - DNA, 837 bp, Glycine max
  misc_feature (15)..(15): n is a, c, g, or t
  Peptide Sequence Number=SeqID_141211
atggtttacggcatnatcggcatgatcaacttcgcccacggcgaggtttatatgattggcagctacgtctcatttatgatcatcgccgcgctgatgatgatgggcattgataccggctggctgctggtagctgcgggattcgtcggcgcaatcgtcattgccagcgcctacggctggagtatcgaacgggtggcttaccgcccggtgcgtaactctaagcgcctgattgcactcatctctgcaatcggtatgtccatcttcctgcaaaactacgtcagcctgaccgaaggttcgcgcgacgtggcgctgccgagcctgtttaacggtcagtgggtggtggggcatagcgaaaacttctctgcctctattaccaccatgcaggcggtgatctggattgttaccttcctcgccatgctggcgctgacgattttcattcgctattcccgcatgggtcgcgcgtgtcgtgcctgcgcggaagatctgaaaatggcgagtctgcttggcattaacaccgaccgggtgattgcgctgacctttgtgattggcgcggcgatggcggcggtggcgggtgtgctgctcggtcagttctacggcgtcattaacccctacatcggctttatggccgggatgaaagcctttaccgcggcggtgctcggtgggattggcagcattccgggagcgatgattggcggcctgattctggggattgcggaggcgctctcttctgcctatctgagtacggaatataaagatgtggtctcattcgccctgctgattctggtgctgctggtgatgccgaccggtattctgggtcgcccggaggtagagaaagtatga

SEQ ID NO: 49527 - DNA, 146 bp, Glycine max
  Peptide Sequence Number=SeqID_141212
gaagcggggtagggatcatcctcgaaggcctttacaatatcactctagagcaagccctcaagatcaacttcagagcctcaaacaatcaggcagagtatgaggcgctcattgcagatctgaagctagcaagagaacttggagcgtag

SEQ ID NO: 49528 - DNA, 282 bp, Glycine max
  Peptide Sequence Number=SeqID_141213
atggacattttgcttcccatagtcctaaaaagttctacaattactggaaaaaagaagaatttgcctgctcctgtgccaactttaacccctgaaatggttcaagaaatgattgtttcagcattttctgctttgggtcttttaggtaaagcttctttacccagctctccttggtattttgactctagtgcatccaatcatatgaccaacaatgttgctgcacttaccaatgtcacaaattactctggatcaacactcaaggaagataatcgcgaatgggcctaa

SEQ ID NO: 49529 - DNA, 540 bp, Glycine max
  Peptide Sequence Number=SeqID_141214
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggccccatttcgccattcaggctgcgcaactgttgggaagggcgatcggtgcgggcctctttcgctattacgcccagctgcgaaaggggatgtgctgcaaggcgattaagttggtaacgccagggttttcccagtcacgacgtgtaaaacgacggccagtgaattgtaatacgactcactatagggcgaattggagctccaccgcggtggcggccgctctagaactagtggatcccccgggctgcaggaattcgatagtgcatcaagctgttcgcaagggccagcttgatcctcttccccaggatcccaaatga

SEQ ID NO: 49530 - DNA, 538 bp, Glycine max
  Peptide Sequence Number=SeqID_141215
atggcgagaatagccaaggtatttgaaatatcggcgcaagaattggaccgagtaaaacaaaataaaaatggggtggtcggaataccgaggaagcacttggaggagaaagcgaaggctttggcggatcaaggtgaatgggtttcattcgttgatgtcttggcgctattggtatttggagtcatcctttttccaaatgtggatgggctagtggatttagcagcgatcaacgccttccttgcttatcaccatagcaaagaaagcccggccattactattttggccgatgcctatgacatacttgaacgaagatgtgagaagagtggcacaaggattgtctgttgcacacccgctctttatgtatggttggtctcgcacctctttcatcatgaaagtagacctgtctatgccctgcaaggtcaccacatgtgcgctgagaaaggaaaggcaaattgggagcaactcttggctagtatggtaggggcatccattaattggttcccccgatggaagaaaggaagagttggggttttgtcctcat

SEQ ID NO: 49531 - DNA, 373 bp, Glycine max
  Peptide Sequence Number=SeqID_141216
atggaagagggatatgctgcttctagtgaagttgggcaggttcatttgcggatgaggaagatgttgctggttgagattgagaagtcatttgcctcacaagttcttcaagggaaggttgcgaaggagcctcaactgtttgttgtttctagggttgttgttgttgttgttgttgttgctggattggtggaggaacgtaaggtctgcttgggccagcagcattttgaaaataaggttgttgttgttgttgctgctgttgtgaaggattcgaccattaaggttgggatgattcctccacctgggcttgtacctgttgctggagagcataagcttcaggttgttcaattgcttcagattgctgcacagaagggcaaag

SEQ ID NO: 49532 - DNA, 222 bp, Glycine max
  Peptide Sequence Number=SeqID_141217
atggaggagacacatgaaattccccaccacgatctagccaacttcgagccttgcctcggatataccgttgaagggcaagcagttggtggtatacccctgcaaaacactttggagggccctcagtatcatccacaaccacaaccttcacgttgcacagcggttaaaaaccctcatgactatggcagaagatgggggaatacgcaaaagatgaggaattgctga

SEQ ID NO: 49533 - DNA, 540 bp, Glycine max
  Peptide Sequence Number=SeqID_141218
atgtcctctgatcacttcccccacctcggcctcggctactccatcgccatagccctcgccttcctcttcctcctctccacactcctcctctcctcctacctatgctgccgccacaaccgccgccgccacacccaaaccaccgcctccgccgccgcctccgacggcggcatcgtcctgccacgtgtcatattcgtggcggaggacgatgacgaggatgccgatgcctgcatggtggtggggctcgaccagagcgtgataaactcgtacccaaggttccagtttaacaaggacagcgatgcgcggaatattattaacaccacgtgctccatatgtttgtgcgagtacaaggattcggagatgctgaggatgatgccagagtgccgccattacttccacctatgttgtctcgattcgtggctgaagctcaatggctcttgccccgtttgcagaaactcgccgctcccgacgccgctttctacgccgctgcaggaggtggtgccgctctctcagtatgctgctgataggagaagaaataggtga

SEQ ID NO: 49534 - DNA, 1110 bp, Glycine max
  Peptide Sequence Number=SeqID_141219
atggaaagatatcaactatcccttcacatgaatgatggcaataaagaacagagttatgcaaacaactcgtcgatgcaaagaagagtaataagtaaaaccaaaaccatacttgaagaaactataatgaggctgttgtattgtgattcttctcctagctgcatgaaggtggcagatctaggttgctctgcgggaccaaatacacttcttgtgatatcaaatattattgacatggtttataaagcaagcacccacttgaatcatgaaccacccacactccaattttatctcaatgatttatttggaaacgatttcaattccatcttcaagtcactccctgatttctgtaaaagattgatagaagataagggtcataattttggtccatgctttattaacgctactcctggatccttctatgggaggctctttcccaataattccataaacctttttcattcctcctacggtctacactggctctctcaggatccattattggggtctagcgaggcatcgttacttaacaagggccattgttacatagttaacacaagccctccagaggtatacaaagcttaccttaagcagtttcaacaagattttaaattgtttctgaaatcacgttcgaaggaacttgtgcctggaggagcaatgctcttggtgttacttggcagaaatgaaattcctcctacagtaaacggttgggaaccaattagtctaatactcaatgacatgttcttggagggtttgattgaagaagcaaaattagactccttcaacataccagtgtatcaacctacagttgaagaaattaggcatgtgattcaggaagaagggtcattctatgttcaacgattagagattttcatccagcctttgggtgaaagcataaatgacggtggtgatgattcttttcttgatggaaatttaaaagctgaatcagtagccaagcacatgagagcaataatggagcctcttttgtccacaaagtttggtgcagaagttataaatgaactattcaccaggtttcaaaagaaaattatgcaactgatggaggtggagaaatcggagtgggctactttgatgatatccatgataaaaactgcttga

SEQ ID NO: 49535 - DNA, 1068 bp, Glycine max
  Peptide Sequence Number=SeqID_141220
atggcattgggaagagtaatatacgttgctcacaccgtatgtatcagatcagagcttcaacccatggcacctgaccgcattggttcttcctcttcttctcgccaaagggacctcgttttcgtcgtcaaccctctagctagaaaagcagaattactcgttatttctttggggataaagtttaatttttggaaatattggaccataattggcactcaaatcaactgcaagaaacttgagttccaggtgctaatgggaggacagatatgtgaatccataacgtcgggtccttgtcatgctattgacataacaagagaggctataagggagggggctgatgctgtcattgctgttggaggagatggaactcttcatgaggttgttaatgggtttttctgggctggaaaacctgttgttagtcaagtgaaagagtctacacactcaactgctcttggtctcatccccttgggaactggttctgattttgcaagaacatttgggtggtcttctttagggttgagatcaatgatagatgtcggtgttatcactggagagagttgcgaccatcattacttcataaatgtcgccgacattcatttgagtgcaaaggcgggtttttatgcttctagatacaagagatttggcaacctgtgctatgtcattggtgcattgcaagccttcattgggcatcaaaaccaggacatgagaatcaggttcaatgatggtccatgggagacatgtcctcaagtgacagccctttgcattggaaatgcaaaatactttggtggtggcatgaaaattacaccaaatgctgatcctttcagtagaaatttagaggttgtaactcttcagaacttcaagtggtatgattttgtcttgaaattacataagctatacagtgggacacatctctcagtaaaaaatgtatctgatagaagtgtactttctattgaggtggaggacatatcaggcatgggtggtggtatttatattcaatctgatggggagcatttggggttccttccaaaaaagattagtgttgtgcctgctgctattgagatgatattgtga

SEQ ID NO: 49536 - DNA, 168 bp, Glycine max
  Peptide Sequence Number=SeqID_141221
atggttgggtttggtggctatgatgacatgaaagtggtggtggtgatgatggtagcggcttgggttgcaacacttcacgttagagatgacattatcgtcagaggtgtggttgttgatgttggggctgaattcattgatgaaggattggaaggtgttccggcatggtga

SEQ ID NO: 49537 - DNA, 639 bp, Glycine max
  Peptide Sequence Number=SeqID_141222
atggaggatcagaataagaaggtccgaaaaccttacaccattaccaagtccagagagaactggaccgaccaggagcatgacaagtttctcgaagctcttcacttattcgaccgtgactggaagaagattgaagcatttgtaggttcaaaaacagttatccagataaggagtcatgcacagaagtatttcatgaaagttcagaagaatggcacaagtgaacatgtacctccccctcgtccaaagagaaaagctgctcatccctacccacaaaaggcatctaaaaatgctcttactatatcccaagttgcgcggccattgcaatcttcatctgctttatctgaatcatcacacatctataggccagattcatcatctgtggttagaactccagttagcagtgtgccattgccatcttgggtttataatgttacaccaccagtcagtcttccccgagtgactaaagatgatatggtgatgatgagtcaacaaatcaatcctttcagcagtagtaatgagagcactcctaggggttggccaattagcaaacagacagatcagggtgaccaaggcaagccaactataggaaaagtttataggaaagtggtactgcctgttgaagctttcttttcaaggaagtga

SEQ ID NO: 49538 - DNA, 1593 bp, Glycine max
  Peptide Sequence Number=SeqID_141223
atggctaccgctccttcgcttctacactcatctgggtcctcttttttctctcaatttcgtgcctttcaattctcttcttcttcgctgtttcctcatggaaacaggcatgggaatgccgtggtctctgtgaaggcctctgcttctggggttgtgttggtggagaagtctgaggcagagaaggccaataggctcaaaacagcttacactgagaaaattattcccttgctcatggaagagttctcttacaccaacaaacaccaggtgcctaaaattgagaagattgtggtgaactgtggtattggagatgctgcgcaaaatgcaaagggtttggacgcggcaataagtgatctagcactgatcacagggcagagacctattaagactcgggccagggcttctcttgccacttttaagatcagggaaggtcaaccgcttgggattgctgtgacactaagaggaaatatgatgtattcattcctagaccgagttatcaacctgggacttcctaggacaagagatttccaaggtgtgaaccccaacagctttgatgggcatgggaactacagcattggcattaaggaccagggtgtgttcccagagatcagagccgatgttgttggtaagcctcggggaatggatatctgcatcgtgacgacggctaataccgaccaagaagcacagaaattgttagctcttatgggtatgcccttcagagagggaagtggtcctgccacgacaattcggaaaaagaagcttaagtctcatcattttgatgcaaaatcaaagggaagaggaaggaggcttggacatgccatcaactatgtcgctatgagtgccctcaaacttcctactcttccaaagactttagaaggagttatcagccaagagaaatttgagaaatctagagcctatagtcttgataaaagccacttccattttgttcacgagtttgtgacaatagtgatagactctacaattttgtacttcggagtattgccctggttttggaagatatcaggagattttatgacaatagccagtctcaatgctgagaatgaaatactgcatacccttgcctttttagctggggtgatgatttggtcacagataactgatttgcccttttctctgtactcaacttttgtgattgaggcccgtcatggttttaacaagaaaggaggtccatacttggccatctatctttgggcttttacatttggtctttctattgtgatgatgaccctttatccagtactaatagctccactcttcaataagtttactccagcagtggaggtgtggggatgggaggatttagagcttggcttggatgaggaacagtccatcttggtttttgggagaagcatcccagaggaagggcacaatagtcttaccaataactgctgggttaaagctgtaatcataattatcaaattaatggagttgggttgggtggatcttccagatggtcaactcagggagaaaattgagaaacttgcttcctccctcaactatccgttaaagaaactatttgttgtcgatggatccacaagatcaagtcacagcaatgtaaggaatattgatctcctctaa

SEQ ID NO: 49539 - DNA, 102 bp, Glycine max
  Peptide Sequence Number=SeqID_141224
atgacagttgagcaaaccaagtctaagctgaaggatagaaatacaccaacaagcaacaaggagccagagcccatggatattcctgctgaaaccttaaagtaa

SEQ ID NO: 49540 - DNA, 171 bp, Glycine max
  Peptide Sequence Number=SeqID_141225
atggacaccatatatattatgcatgaagtacaactgatgtgggatttgggtatttcccaatacatccccttcatgtccagcacttattgggcttggtgcgtgaaccacaaatggtgggtgctcgtcgcagcggaagcaaagacgagatcccagggtcagaacctgctctga

SEQ ID NO: 49541 - DNA, 321 bp, Glycine max
  Peptide Sequence Number=SeqID_141226
atggctgattccaaaaatctcataaaaaaagctttgtggcccaatagcttaagcaactcttccggtcctaaaacttcaaacactagccagcatgaaacaccaccaaaaatagccatcaaagatgttttctatagttcaagacctagtaatcctcccaacacttcaaccactactagcccaagtggtacaccgttacctaagatgagggacgtttttgcacgcaggaaagggaaagggagtggcggctatgccggccatggtcaccaagaacattggagagagaaatggttaaaaaacttgaagtcacactatgcttcttaa

SEQ ID NO: 49542 - DNA, 204 bp, Glycine max
  Peptide Sequence Number=SeqID_141227
atgtcaggcgttcttgctttgattcagaaggagcttagcaacttcaaattgtactcctatgcagatgatgaagctgcaagtgtatctccgcagatactacaatttgtagcttctgcattaagtggttatgttgcagaacatctagattctcccatggacttgtcatttgagagaaggctttctgcaaaggcatttgttgcttaa

SEQ ID NO: 49543 - DNA, 1233 bp, Glycine max
  Peptide Sequence Number=SeqID_141228
atgagttatgctaggacacctccacagagcataggtaggccacgtgcattacgcgtggaggctgcgcacgcattagagaatgccatccgaatatccgattacaaactgccaaacgttctgaacaggaagttgagcaagaaaagcaagtatcacttgtctgatggagaggagaatgactttgagggaattgattctcttggaagagatgattttgaggatgagatgcttcctgatgatattgatgctgagactgatgagaaattagatttggttcaacggagcatgcagattccgggggaaactagtgcggatgatggggaggaaaatagacataaaagcaagaaggaagtgatggaggaaattatctcaaaaagcaagttttacaaggtgtgggatatttctgtaatcaaggctatggctcaaaaggcaaaggataaagaagaaaatgaaaacttggtggaagaattggataaggatttcacttccttggttcagtctgaagccttgttatctttgactgaacccaacaagatgaatgctttgaaggctctggtgaacaaaagtatttcaaatgatcaaagtaataaggaccagatgtctgctactcggacaatggataattctgtgcaggaaaaacctgatgattatgacaaacttgtcaaacaaatggggttggaaatgcgtgctcgcccttcagataggacaaagacaccagaggagattgctcaggaggaaaaagaaggtctagagcaattggaggaagagcggcagaagaggatggttgcggctgaagattcaagtgatgaagacaatgaagattcagaaaagccatttgaacagaaaccaagatctatatctggtgatgatcttggtgattccttttctgttaatgaacaaattatgaccaagaagggttgggttgatgagattcttgaaagaagagatgaggaagattcttctagtgaagatgatgatggtgaagatcctgacaatttgggaagctctgaagatgctgatgaaggatcagatgaagatcttgatgaacacgagaaggatctttctttaaaagattgggaacaaagtgatgatgatgatattggtgcagatttagaagatgaagatgatagtgatgagaatatagaaacagctgcagaagaccttgatgaggtaaaaggatcggatgctgcagttcatataaaaaagcaaaaagaaatgcttctgttgaaagtgtag

SEQ ID NO: 49544 - DNA, 606 bp, Glycine max
  Peptide Sequence Number=SeqID_141229
atggggcacaaagaaaaatcaaaggacctaaaagaaaagagattgcaacagatttctcttttgagaaccattccttattctgatcaccagaggtggtggtccaaggaaactgttgctgtggttacaggtggaaacagaggaattgggtttgagatatgtaggcaacttgctggtcatggagtgactgttgtactgacttcaagagatgaaagtgttggtgttgaatcagctaaggtcttgcaagaaggtggcttcacggaggtggcttgtcatcaacttgacatattggatccttcatccatcaaccaatttgctgaatggttgaaagaaaattatggtggtttagacattctgttccatgtcaattggccatttctaaaagcaaagttccaagtacttatgatttggatgttgctacttggctacttggcttccatgaaccctttggatgtaattcaaacaagggacggaggttacttggcttccatgaaccctttggatgttgctatggctagaaaagaagctccaaagctagctatgcagatgtcaaggccttttgtgttggcatcataccaatccttgacagggttcaagttgtatttataa

SEQ ID NO: 49545 - DNA, 672 bp, Glycine max
  Peptide Sequence Number=SeqID_141230
atggatgtagaagcggtgaaaaggtctccttctcaagaaaaatatggcagggttcaatctgcaataaggttgttagtgctggttgtgtttctgggttggattttcgtatggatagtgactccaacaaacacttaccaacaaaaatggcagcctcggcttcaagcaaagactaattctatttttggtgcacaaggtgcaatgcttctggtatacacttttccaatcttgttcatagctgttttgggatgtgtgtacgttcacatagccaaaaaaggaaacggtttcggcaaggaaagtagttatggcaagaaacgtgaggtatctatatggaagcgtttggtgcttgtgagaggccctcttggcatagtttctggaacagaaatggtcttcttctgggagaagaaactagatattgcatctgtgaggttggccctagttgggaacatatgcttggcattcctgtttttcccggttgctcgtggttcctcagtgctacctctgcttggactcacaccagagagttgcatcaaataccatatttggctaggaaacgtggccatgacccttttcactgctcatggtatttgtttcatcatctattggacagttaccgataaactttcaaaggttcttaaaaatccctactactatctctcttttggtgcattatga

SEQ ID NO: 49546 - DNA, 2418 bp, Glycine max
  Peptide Sequence Number=SeqID_141231
atgagcacattgccaataatatgctttagagatggaagtcctccactgccagatgccttaaatacatctctgaaggattcagccacctctggtataaatgatctagatgtggagcggtgctttcctatgcagaaaaatatcactatgaaactgacaaacaatcagatatctccaggtgtttggtacattggtcttttcaatggcattggacctacaaggacgcagtcaaagatgaattttcagccaatgatttctgttcttcaaattatccgtggtccatcattttccttcattgctaatataagtgtggaagcatgcacaaattcaatgatgaggggggatttctgtaacagttcagtttatccactttcatgtgcagaatctgatgtctctaatgctttggaagctaaaatgaacaagtcaatgttggaaagtttggtgacctgcaaaagtaattttgaagctttttgtgttcatgaaggcatgccaaacttcttctccctggatattatgaatgtggcagaagaaattatcattacggcagcaaatatcagattcaatgttagtcgatcaaatgatattagtttaatgtgttttgtccgccatggtgcaatgccttctgtgacttcgaatgattataacattaatattgctaaaggcccactggttattcattcaccattaattggccgttggtacattagtatagtgccagtcaatcttacaaagactcaggataacagtgtaagagtttgctattcagtggaatctcaagtgcttcaatgcccacttgggaaagctggaccaaattgtacaatggatagctacttgcttcagaattttaaacaactaaaaatctggaatttcaatttccttctaaaaggtgagaaattgaaattctcttcttacagtcttcttcaagaaacaccgtctgagtttgtggaatatcgatcgggtacatttgtaaggagaggttcaaccccctttgagtcatattatttaccagttgttggaggagcatcgtatgattctgccaatttccctctcgagccacttttagacgactcatcatacagtggagaacctgataacatttggacttactttcttctgaacattcctcgtggtgcagctggaggaaatattcacatacagctatcctcagatatgaagatcagttatgaagtgtatgctagatttggtggattaccatctcttgatagctgggactattattatgctaacaagacaaggaggagtgatccatctatgtttttcacactatatgactcaagtgataacaaagttaatttttatattatgtatgctagagaaggaacttggggtattggtctaagacatcttaataccagcagtgattccatgaaagggcttactatcatgtctatttcacttgagcgatgcccaaaacgatgctcctctcatggagaatgtaaattttcttttgatgctagtggattgacatcgtacagacatgaaccaagaaagtcctcggcgaagactttcttggttctagacaccttggtaatgattgagacacatggcaaaaaaatcgaatgccgtattgtggacttttctggttgcatcttctgctcttgtgatcgaaaccatggaggcttcgactgtagcattgagattgtaacacatcaaggacatgtacggcaatcaatttttctcattgtatcaaatgctgcagccatacttcctgcctactgggcccttcggaagaaggcattagcagaatgggttttatacacatccagtgggatttcaagtggactatatcatgcgtgtgatgtaggaacctggtgtgcattgaactataatgtcttacagttcatggacttctggctctctttcatggctgtgattagcactttcctttatctagctaccattgatgaagtacttaagagagcaatccacacagctgttgctatccttactgccctaatggctgcaacaaaagcaaccaggtcttccaatgttattcttgtaattgtgattggtgctcttggtttgtttattggatggttgatagaaatctcaacaaagtataggtccctttccttttcaattggaatctcatttaatttctctcactgtttccaaactataaagcagtggctctataatcttgtcaagacacttttgagacggtaccactgggcatttgccttggctggttttcttgcattggccatggcagcaataagctggacacttgaaaccagtgaaacctactggttttggcatagcatttggcatattacaatatacacatcttctttcttcttcctttgttcaaaagcaaatattgaggatactgagaatcagcttcctacaaatggaaactatgaattgactcatcaggattcacttccaagaactggttag

SEQ ID NO: 49547 - DNA, 2808 bp, Glycine max
  Peptide Sequence Number=SeqID_141232
atggcatatgggtggcctcaggtcatccctctggagcaaggactgtgtccctctgcacagaagattgtgtacctcaaagtcatcaatcgcacgttgctcgttgtctcccccactcactttgaactctggagcacttcccagcatagagtgagattggggaagtacaagagagattcagattcattgcagagggaaggagaaaacttgcaggccgtgtggagccctgatgccaaattaatcgctattcttacatctgcgttctttcttcacattttcaaggtccagctatcagataaaagaatacacactggtgggaaacaaccctctgctttgtgcctagctactatttctcttctgcttacagagcaagttccttttacagcaaaggatttgtcagtgagcaatattgttagtgataacaaacatatgctacttggactttctgatggaactttatacagtatgtcttggaaaggggagttctatggggcttttcaattttatccacaacctactgctagctttgacaattctcaaatgccacttactctagagaatggtctttctcctaaaagtcacccaaaggttcttatgtccaatcacattattcctagaaagtctgaaatcaaccaactggagctttgccttccattgaggttcctatttgtcttgtattctgacggggaacttgtctcatgttctgtgagtaaaaaaggcctaaagcaagttgactgtatcaaagcagaaaagagattggcttgtggtgatgctgtctgtgcttcagtagctctagagcagcaaattcttgctgttggtaccaaaagaggaatagtggagttgtatgatttggctgaatcagtatcacttatacgtgcagtctctttgtatgactggggatattcaatggatgacactggccctgttagtttcattgcttggacacctgataattccgcttttgcagttgggtggaagttaagggggcttacagtttggtctgtttctgggtgtcgcttgatgtcaacaatccgacaaataggtttaagttctgtgtcttctccaatatctaagccaaaccatgattgtaagtatgaaccattgatgggtggtacctcactgatgcagtgggatgaatatggatatagactttatgctattgaggtggggtcttcagagagaattctatcgttctcatttgggaaatgctgtcttagcagaggtgtttcaggcactacatacatccggcaagtgatttatggggaagaccgtttactcattgtgcagtcagaagagactgatgaactcaaaatgctacatcttaagcttccagtttcttatatttcccaaaactggcctgttcaacatgtggcagctagccaggatggcatgtacttagctgttgctggtcttcatggtttgatattgtatgatatacgattgaaaagatggagagtatttggagatgttactcaggagcaaaagattcagtgtaaagcaaatggggagctttcacttcttgacttggatgatggacgggagagaaatctcactgattcagttgaactattttgggtcacctgtggtcagtctgaggataaaacaaatttgattgaggaagtttcatggttagattatggtcatcgaggcatgcaggtttggtatccatctccaggtgctaattcttttaagcaggaagatttcttacagttggatccggagctggagtttgatcgtgaagtataccctttgggacttcttccaaatgctggtgtagttgttggtgtttcccagagaatgtcatttccagcaagtgctgaatttccatgttttgaaccatctcctcaagcacaaacaatactgcactgcctactccgccatcttcttcagcaatggtgggtggcagctggctcagatggagcaagaagaatggcagttaggggtcaggtttcaatttcgcagatgctttgtgaagaagcagcagcagctttgatgttagagttcacagtcacacaagacaaaaaagaagcttcaagcagcgttgaaccgaatcagggggacaaaattgaggaagctttaaggctggcagagctatcagctgagaagcctcatttttcacattgtctagagtggcttctttttacagtatttgaagcagatatatccaggccaaatgtgaacaagaaccagatctcagttgttaaacatgctaaaaggtctcttttagagaagacctgtgacctgatcaggaattttccggagtaccttgatgttgttgtaagtgttgcaagaaaaactgatggtcgtcattgggcagatttgttcactgctgctggaagatcaacagatcctttttttccatttgatttatttaactctagttacaccaacttcaatgatgtggttatcaaacttacacaggcaacacttgatgaatcattgtacgagcttgctggggagctggtgcggttcttgctaagatctggtagggaatatgaccaagcatcaaacgattcagataaactgtctccaagatttttaggctattttctttttcgttctagtgagcagaagcaatcattggataaaagcacctcattcaaagaacaaagttctcatgttacctctgttaagaatattttagaaaaccatgctagttacctgatgtctgggaaagagctctccaagcttgttgcatttgtaaaaggaactcagtttgatttagtggagtatctacaacgtgaaagatatggaagtgctcggttggagaattttgcttctgggcttgaactaataagccaaaaggtttaa

SEQ ID NO: 49548 - DNA, 1681 bp, Glycine max
  Peptide Sequence Number=SeqID_141233
ggtatatgagtatttagatgaaacgaagtcgtgtgttagtgatagtgtgaagggcaagaaatcagattctaatggggatgaatttgataatgtatgtgactttctagatgggagggagttgtgtgatactaatagggtgaagggtgtgagtccagagtctaatggggacaagaaagttcagagcaaaggacttgttgatttggatatgctggacgatgggacggatgagcatattatcagaaacttgtgcagtcttaatactgagaggaatatactggaagagtttgatggggggaaaatattaactgtggatgcatctgatgcagagagcaacatgcctagattgtcggatggaagcaagtgctgtgataatgatgatgatgatgatagtgatgaagtcttgatattggatccatctggtgttgacaaagagatatttggtcgtaagaggaagagagagtctaagtcagaaatgctaagttggattactagcattgctaaaaatccttgtgattccacagtcggttcgattcctgaaaagtctaagtggaagttttacagtagtcaggagatctggaagcaggttttgttgtttcgagaagctgtctttctgaagaaagattttgagacaaccagtgaacagcttaattggcagtggtcgtcggtagttttgtcagaaaacactttcgctggagagaaaggtgggtcatggacaagaaattactccaggagtgggatagtggcacaccactgctcagcgtggatccagttgaagcaaaaaatacttgcttctgtgtcatttaagggacagaaaatgcatccttctatgtatgatgatcgtgttggggcaatgtacaatcttagacagaggttgaaatgtgacaagagagttttattgggaaaaactacatctggaggagtctccttagcttcatctggaggaacacatgtggatttggagaggaccccaagttctcatgctgaagatcgtgctgagaaattgttacctgactccggtactgctcactcaagccttgatagatgtgccagagtgcacatccctttggggccaaaccatcaagctgaagtgccagaatggactgtcataacttatgaggttgattcaaagtggttggggacccaaatatggcctccaaaaactgtaaattccaaatgtcgtctttttgaaagggaccccattggagagggaagacaaaattcatgtggctgccaagtacaaggttctgttgagtgtgtccggttccacattgctaagagaagggctaaagttaagttggaattgggtgaggcgtttcaccaatggaatttacataaggtaggtgaagaagttgggggttcatggacagagcaagaagagaagaagttcaaagatgtggtgaaatcaaaccctgcttcacttgataaatgtttttgggatcatcttttcaaaacatttcctaagaagagcagagaagatttagtcagctactatttcaatgtctttcttttgcagcgcagagcatatcagaataggcatactcctgataacattgacagtgatgatgatgaatcagaattcacaccattgaggaaagtttttggacatcaaacaccaaaacctcgcagcttcaccttgttatcccccaaaaaagccacattcaaaagggaaaataacaagtga

SEQ ID NO: 49549 - DNA, 498 bp, Glycine max
  Peptide Sequence Number=SeqID_141234
atgggaatgatagtggattttgaaaatgaccaaaacgacgccgttctggttccgccccctaacttcgccatggttgaagactgcgttttccgatccagcttccccaccccttccaatttcccctttctccaaaccctaaaccttcgctccatcatatacctgtgccccgagccttatccggaaggaaatctcgagttcctccgctcgcagaatattcgcctctttcaatttggaattgaggggaaaacggacgtttctatgcctgttctcaaggattctatcatggatgcactgaaagttttaattgatgtgagaaatcaccccattttggttcattgcaagcgaggaaagtttcaggagtcctctcagaaggggcaggatgcttctgatattaaccataaattggcaatactgcaaaaggagaatgcagtcttactcgaaaggttggaaacattgaaaagagagcttgaagaggaaaggttgaagtgcagttcatga

SEQ ID NO: 49550 - DNA, 309 bp, Glycine max
  Peptide Sequence Number=SeqID_141235
atggaagaatttcctggtttccctccccattacacctcctggtcacttgccatggggaagtcttttattttaacattccttgctgagtggggtgatcgtagccagatagcgacaattgcactggcgacccacaaaaatgcaattggagtagcagttggggccactataggacacaccatctgtacctctctggctgtggtgggaggaagcatgctggcatctaagatttcccaacgctcagtagccactgttggtggcttgctcttcatcggcttttccatatcttcatacttctatccgcctctatga

SEQ ID NO: 49551 - DNA, 501 bp, Glycine max
  Peptide Sequence Number=SeqID_141236
atgacacctgggtttggagagctgaatccactgggattatctcaactaaatctgtctatcaaactttccatgaaggacaatctgatcaagaggcaaattcaggtggataatgatttatgtcccttctgccatagtcaacctgaaactgcatcccacttatttttcacttgtggcaaaattatgcctatgtggtgggaattcttatcttgggtaaaggaagacaaggtgtttcactgtaggccaatggataattttctccagcactattcctcagcagcatcaaaggtctctaacacaagaaggataatgtggtggatagcagctacagtttcaatctggaggctcaggaatgatatcatttttcagaatcaagattttgatattactaggctgacagataactccttgttcctattatggacctggctgagggggtgggaaaggaacttccagattccttattattgttggtcttcaaatatgtctacagcttttagttaa

SEQ ID NO: 49552 - DNA, 1764 bp, Glycine max
  Peptide Sequence Number=SeqID_141237
atggagttggcaaaatcagactgggatgcaattaagaagtctcctccatgggccatagattcttggggcatgggttgcctaatctatgaggtattctctggattgaggttgggcaaaacagaggagttacgcaacattggttccattccgaagtctctgcttccagattaccaacgactattgagttccatgccctctcgtagattaaatacatcaaagcttatagaaaacagcgaatattttcaaaataagttggtagacacgatacatttcatggaaattctcagtttgaaagatagtgtagagagagacaccttcttccgcaagcttccaaatttagctgagcaacttcctcgccagatagtgttgaagaagttacttcctttattagcttctgcccttgaatttggttcagctgctgcctcagctttgactgcattgttgaaaatgggttcctggctttcagctgaggagtttaatgtcaaggtacttccaacaattgtaaaactctttgcctccaatgatcgagctatacgagttgcccttcttcaacatattgatcaatatggagagtctttatcagcgcaagctgttgatgaacaagtttaccctcatgttgctactgggttctccgatacatctgcttttctcagggaactgactcttaagtctatgttaattctggctccaaagttgtctcaaaggacaatgtcagggtcattattgaagtatctgtcaaagttgcaggttgatgaagagccagcaattagaacaaatactaccatattattaggcaatattggaagttacttaaacgaaggaacaagaaaaagagttttgattaatgcatttacagtccgtgcattacgtgatacttttccacctgctagaggagcaggcattatggctttatgcgccaccagttcctactatgacatcactgaagttgcaacccggattcttcctaatgttgttgtgctcacaattgatcctgacagtgatgttagaactaaggcatttcaagctgttgatcagtttttgcagatagcaaagcaacattatgaaaagacaaatgcagcagataccactggtgttgcaggtgtgggaagctcatctgttcccggaaatgctagtttgcttgggtgggctatgagttctttgaccttgaagggtaaaccttctgatcatgctccagttgcttctgcaagttcaactgcaattacttcaacatcttctaatggcaccgcaggtatagagacgccatcaacagcaccagcccgtgtaaactctacctcagatttggctgaacaccctgtgcctacgtctcctacatcaacggatggctggggggaacttgagaatggaattgatgaggagcatggaagtgacagggatgggtgggatgatctggaaccacttgaagagtcaaagccagctcttgcaaacattcaagcagctcaaaggcggcctgtttctcaacctatttcacatacaaaacaagcctcgaatttgctatcaaaaagtacaccaaaattgaacaaggatgaggatgatgatttgtggggatctatagctgctcctgctccaaaaactgcaagacctttaaatttgaaatcagctcaaactgatgatgatgatccttgggctgccattgctgctccagcacccacgaccaaggccaaacccttatcgactggcagaggtaggggagccaaacctgctgctccaaaattaggtgctcagcggataaaccggacatcataa

SEQ ID NO: 49553 - DNA, 843 bp, Glycine max
  Peptide Sequence Number=SeqID_141238
atggcaatatctgtagaattggtagttttaaacactctaaggaatggaggtgggaggaaagagattaagccgtcaatgagagttgcatgccatccattttctttatctgttgtctctggaattatttatctacatttatttgaaaagtggtttcatcatcctagagacaaggctgggattgctggaagagttgccttgaatattttaggctatcctctccgcccaaatgaaccagaatgtggttattatttaagaactggacaatgtaaatttgggaacacttgcaaatttcaccatcctcaaccaaacaatatggtgctttccatgcgaagttctcctgtttatcctactgtccattctccaactacaccaggtcaccagtcatatgcgacaggaattacaaattggtctagttcatcgtatattcctagcccacgttggcaaggcccttcaagttatgcacctttaattctacctcagggaatggtttcagtgtctgggtggagtgcatacagtggtcaaatgggatcagacagtccacagcaaacaatggcaaatggccaaagctatggaacttctcgacaaagtgaaccagcaaattcaggatcccagggggcatattctcaatttcgttctggctctgttcctgtagggttctatgcgttgcagagggagaacatatttcctgagagacctgatcagcctgaatgtcaattctacatgaagactggagattgcaagtttggtgcagtctgtcgtttccatcatccacatgaaaggatgattcctgctcctgactgtgttttgagtcctataggtcttcctttacgtcctgtgagttga

SEQ ID NO: 49554 - DNA, 300 bp, Glycine max
  Peptide Sequence Number=SeqID_141239
atggccaaagcgaacactcacctccgccgcgcttcctcttcctccagtgacatctcagtctacttggacgccgacaacacttccgttcccgccgcttcttccgggcctattgacaggaatccatcctcctctatgttgtcgttgtcgccgtcgcggaatgccgaggctgcgccggttgctcaaccggccgatcaggttaacggtaagaatgctgctgttgctaaagttgataggagcaagggaagcagtgcattggcgcttgccaagttccttgacgagaaagttcccttcaagaaaaag

SEQ ID NO: 49555 - DNA, 318 bp, Glycine max
  Peptide Sequence Number=SeqID_141240
atgaccactcttacatggatatggatgacgttgctatttagcaacattctgcccagcgaccataatgccaatctcccctgcaaatggatcgcgcccacaagacgcccagtggacccgaagaagtccaacagggccctggggtttccaactctggttatgggcctctgtcagtcctacagggtgctcgtccccccagcgaggtcatgccatcgtgacataggtaaggatcgcgcccacaagacacccagtggacccgaagaagtccaacagggccctggggtttccagctctggttacgggcctctgtcagtcctatag

SEQ ID NO: 49556 - DNA, 489 bp, Glycine max
  Peptide Sequence Number=SeqID_141241
atggtggcacctccagactctatccctttaatagagcagtttaatgagatggtagcctggcccgggacccaaccttctcttcacagggaagacgaaggtcccacaacccaggtacctcagcttatggaggatgagtcatctgaggccaccatcccagagccatttgatataggagaagaggcagaggagacacaggtgagacaggtagctgttgtcactcctgagcgatcccttgagcctactttagagccttctgcaccagtggtaaacctaccctcacctcagcctacaacagacccctccactcctcttctacagatgccagaggacctgactatgccagtcttagctgtggacacttctcctccaactactctagtgcttcaattgacagatgaggaggatggtcagacacaggacacccaggaccagtcacaggaatttttattcctgatgatactttttgcttttgatttattattattttaa

SEQ ID NO: 49557 - DNA, 366 bp, Glycine max
  Peptide Sequence Number=SeqID_141242
atggaagagagcggcattaaggtgaaaaacctgcgctatgtgacctcccagccgtggcccttcccgcaatcattgatgaccgcctttatggctgaatacgatagcggcgatattgtcgtggataagaaagagctgctgagcgcagagtggtatcgctatgacgatttgccgctactgccgccgccgggcacggtggcgcgacgcctgatcgaagatacggtggcgatgtgtcgggcagagtacgaccggttgatgtcacccggtagccatggacttggccactacatgcgccaggcgggctcgctatcttccggaatacaaagccacccgcacgcgacaagcgggcgatttcatgtcgctgtgtaa

SEQ ID NO: 49558 - DNA, 151 bp, Glycine max
  Peptide Sequence Number=SeqID_141243
atgaacaaagatggtgccaactcccaagctaatgtagtaaaaagtgttgaagatgaagatgatgtgtttttgacaacaaattatgaggttgctaaaacaaaatgggtgatggattctgctgcctcaaagcacatagtagagatcgatagat

SEQ ID NO: 49559 - DNA, 606 bp, Glycine max
  Peptide Sequence Number=SeqID_141244
atgaccaccttgacacagatgtggatgacattgctacttagcaatgtcgtgcctagtgatcataactccgaccttcctctgccgaagtgtcagttggtgtatgccatcctgacacggatgaacgtccatgtggctcagttgattgctgacaccatctatttatttgcagcattgatcacgagcctctgccagtcattcgaggttcccgtcacacctagtaaggtgatccgaccgccgatcacctgggccttcattgagaagtattgcacgcctaggcaggcacagggtgatgcaccgcaggccgcagacgcaccgccaccacctcatcaggctgatcccgctgggtcattaggcatggtgcagtatctacagcacttggttcgccaacaggcggccaaccaccggggtcagcagggccagggtttcgctccttttgcgtgccctactccagatcagtttagggctgaggtcgcatggcccggagattggcccgaggcccaggcaggggaggcacctgcaggagctcccggcgatgcagaggaggcccgcatggacgagaagatgacggacttgcttggtttcttgggaggaagcggacccacgtga

SEQ ID NO: 49560 - DNA, 126 bp, Glycine max
  Peptide Sequence Number=SeqID_141245
atgacaatccaagatttacaagaacatgaaatggaattgttgagattgaatcaacatgaagaaaatgataagaagaagaagggaatcgctcttaaagcttcaccttcaaaccaagaagagagttag

SEQ ID NO: 49561 - DNA, 405 bp, Glycine max
  Peptide Sequence Number=SeqID_141246
atggctccgaagaaactctccacgaagaggtctagaagggacgccactggagaaggctccagtgccgcctcagagtttgatagtcaccgtttctggagtgccaagcaccagcagcgcttcgaggccatcaggggatggtcattccacagggagaggcgtgtccagctcagggaagatgagtactcagacttccaagaggagatagctcgcaggcattggacacctctagtgactcccatggccaagttcgaccctgagatagtcctagagttctacgctaatgcctggcccacggaggagggagttcgggacatgcgcttgtgggtaaggggtcagcggattcccttcgacgtagatgccctcagccagttcttgggcgacccactgattttggaggaagactag

SEQ ID NO: 49562 - DNA, 429 bp, Glycine max
  Peptide Sequence Number=SeqID_141247
atgcaatctcagggacttgcactaccccccaagcctctggctggtccctcaggtcctcgagtaagcacaaaggggagttatgttgatccctcaggaaacgatcctgagacgggtaactcagattggtgcggcttgtacatcgaagcagatcctaactgcttggttgccttggggacagtttacgagggatccactgttgttcataacactcatttgttgcctggtcaagtaaaggtgggtgtggaggaggttacagatgcagatgctccagttcttgtatccactgatgaggtttccttagcggggcaggcaattcacaccttccttgcttggccgacacatctggtcaagtctttatcacagcagctgtgtctctggcaaaaccacctcaaaagcccgatccggaggtcgatgatccgctttatctaa

SEQ ID NO: 49563 - DNA, 213 bp, Glycine max
  Peptide Sequence Number=SeqID_141248
atgatcgccactatcgatctgctgaagaaagccggctgccacagcatcaaggtgctggttctggtggcggcgccggaaggcatcgccgcgctggagaaagcgcacccggacgttgagctgtacaccgcctccatcgatcagtgcctgaacgacaaaggctacatcgtgcctggcctgggcgatgcgggcgacaagatatttggtaccaagtaa

SEQ ID NO: 49564 - DNA, 96 bp, Glycine max
  Peptide Sequence Number=SeqID_141249
atggcttatggaaaactgatagagatgaagggtagagttaacctagggctaaaaagattgtgggaaaagcttgggctgtgcaaaggaggaaaatga

SEQ ID NO: 49565 - DNA, 340 bp, Glycine max
  Peptide Sequence Number=SeqID_141250
gtcgactctagaggatcccacgcagcggcacgggtaaaatcttgccctggtatgtatagtagctacgcgatagcctccgtctctggttgtgctcgcacagttggcctccctccaatatcagggggtggcctaagaactgataaaagcaaactactagcccctcacccgggagcgcagatgtggagtcctatgaaggcgagggcgtgcagccctacgaaggcgaaggcatgcagccctctgaaggtgaaggcgtgtagccctatgaaggggaggacgtgtagccctctaaaggcgaggacgtgtagccctctgaaggtgaggacgtctagtccttctgaag

SEQ ID NO: 49566 - DNA, 222 bp, Glycine max
  Peptide Sequence Number=SeqID_141251
atgggggaagatttgtggccgttagtgcgtaatgaattgattaaagaacttggcaggtggtcgcatgagtacatgaacctcttcggtggcacagagagatttgaacaattaaagttgtccctacttgttgatggcttttcaaaggttagtgtggacaagtggatggatataacggacatgggatatgtgattgtattcattatgcgatataatttgttgtaa

SEQ ID NO: 49567 - DNA, 429 bp, Glycine max
  Peptide Sequence Number=SeqID_141252
atggataatgaagagggcgtgcaggaacagatgaaggccgatctatcggccttaaaagatcaaatggcttccatctcggaggtcatgttaaaactccagaaaaccatagaggataaagccacgacaaccgcctccagtacagttagggaagcggagccggtgctgcagcccgccttgaatccgggcctagacagaaacacgggggtgttcggtcgaaggtatagtctgcaagcttatccttatggcctgcctccggacttcaccccccgtgccaccccggaagatttaagccaagcccctacttttgaggggcaactcccaccttatgaagactatcccgggcaagacgatggggaaggagatacccatcttggccccctgctccacctcaaagatccttccccgcatgaactacccagccgaacatag

SEQ ID NO: 49568 - DNA, 345 bp, Glycine max
  Peptide Sequence Number=SeqID_141253
atggagcctccggtgaggggaaaatacgggaaagaagaagaaaagacgggagtcactcatttcaaatcgttttgggttggaactattgggcaactgccataccctaatttcgtccggggaccattgtttgatggcatgcaacctttgcttaaccacttcgagaagtcaaaggaaaacattgttgcacgatccgtgaaattccgtaacatgccggaaaccaaaaggaagcattgttacgcaatccgtaaggatgttcctccagaaggcggttgcttctggaggaagcaacctagctcgcctgggcgagctgggtggcaagctcctccctcattttcctataaatag

SEQ ID NO: 49569 - DNA, 331 bp, Glycine max
  Peptide Sequence Number=SeqID_141254
atggctccaaaaaagctttccgcgaaaagatctaggagggacgccgcggcggaagggaccagtgccacccccgagtttgatagccaccgtttcaggagcgccgagcaccagcagcgtttcgaggccatcaaaggatggtcgttccacagagagagacgcgcccagctcagggacaatgagtacacggattttcaggaagaaatagctcgccgacattggacatcgctggtcactcccatggctaagtttgatccagatatagtcctggagttttatgctaatgcttggcccacagaagagggagtgcgggacatgcgatcatgggtgaagg

SEQ ID NO: 49570 - DNA, 119 bp, Glycine max
  Peptide Sequence Number=SeqID_141255
gatgtaccatctgtgggggagctcatgaatctggatgttgtatagctattgaagaacaccccactcgtgaagtcaattacatgggaaatcaacctagaaaaaattttaatacaggatga

SEQ ID NO: 49571 - DNA, 262 bp, Glycine max
  Peptide Sequence Number=SeqID_141256
atgggaagaaacattttacctgagaggaaagtagagttgtatcacactaagctagataactttaaggctgagctggagaggcgtaatttccataaacgcctcaccaatttagccgatgagagcatagacctggctttggtgaaagagttctatgcaaatttatacagttctgaggatcgtccaccaaagcagtccagagtcagaggtcatttggtgaagattgatgctgacaatctcaaacgcattcctggagacacctgtg

SEQ ID NO: 49572 - DNA, 279 bp, Glycine max
  Peptide Sequence Number=SeqID_141257
atggatagagctaggttggtctatggcttagtgactaacatggacatgaacatcggagcccttatcttaggtcagatttcttctattgctcagagtaactcctctaggcttggatttctagccctgatcattgccctatgcagagctagaggagttacctctaacagtttgacttatgagagcctgaacctggccattaacttggcctacattaagaaaaactgttggaatatggatgatctaacagttaactttagaggggcaaggaaaagggcttga

SEQ ID NO: 49573 - DNA, 264 bp, Glycine max
  Peptide Sequence Number=SeqID_141258
atggcttgcttggaccaacaacattctggaaaggagggacaggctattgttgctgttgttgttattgtggttgtggaggatttgcccatctcagatttggatgattcctccaacctggattgcatctattgcttgaaacatcataattattctgcagttgttggttttgctgttgagggggtctattataagtgtttgcagcataggcttcagttgctcattgactccagattgctgcaagaaggacagagatctgtatggtga

SEQ ID NO: 49574 - DNA, 228 bp, Glycine max
  Peptide Sequence Number=SeqID_141259
atgagcaatttaaatgttgacgaagatgatgatgatgattatcttgtgtctaaatcatacgttgaagagtctttagacgaagatgatagtgttgacggtatatctgatacagacgataaagtcaccgacatgattcaaccagtaagaattgttcacccagcagaaggtgcacaaggaattgaaaatcctttttggaatgatgctttgcattataacaatatcaactag

SEQ ID NO: 49575 - DNA, 252 bp, Glycine max
  Peptide Sequence Number=SeqID_141260
atggaccttagaggagatggtgatccagcaaccaatgttatagccaattggcatatcaaagatagtgagttaatccaatcagaattacctcctacaatccaataccaactgccaaaggtcaaggacaacagtgataaacttgtcatggccacaccatttaagacaaaggatgtcaacgaagaaataaccctgaaggatattaggagcctaatggaacaggctaattacaccaacaaataccttcaggtgtaa

SEQ ID NO: 49576 - DNA, 480 bp, Glycine max
  Peptide Sequence Number=SeqID_141261
atgaaggccgacatagaggccatgaaagagcaaatggccacgatgatggaggccaagatgatcatgaagaagataatggaagccagtgcggttgcagttgtcgctaccagcactgttgctaagtacggacgaccccatgatgtgaaaattcaaaacgagcatgccttcccgccacatggcttgcctcccaactatacacgacccaatgtggtgtacactcccaatgaggatgtcaataaatgctcattgagagccgacaacctcatcatatacatgtctctcaaccgatgggggagacacatgaaattccccaccacaatcaagccgacttcgggccttgcctcggatatgccactgaagggcaagcagttgttggtgtacccctacaaaaccctttggagggccctcagtatcatccccaactacacctcttgcattccacaacaagtgaaaaccctcatgctatggcagaatgggaaa

SEQ ID NO: 49577 - DNA, 142 bp, Glycine max
  Peptide Sequence Number=SeqID_141262
gcaacatcacatatcgcagacgctcgaaattgatacaacggaagtgagaaattcctaccccgcaagggcattggatagaaaactcaaagtagattgggccagagatgcaagagaaggccctagggttcttatgagccttagg

SEQ ID NO: 49578 - DNA, 186 bp, Glycine max
  Peptide Sequence Number=SeqID_141263
atggaggtggttgtcgtcatcatcaaaaagggggagaatgtaaatcatgaaaattttgatgatatcaagaagaatttgcttgagaaagagggagatgtaaatcatgcaagctttgatggtgttgagaagaaatcacatgtttgtcatcatcaaaaagggggagaatgtgaatgtatgtatatatga

SEQ ID NO: 49579 - DNA, 450 bp, Glycine max
  Peptide Sequence Number=SeqID_141264
atgggggatggtcagccttgcagaatggcagagttcattgttgggattctcattggtggagggatcttaggaagatatatcagcacaatgacttcaagattatacatcaaaatatggcttggaaggcaggttgtggggataaaattagattttggaaagataattggctgggggaggattgcaacttgcaacagaaatattctcagctctttatcattaaggagacacctattcgagtatgaggagggagtagctgtggcttttatggaagagatcagtgcttatcctattcagtgtcatttgaaagataacttattgtggaaagctgatcctagtgggatgtattctatcaggagtctgtctgccctctttgtcatattgagcaggaggaggcaggccatctttttttccaatgcaatcagactattggcctgtggtgggaatccttga

SEQ ID NO: 49580 - DNA, 115 bp, Glycine max
  Peptide Sequence Number=SeqID_141265
atgggggtgcaaatagcacccaggcccacttgggccctctggaatattcctccagaaggcggggaggaaggcaagaaggaaggggttgggtaccgagctcgaattcgtaatcatg

SEQ ID NO: 49581 - DNA, 108 bp, Glycine max
  Peptide Sequence Number=SeqID_141266
atgggacccatcaccagagccatggcaaagagactccaagaagattgggccatagatgtaggaaaaggtcctagggttctcatgagccttaggggctccaaagtttag

SEQ ID NO: 49582 - DNA, 166 bp, Glycine max
  Peptide Sequence Number=SeqID_141267
atggctggacagaatgatcgtgcgataactgatgctctccaagccttaactcaggctatagggaatcaaaataggggagaagctgctggagttgtagagtaccaagggttgggccgtttccaacaaaacaatcctcctgctttcaatggaggatacaaccctgatg

SEQ ID NO: 49583 - DNA, 757 bp, Glycine max
  Peptide Sequence Number=SeqID_141268
tgccggaaggccaaggaagttggtgacctgatgacaggggagccgacgaccgaagccccggtgaacggcggccgtaactataacggtcctaaggtagcgaaattccttgtcggatgcggactacctgcacctggacagaaagaccctatgaagcttcactgtttcctgggattggctttgggcttttcctgcgcagctaagccatcagtgagataccactctggaagagctagaattctaaccttgtgccaggacctacgggccgagggacagtctcaggtttcctcgggccagacggagattgggcccttcgagtgcaaaggcagaagggagcttgactgcaagaccacccgtcgagcagggacgaaagtcggccttagtgatccgacgtgccgagtgaagggccgtcgctcaacggataaagttactctagggatacaggctgatcttccccaagagctcacatcgacgggaagtatgttccaagggttgggctgttcgcccattaaagcggtacgtgagctgggttcagaacgtcgtgagacagttcggtccatatccggtgtgggcgttagagcattgagaggacctttccctagtacgagaggaccgggaaggacgcacctctggtgtgccagttatcgtgcccacggtaaacgctgggtagccaaagcctccggtagcacagccgagacagcgatgggttctctgccccagcggggatggagcgaaagaagttttgagaattcaagagaag

SEQ ID NO: 49584 - DNA, 394 bp, Glycine max
  Peptide Sequence Number=SeqID_141269
atggggacaaatcaaaacggcaaaaggttttatcaagtcaaggttaaaggtctagatgtcactagcctcaaggaattgggacgattgatgggacccctccaaagacaagccttctgcaaaatttacgggaagattctagatttgaccgtagtggaggtatttacggaagccgtagtatccatcgcccaatactacgaccagccgttgaggtgtttcacgtttggggacttccaaatggtaccaactattgaagagtttgaagagatattaggatgtcctcttggggggagaaaaccgtatcttttctccggctttcttccttccttgagcaagatcgcagctgtggttggagattcagcaaaggagttggattgcatgaagcaaattcagaacg

SEQ ID NO: 49585 - DNA, 417 bp, Glycine max
  Peptide Sequence Number=SeqID_141270
atggagacatgtttagcagtggaagagttgttgcaacagatgatagatcgaggccgactagaagtcggcgatgaggggagggaagagcaacatatatgtatgcagtccgcggatgagagaagtttggaaggcctaacctttggtgatatatttcaccaaggacgcagcttcacaaaagccccgagctggtacccctcggcagtaacacctgttcgagctttcggccataccgggaacagccatcagcagccctgtgtagctaaggcacccacccagagaggaagtccaagaggttccaactccgacatcaactcgtcccggccagacctcttgccgtccctcatcgccaaccatttggccgtggtaactcccggaaaggcctccaactccttccaaagtggtggaagaatgacctaa

SEQ ID NO: 49586 - DNA, 288 bp, Glycine max
  Peptide Sequence Number=SeqID_141271
tcaagtgacatgcgtgattaccttatggttacccgcacctttcgtcaaccaggggcaaacgagcccattgaggcccggagacttacatcgtcttctgcagcttttgtcatcgtgacccgtgaatcaggtgacatgcggggttaccatatggttacccgcacctatcgtcaacaaggggaaaacgagcccgttgacgcgcggagaccaacatcgtcttcttcaccttttgtcgacctgacccgtgaagctgatatcgtcttctccaccttttgtcgtgctgacccgtga

SEQ ID NO: 49587 - DNA, 477 bp, Glycine max
  Peptide Sequence Number=SeqID_141272
atgattttgaggggccaagacatttatagtagccaagataaggctactaattcaccttcctctagtgaaagtgaaaaagcaaaagggggagaatctagtgaagaaatctacccccaagaagaaggacaaccattagtggttaaagagaagtgtaaggaggtaagtgtctcctccaagaggttagctaagaaggaaactcattttacaataaatacaaacattaaagaaactttccctcttagacaacctccacattttctcttttgtaaaaagacacttgctagcattgtcacgcctcttgggcttgattttattcctcaagtaaagaagttgttggatgagggtttgtttcgcaagagcttaaatccttgtgctttgttggtgcccaaaatagataaggatctagcttctcaaagaatcctcttgagaaagcttctcaaagaagccacaagggagcttctggaggaagcctcttaa

SEQ ID NO: 49588 - DNA, 618 bp, Glycine max
  Peptide Sequence Number=SeqID_141273
gccctgcgtgacctcactcttgttgggcggtatgcatggggagctattgggctcgtccatatgtacgatcagcttaatgatgccagtctcagcaccagccgacagcttgctggttacatcaccttgttacagtgttggatatacgagcactttccgtcagctgcggagtgcaatgttgattcagactatgatgaggtttcaccacgtgcgtgtcggtggattacgacaaagaagactgtgaagaaggtgtctacagcgacgtacaggcagcacctggatcgtctacggatcccagatgtctgctggatgccatattcagagcaccgacctgtgcaagactttcatccgatttcgtgtttctctagactggtccactgggggcctattgttgtcagatacagaccgaagagggttatgcgccagttcggctacttccagtgcactcatgcacaccatatccatcaatgggtgtcatatgatgacatagacgatacatggacgcactacttagaccatctggcaacagcaggtgatctatgtgttgtgtcaggtcagtgtgcgccagactacattgactggttcttttgtatttctcatccattcatgatcgtggcatag

SEQ ID NO: 49589 - DNA, 294 bp, Glycine max
  Peptide Sequence Number=SeqID_141274
atggcgaaagttggaacctcttacgtgccgatcaacgtctcattttcgccaaaagttggcccagggcttcccggtatttattcggcgcaaagtgcgtcgggtgatgctgcccaacttactgatttagtgtatgatggtgtttttgaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 49590 - DNA, 363 bp, Glycine max
  Peptide Sequence Number=SeqID_141275
atggaaccaattgcctccctcgcccagtattatgatcagccgttgaggtgcttcatctttggggacttccagctatcaccaatggtggaagaatttgaagagatcctaggatgtcctctagggggaaggaaaccatacctcttctcaggctctctatgtggggctggtttcacaccttttttccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaaggatgtccaaatgttcccttga

SEQ ID NO: 49591 - DNA, 552 bp, Glycine max
  Peptide Sequence Number=SeqID_141276
atgaccggccctctcgatgagtcgatctcttgctttctcataaaggtggacccttgggtactagtacctatcacctttagaggactgtatgtcctcgccatcagaggactgcacatcctcgcctgtagagggctgcacaccctcgcctttagaaggctacgcgtcctcattttcagtgtgcttcatatccacaccttaacagaatataagggatcgtgcccacaagacacccagtggactcgaagaagtccaacagggccctggggtttccagctctggttacgggcctctgtcagtcctaccaggtgccccgttcccccagcaaagtcatgccatcgtgacataggaatggcacccacaaagacacccagtggactcggagaagtccaacagggccctggggtttccagctctgggatcgcgcctgcaagacacccagtggacccgaagaagtccaacagggtcttggagttgtcaagctctaattacgggtctctatcagttctacggagtacctgtcacctccagcaagggcatcaggccccctactaa

SEQ ID NO: 49592 - DNA, 765 bp, Glycine max
  Peptide Sequence Number=SeqID_141277
atggctccgaagaagctctccacaaagaggtctaggagtgatgcccatggggaaagctctagcgcctctatggagttcgacagtcaccgggagaggcgcgtccagctcatagaggatgagtactcagacttccaagaggagatagcacgcaggcattggacacctctagtgactcctatggccaagttggaccctgagatagtcctagagttctatgctaatgcctggcccacggaggagggagttcgagatatgcgcttgtgggtaaggggtcagtggattccctttggcacagatgccttcagccagttcctgggccacccactgatcttggaggaggaccatcggtgcgaattcagccagaggagggaccaggcctctggctttgacaaggaggccatcgcccagctattgtgcataccgtggcaagactttgcccggaccgctgcggggaggcgggtgtggattatgcgcaccagcatgactactctgactcatatatggatgacgctgctactcagcaacatcctccccagcgaccataattttgacctccctctgcctaagtgtcagatggtgtacaccatcctgacacggatgactattcacgtggcccgaataattgttgatgccatttatttgtttgcagggacggcgcccactaggcaccctttggacccggagaggtccaacagggccctgggatttttggccttgatcacgggcctctgccagttctgcggggtacttgttatccccagcaag

SEQ ID NO: 49593 - DNA, 180 bp, Glycine max
  Peptide Sequence Number=SeqID_141278
atgacttgttgttcccggaggaacaaaagaatgaccaaacttggtctctgcttgtcatcgggcccgccgcctctggatgacaaaaaggtgcgaataaccgtaaggtatctccgcgtatcatgggtgcagaatgaccaaacttggtctctgcttgtcatcgggcccgccgcctctggatga

SEQ ID NO: 49594 - DNA, 387 bp, Glycine max
  Peptide Sequence Number=SeqID_141279
atggtgaaagttggaacctcttacgtgccgatcaacgtctcattttcgccaaaaagttggcccagggcttcccggtatcaacagggacaccaggatttatttattctgcgaagtgatcttccgtcacagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 49595 - DNA, 825 bp, Glycine max
  Peptide Sequence Number=SeqID_141280
atggataagaagatccgcagtattgtgagtaacatcctgaaaaatgcctctgtgcctgatgctgatgaagatgttccaacatcttccaccccagatgttgctgttcctgatgctgagaaagatgttccaacatcttccaccccaaatgctgaagtcgtctcttcacccagcaaagaggaacaagccacagaggagacccctgcaccaagggcaccagaacctgctccaggtgacctcattgaccttgaaggagtagaatctgatgaggaacccattgccaacaggttggcacctggcattgcagaaaggttacaaagcagaaaagggaaaacccccattaagaggtctggacgaatcaaaactatggcccagaagaagagcactccaatcactcctaccaaatccagaaggagcaaagttgcaatcccctccaagaagaggaaagaaatttcctcatctgattctgatgatgatgttgaactagatgtctcgacatcaaagagggccaagaaatctgggagaaaggtgcctggaaatgttcctgatgcaccattggacaacatctctttccactccattggcaatgttgacaagtggaaatatgtgtatcaacgcagacttgcggttgaaagagaactgggaagagatgccttggcttgcaaggagatcatggacctcattaaggctgctggactactgaagacagtcaccaagttgggagactgttatgaaagcctagtcagggaatttattgtcaacattccctctgacataacaaacagaaagagtgatgagtatcaaaaattatttgtcagaggaaaatgt

SEQ ID NO: 49596 - DNA, 347 bp, Glycine max
  Peptide Sequence Number=SeqID_141281
ctcccacttatcctacacctctcaagtcatttcacaaagtcggactagagtcaagctcaacagggtcttctttccccgctgattccgccaagcccgttcccttggctgtggtttcgctggatagtagacagggacacggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggccgcggcgggtgtggtggttacgccagcgtgaccgctacacttgccagcgctgatgtccggcgg

SEQ ID NO: 49597 - DNA, 2046 bp, Glycine max
  Peptide Sequence Number=SeqID_141282
atgaatcagctctcttcctctgcggatgtgattgccgtggtgccggctgccggtatcggcagccgcatgcaggccgcctgtccgaagcagtatctcactatcggtccattaaccctgctcgaacacagcgtggcgcgcctgctggcgcatccggcggtaaagcaggtggtggtgccagtcagcccggatgacggctggttcgatagcctgccgctggcgcaggatgcccgcgtgctgcgcgtcaccggcggcgaaacccgcgccgagtcggtgctggccggattacagaccatccgccacagtgcctgggtgctggtgcacgacgcggcgcgtccgtgtctgcatcctgatgatttagcgcgtctgctggcggtgcgtgagcacagcaaagtcggcgcgattctggcggcaccggtgcgcgacaccatgaagcgcgcggagcccggcaaaggtgccattgcgcataccgtcgaacgcgatgatttgtggcatgcgctgacgccgcagtttttcccgcatgcgctgctgaccgcctgcctgacgcgcgcgctcaatgaaggcgcgaccatcaccgatgaagcctcggcgctggagtattgcggttatcatcctgagctggtcagcggacgcagcgacaatattaagggctttattgcgcattctgacggcgatgtggcgctgcatgcgctgaccgacgcgctgctgggcgcggtggcgatgggcgacatcggcaaactgttcccggacaccgatccggcatttaaaggcgccgacagccgcggtttgctgcgcgaagcctggcgccgcatccagcagaagggctaccgcatcggcaacgttgatgtcaccatcatcgctcaggcaccgaaaatgctgccgcacgtgccgcagatgcgcgtcaacatcgccgaagatctcggttgccacatggatgatgtcaacgtcaaagccaccaccaccgagaagctgggctttaccggtcgcggtgaaggccgatcgggcatgagtgagctgctctacctgcacggcgtgcccgctgccactggggtgattaaagccagtcccgaagatttcgtggtaattgaagatctcggctatccctatgacggcgaaggcgagcagctactggtgcgcatccgtaaaattggctgcaacacgcgttttgtcgctgaggcgatcgccaaattcctcggcgtgcatcagcgcgatctcagctatgccggtatgaaagatcgccacgcggtcaccgagcaaacgctgtgcttccgcgtgccgggcacggcgatgcccaaccttgccggcttccagctggaaggcgtggagatcctgcaggtgattcgccacaagcgtaaactgcgcaccggcgcgctggcgggcaatgcgtttcgtctggtggtacgtcaggtgtccgaccgcgcgcaggtggaatcgcggctgcagcagattcagcagcagggcgtgcccaactactttggcgaacagcgctttggccgcggcggcaataacctgacgcaggcgcgcctgtgggtagaggagaaattccgtccacgcgaccgcagtatgaaaggcattctgctgtcggcggcgcgcagccagctgttcaatcagctgaccagcgcgcgtctgcagcgtgacggtgcgctggatcgcgtgcagcccggcgatgcgctgcagctcagcgggcgcggcagctggtttgttgcccaggcggacgagttacctgcgctgcagcagcgtgtggataaccacgagctgcgcatcaccgcaccgctggccggacgcggcgaaccgggcactcagggcgaaacgctggcgtttgaacagcagcagctggcgggcgcggccgatctgctcggcctgctggagcgtgaacgcgtcgatgcggcgcggcgcgccatgctggtggtgccgaaagatctgcagtggaactggtgggatgacgtcacgctcgagctgcagttctggctgccggccggcagttttgccaccagcgtagtgcgtgagctgctgagcaacggcgcggcggccccgctcggcgacgaataa

SEQ ID NO: 49598 - DNA, 2622 bp, Glycine max
  Peptide Sequence Number=SeqID_141283
atggaccaaaatcgtctcactcatctgcgccagctggaggcagagagtatccatatcatccgcgaggtggcggccgagttcagcaatccggtgatgatgtactccatcggtaaagactcctcggtgatgctgcatctggcgcgcaaagccttctatccgggcacgctgccgtttccgctgctgcacgttgataccggctggaaattccgtgaaatgtacgagttccgcgatcgcaccgtgaaagcgatgggcgcagagctgctggtgcaccgtaacccggaaggcgtggcgatgggtattaacccgttcgtgcacggcagcgccaaacacaccgacatcatgaaaaccgagggcctgaagcaggcgctgaacaaatacggttttgatgcggcattcggtggcgcacgccgtgacgaagagaagtcgcgcgccaaagagcgtatctattcgttccgcgatcgtttccaccgctgggatccgaaaaaccagcgtccggagctgtggcacaactacaatggccagatcaacaaaggcgaaagcattcgcgtgttcccgctctccaactggaccgagctggatatctggcagtacatcttcctggaaaacatcgaaatcgtgccgctgtacctggcagcaccgcgcccggtgctggagcgcgacggcatgctgatgatgattgatgacgatcgtatcaacctgcagccgggtgaagtgattaagcagcgtatggtgcgtttccgtaccctcggctgctggccactgaccggcgcggtggaatccgaggcgcagacgctgccggaaatcattgaagagatgctggagacgccgatgaataccgttattgcccaacagattgccgagcagggcggcgttgaagcctggctgaccgcgcaacaacacaaaagcctgctgcgtttcctcacctgcggcagcgtcgacgacggcaaaagtacgctgattggccgtctgctgcacgatacgcgccagatttatgaagatcagctgtcgtcgctgcacaatgacagcaaacgccacggcacccagggcgagaaactcgatctggcgctgctggttgatggcctgcaggccgagcgcgagcagggcatcactatcgatgtggcctatcgctatttctccaccgagaagcgcaagttcatcatcgccgacacgccggggcacgagcagtacacccgcaacatggcgaccggtgcctcaacctgcgatctggcgatcctgctgatcgatgcgcgcaaaggcgtgctggatcagacccgtcgccacagctttattgccacgctgctgggcatcaaacatctggtggtggcgatcaacaagatggatctggtggcgtacagccaggagaccttcgagcagatcaaacaggattacctcgattttgccgcgcagctgccggacgatcttgatatccgctttgtgccgatgtcggcgctggaaggcgataacgtcgccaccccgagcgtaaccatgccgtggtacagcggcccgacgctgctcgacgtgctggagacggtagagctgaagcgcgtggtcgacacgcagccgatgcgcttcccggtgcagtatgttaaccggccgaacctcgacttccgtggctatgccggtacgctggcgtcaggtacggtcagcgtcggccagcgggtgaaagtgctgccgtccggcgtggaatccagcgttgcgcgtatcgtcacctttgacggcgacctgcagcaggcggccgccggtgaggcgattaccctggtgctgaacgatgagatcgacatcagccgtggcgatctgctggtggatgccgcagccgatttgcaggcggtgcagtctgcgaccgtcgacgtggtgtggatggcggaacagccgctgcagccggggcaaagctatgaagtgaaaattgccggtaagaaagcgcgtggccgcgtcgaaaagattctccatcaggtggagatcaatacgctggaaaaacgcgcggtcgacagcctgccgctcaacggcatcggtctggtagaagtgacgtttgatgaaccgatggtgctggatgcttaccagcagaacccggtgaccggcggcatgatctttatcgatcgcctgagcaacgtgaccgtcggcgccggcatgatccatcagccgctgagcgccgcgcgcagtcaggctggccagtacagtgatttcgagctggagctgaacgcgctggtgcgcctaatggcgcaacatgacgaaaacgtggtgtggcatgaccatccggtcacgcgcgctgaacgcgaacagcagcacggccatcgtggcgtggtgctgtggtttaccgggctctctggctcgggtaagtccaccgtggccggtgcgctggagcaggcgctgcaccggctgggcgtcagcacctatctgctggacggcgacaatgtgcgtcacggcctgtgccgcgatctcggtttcagcgatgaagaccgcaaagagaatatccggcgcgtgggcgaagtggcgaaactgatggtggatgccggactggtggtgctgacggcgttcatctcgccgcaccgtgccgagcgccagatggtgcgcgatttgctcggtgacgggcagtttatcgaggtgttcgtcgatacgccgctggcg

SEQ ID NO: 49599 - DNA, 903 bp, Glycine max
  Peptide Sequence Number=SeqID_141284
atgctcggctacctgttgtacgtcggcgatcgccgcaaaacctcactgccgtatcagagccagaccgatgatccgtgcgactggtatcgcctgcggcatgaggaagcgctgacgccggacgcggtggtgcgcctggcagaagccgcttatgaaaaatatggctttaacgatttcaaactgaaaggtggcgtactgcgcggcggtgaagaggccgaagcagtaaccgcactggcgaagcgtttcccgcaggcgcgcgtaacgctcgatcccaacggggcctggtcgctgaatgaggccatcctgctcggtaaacagctgaaaggcgtgctggcctatgcggaagatccgtgcggcgctgaacagggttactccggacgtgaagtgatggccgagttccggcgcgccaccggtctgcctaccgccaccaatatgatcgccaccgactggcgtcagatgggccacacgctgtcgctgcagtcggtcgatattccgctggccgatccgcacttctggaccatgcagggctcggtgcgcgtggcgcagatgtgtcacgacttcggcctgacctggggttcgcactccaacaaccatttcgatgtttcgctggcgatgttcacccatgtggccgccgccgcaccgggcgccattaccgccatcgacacccactggatctggcaggagggcaaccagcgcctgaccaaagagccgttgcagatcaagggcggcatggtgcaggtgccgcagaagccgggccttggcgtcgaactggacatggatcaggtgatgcaggcccatgcgctgtatcagcagcatggactgggcgcgcgcgacgatgcgcaggcgatgcagttcctcgtgccgaactggacatttgataacaagcgtccgtgcctggtgcgctga

SEQ ID NO: 49600 - DNA, 541 bp, Glycine max
  Peptide Sequence Number=SeqID_141285
gcgtcagcgcgaaactgccggcgtcagcgctggtgtcggcacccagtgcggcggcagcgatgcgttttccggcgtgacggccaatccggcggttggctttgcctcggatctgctggtgcgctgtggtgcgacggtgatgttctcggaagtgaccgaggtgcgcgatgcgatccatctgctgacaccgcgcgtggtaaacgaagcggtgggcaaacggctgctggaggagatggcgtggtacgacgattatctcagccaggggcaaaccgaccgcagcgcgaatccgtcgccgggcaataaaaaaggtggcctggccaatgtgcccgattgtcgaagtgctgtcacccggacagcgcccgacgcagcgcgggctgatttacgccgccacgccggccagcgattttgtctgtggcacccagcagatggcttccggcattacgctgcaggtgtttaccaccgggcgcggcacgccttacggcctggcggcaattccggtgatcaagatggcgacgcgcagcgcgctggcgaaccgctggcatga

SEQ ID NO: 49601 - DNA, 376 bp, Glycine max
  Peptide Sequence Number=SeqID_141286
ctggacgccttatgacttgtcggtcactgacctagtactttgcttacctttggctttggacttggtcgcctactggtcggccatgtgtcgtaggcaacactctaacctttttgcggatgagctgagggacgcagtacttcttgatgaaagctcgatcagtagggggcctgatgcccttgctggagagcttgacaactccaagactctgttggacttcttcgggtccactgggtgtcttgcaggggggtacgggcaccctgtaggactgatagaggcccgtaaccagagctggaaaccccagggccctgttggactttttcgggtccactggggtgtgattggcattgcggtcgctgggcagaatgttgctaagtag

SEQ ID NO: 49602 - DNA, 442 bp, Glycine max
  Peptide Sequence Number=SeqID_141287
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctctgttctgctttcggttaccgggtgtcattccgctgtatggcgcgtttgtctcattccacgcctgacactcagttccgg

SEQ ID NO: 49603 - DNA, 318 bp, Glycine max
  Peptide Sequence Number=SeqID_141288
atggctcaaggattgtgctgttatttgtccttaaaagagatgaaacaagcgaccaacaattttgatgagccaaatgtgataggggtaggagggtttggaaaggtttacaagggtgttattgataatgggttcaaagtggctatcaaagatcgaatccgcaatcaaggtcatgttagtacacccttgaaaggtagctttggatacttggatcctgaatatttcaggaggcatcaattgaccaagaaatcagatgtgtactcatttggggttgttttatctgaggcactttatttgaggaaggtagctttggatacttga

SEQ ID NO: 49604 - DNA, 423 bp, Glycine max
  Peptide Sequence Number=SeqID_141289
atggttccagcaggtgaggtgtgcattgtgctaggtcagtgtgctagcgactacatggattggttcttccacatctcgcatactttcatgacatcaggccacgcatcagatcctctgctagatgttcatgctctgcagccccaagtcgtccctcaggccctacagacagatatctctcacgtgccagagccaggagcaccgtcgacatctgcgaggcccgctgtggaggagcctagacatgcagtggaagtttgccatgggattgctgagaggttggagcgtcatctgagcctaggggtggtcacgtcaggctcatcgacacatgaggtgatcgaagaatgcctcaggatggtcaggagtgtcacacaggaccaagtagtatatgttaggtctcgacgcaagcggcgcacggatcagacatag

SEQ ID NO: 49605 - DNA, 219 bp, Glycine max
  Peptide Sequence Number=SeqID_141290
atggcaagagtagcccaaggaggagtcgagttctaccccccgatccccgtcgaggggctcggcaccgcaacactttggtctcaagcccccgcaacctcacagacacattacatatgtcttgtcaacatcatccgaagactcagctcccggcgaccgaggaaagaagggactcgatctccattcgaggagagtgagagctgtgaaggcacccttcggtga

SEQ ID NO: 49606 - DNA, 586 bp, Glycine max
  Peptide Sequence Number=SeqID_141291
ggcgcgtcccattcgccattcaggctgcgcaactgttgggaagggcgatcggtgcgggcctcttcgctattacgccagctggcgaaagggggatgtgctgcaaggcgattaagttggatatcaagggcacaccagagaccggcttacaaatcccaggttttcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49607 - DNA, 1068 bp, Glycine max
  Peptide Sequence Number=SeqID_141292
atgaaaagagaaaaacttgtctcctatagtagtcataactcttgcaagagcctaagtgaagaacttcgtgactattatgaaggaaggcataggtcacatcttagacctcactcccgtaggagagaaaatgaacgaaagcctcaagaggttaacattgaactcccatacttccatggaaaggacaatgtagaggctaatttagattgggaaataagggtagagcaacaacttaaaaggaagtctacttcaaaatcctatggctctcactcttcccccaagaaagaccaaggtcaaggaatcttaggggtgagaccttctaagcccaaagatgataaggggaagacaatagaaaagcaacctcttaaggctagtatgcaagagaagactagctccatgaagtgctttaaatgtcttggaagagtacacattatttctcaatgccccaccaagaaaaccatgattatgaggggccaagacatttatagtagccaagatgaggctactacatcaccttcctctagtaaaagtgaagaagcaaaatgggaagaatctagtgaagagatctgcccccaagaagaaggacaacctttaatggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagattaaatccttgtgctttgttggtgcccaaaataggtattattaggcaccaaatccctaaaataggtggtgtgatgaatgctttgggtggtgcaacactcttttgtaaaatcactcgtgcacccaacatcttcatgatttgtgtacatagggactcattaggtaggaataatcaacatgaaaatacagaaaaaggggttcccatgaaccctaagagaataaaggtcattcctgagtggcccgctccaccaagt

SEQ ID NO: 49608 - DNA, 810 bp, Glycine max
  Peptide Sequence Number=SeqID_141293
tcgattcccaaagatttgtatgaagcagcagccattgacggtgccagcggctggcagcagtttcgccgtgtcaccctgccgtttctcgccccgatgatcgccattaccgtgatgctgcgtaccatctggatcgctaattttgccgatttgatcgtggtgatgaccgacggcggtccggccggttcaacctcgattctttccagttacatcttcaccaccgcttatcgcaaactggattttggttatgcctcggcgatggcgggcgtgacgctgttacctggcggtttcaccctgagccactttgcgaagcactgccgcgctgaccaccttgattgctgcgggtgccggctatgccttttcccgctttcagtttcgcggcaagatggtgatggcggccctgctgctgtttacgcagatgtttccgctggtgatgatcattgcgccgatttaccggtcatttttgatgccatcccgaaagatctcgaagagtccgccatgctggaaggctgcacccgctttcaggcgctgtaccgcgtgctgatgccgctgacgctgcccggcatggcggcgacgctcggcttcgttttcaccgccgcgtggagtgagttgctgttctcactgatgttgatcaacaaaaacgaagtcatgacctttccggtcgggctgctcagtttcgtctccaaattcgccgtttcgtggggcgaaatgatggctgccgccgtgctggcgttaattccagcctgtctgttcttcgctttcattcaacgctacctggttcagggactcaccgccggtgcggttaaggggtaa

SEQ ID NO: 49609 - DNA, 288 bp, Glycine max
  Peptide Sequence Number=SeqID_141294
actaaagaggttaaggtcatagggcagacacttaacacctttcttgcttggcctacacatcttgtcaagcgtttatcagaacagggagttgtgggaccaacgaatcctgcagataggccggatcatgaagtcgatgatcccctatatctgatgacactgaccatcccacagctttttttgaagccattgcaggttatgtgggatgctaccttgtttggcttgtttaatgaagacttccccttgtacataaagcatgaagatctgtctgaaataacacaaggtggttaa

SEQ ID NO: 49610 - DNA, 249 bp, Glycine max
  Peptide Sequence Number=SeqID_141295
atgggtgccaagtacctcgaagtgtcaaacgagggtcgcatcccaacaacgaatggtcccgggacgaaatttgggtatgacagttgcccttcttacttgtcttttattggagataaaagggaataccgacacatcatctcgatactgtcaaacttgttcctctcggttgatacaagacgcagaacaaccatgatttgtctccgcgttttgttggacacgatcgagcctgggcggcaagacacagaatga

SEQ ID NO: 49611 - DNA, 276 bp, Glycine max
  Peptide Sequence Number=SeqID_141296
atggagaaaaaaatcactggatataccaccgttgatatatcccaatggcatcgtaaaagaacatttttgaggcatttcagtcagttgctcaataccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaacgtttcatcgctctggagtga

SEQ ID NO: 49612 - DNA, 390 bp, Glycine max
  Peptide Sequence Number=SeqID_141297
atggaagctcttgtctcttgttgcaattgcatattctggatggtcatttgcctcactaactcttctaaggaggttgaggaggagcctcagttgctggttatctttgttcaaactgctgctaatgttgctgcattagaggaggaacatatggcttgctcggaccagcagcattctgaaaagaagggacaatctgttgttgttgttatggaggacttgtccatctcagatttggatgattcctccaacctggattgtatttgttgcttgaaagatcataattattctgttgttgttggttttgctactgaggagattgctgcaaggaaggacatagatctgtatggtgatctgcagaagaacatagaccacagactcttgcaacatgtgtag

SEQ ID NO: 49613 - DNA, 84 bp, Glycine max
  Peptide Sequence Number=SeqID_141298
atgggttttaccttacttcacatgaggggccaaacatctaatatagtattattaggcaccaagtccctaaaatgggtggcatga

SEQ ID NO: 49614 - DNA, 258 bp, Glycine max
  Peptide Sequence Number=SeqID_141299
atggcacaacctccaccccgtgagaggactctaagggaaatggttgcacctgatttcacctacgaaagcttgtgcatccaataccctgatgaggatgtcccatatattcttaaaactggactgatccattttcttccaaagtttcatggccttgcaggaggatcgcatatttatgaaggcctttccacattctttagagggagtggcaaaggaccggctatattaccttgctccaaggtccatcacgagctgggatga

SEQ ID NO: 49615 - DNA, 387 bp, Glycine max
  Peptide Sequence Number=SeqID_141300
atggcggttccaaagttagaaaagatgcaaagacaagctgaaactaacaagaaacagcgtagaaccatgtctaagggttcctctcagtgtggggttgcaacggcgaacaacgacggtttgtggtggctaatggtggttgtgggtgatggagaaagtgcttgggatgttagaaatggttttggaagaaagaaagaagaagaaatggtgtttttcctaagctacacgaaagcaagggctgaaaacgctcaagtgagaaatggtctcggacacggaaatatcacgcacactccagacatcttctcgaagatcccaacggcagctcatgtagcttcctcaagaagctttattaagaggcttcctcaagaagcttccttgtggcttgtttga

SEQ ID NO: 49616 - DNA, 377 bp, Glycine max
  Peptide Sequence Number=SeqID_141301
gacgagattggtaaaagagaagctgaaggtggtggtcactagggtcaggaaagaatatgatgagctgaaagatatcaacatgaccacaactgaagcgctagagcgggaaacgaaaaaggcccgaaaggaagagtggagtaggaacaagttccgaggggctttgtggggtagcagtaacgagctcaaacttagaaaggccgagagggacaaatcaaggatggaatgcatggtgttagaggataaattgaagagttgtcagagggaagctatgaaatggatggatagattcgctctcactctgaatcaagagcttccaaggttgttagccaaagccaaggcagtggctaacacgtactctgctcccgatgaagttcatg

SEQ ID NO: 49617 - DNA, 335 bp, Glycine max
  Peptide Sequence Number=SeqID_141302
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccagctggactgtatgcacgaaccccccgttcagtccgaccgctgcgccttatccggtactatcgtcttgagtccacccggaagaatgcaaagcaccactggagcagccctggtattgattaaggattatcttgatctgcgccg

SEQ ID NO: 49618 - DNA, 307 bp, Glycine max
  Peptide Sequence Number=SeqID_141303
tactgacggggtggtgcgtaacggcaaaagcaccgcccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggattgagacgggacatggcggattatgtttggcaactcatgggggctggttcccttgggggaagaagagggcctaa

SEQ ID NO: 49619 - DNA, 627 bp, Glycine max
  Peptide Sequence Number=SeqID_141304
atggtagaagtctccacaaaggccattgcctccctcgcccagtattatgatcagccattgaggtgcttcacctttggggacttccagctatcacctatggtagaagaatttgaagagatcctaggatgccctctagggggaaggaaaccatacctcttcacagggttctatccctcattagctagaatttccaagatagtccaaatctcggtgcaggaattagaccacaggaagcaagtcgaaaatggtgtggttggaataccgagaaaatatttggagacaaaagcaagaatcttggcaggagtcctttttccgaatgtggatgggttggtggacctggcagcaatcaacgtttttctcgcctatcataaccacaaggaaagctcgattgtcgctatgctagccgacctatatgacaccttcgaccgaagatgtgaaaagagcaatacaaggatagtttgctgtactccagctctttatgtatggttagtttcgcacctttttcgccaagaggtgaggcatgcttgccccctagaaagccattgttcatgcacagagaaaggaggggcaaattgggaccaactcttagcgagcaaagaaggagcatctgtcaactggttctcttga

SEQ ID NO: 49620 - DNA, 177 bp, Glycine max
  Peptide Sequence Number=SeqID_141305
atggcacgtagagacaaattatggtcattctgcgcccttttgtcatccagaggcggcgagcccgatgacatgcagagacaaattatggcggcgagcccgatgacatgcggagataccatcatggtcatccgcgcctttcgtcaatcgagaggaatgaattcagcagtatcaggatga

SEQ ID NO: 49621 - DNA, 888 bp, Glycine max
  Peptide Sequence Number=SeqID_141306
atgaggagcacgctaagccacaggaaaagccatagaagaaaaatgcagcacgcgcttagcagacacctcgcgctaagcgtgctcatgcatctcagcgaacgcgctaagcgcgtgcccatggcgctaagcgcatggcttcccgcaaacgccgagccgtgcccacacccggggaaacgtccaactgggactcttcccgtttcacatccaagattgcttggcataaatagcaggataacattcatctctagaacattcttctggaaaggaatgtctagctcgcacccgggatgtttgatgaattcctccaggagctccagaggcgtcgtgcgatttgatgcagagacgattaacgacttcctcgacaccccggtcgtcctggtagatggagaggagtacccaacctactctcagtacctccgcactcctcccgatcatgatgacatcctctccactttgtgtactccatggggacggtttgttctgaatgttgatgatgctccctggaagctgctgcggaaggatctgacgacactcgctcagacatggagtgtcctttcttattttaagcttgctcctacttctcacacttctgatattaatgttgacagggcccgtctcatatatggcttggtgatgaagatggacctggacgtgggcagtttcatttcccagcagatcagtcagatcgcccagtccagcacatccaggctcgggttcccagcgttgatcagggtaccgtgtgacattcaggggggacccgccgatccatctatcacatttccgtctggagccgctactaaggatcctgcagttgatgaagacctcattgctgactttgctagggttgattggggcccatgggcagacttgggcggaggcagcacatga

SEQ ID NO: 49622 - DNA, 384 bp, Glycine max
  Peptide Sequence Number=SeqID_141307
ggtgaaagttggaacctcttacgtgccgatcaacgtatcattttcgccaaaagttggcccagggcttcccggtatcaacagggacaccaggatttatttattctgcgaagtgatcttccgtcacagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 49623 - DNA, 411 bp, Glycine max
  Peptide Sequence Number=SeqID_141308
atggatctagggatctcccggtcatgtggctccgctccctcccaagaaatcgagccaatctttgggccatgcgacctctgccctgaaccaatctggagtagggcacggaaaaggagcgaaaccctggctctgcagactgaggctgagctggtagagacagtcatgggtctgcacatgcaccctgtggttggccgcctgctggcgaaccaaatgcccggtgcgtctggggcctgcggtgcgccaccctgtgcctgtctaaacgtgcagtacttctctatgaaagcccgggtgatcggtggtcgaatcaccttactaggtgtgacgagaaccctgaacgactggcagagacccgtgatcaatgctggaaaacccagggccctattagacttatctgggtctagaaagtgcctg

SEQ ID NO: 49624 - DNA, 570 bp, Glycine max
  Peptide Sequence Number=SeqID_141309
gggaagtcggaaggcctgtatcactttcttaaatgcgtacatggggcatcgtgctgccaaatgttgccggttctatcaagtcaaaatcaagggcttagaggtcgccagtttgcgagaattggggcaattgatgggtcagctccaacatcaagccttctgcaaggcctatgggaagatttgggacctagctacggtagaagtctttgtggaagcaattgcatcccttaccaagtactatgaccagcccctaaggtgcttcacatttagggacttccagctagtaccgactatggaagagtttgaagaaatcctgggatgttcgcttggagagagaaagccatatctctttttggggttctatcccttcatggaaagggtagcaaaggtagttaaaatctcggtgcaagagttagaccgtgtgaagcaaaataggaatggggtagtcggaataccaaggaaacatttggagggaaaggcgaaggcattggccgatcaaggagaatgggttccatttattaacacctttgcactattgatatttggagtcgtcctctttccaaatatggaagg

SEQ ID NO: 49625 - DNA, 81 bp, Glycine max
  Peptide Sequence Number=SeqID_141310
atggtttccggggcttctgcggcttccgtaaaatttccgaaaaccttggctttcttttcttccgtttttaacgtgctttaa

SEQ ID NO: 49626 - DNA, 312 bp, Glycine max
  Peptide Sequence Number=SeqID_141311
atgacaacgcagttgatccatgatcgtgttgtgatggagtgcctaaagggtgtttgggagaccctcaaaggcaatgagaggtgccgattccgtggcacaattcgactcactgctactttattagatcttgaagaggacccggaggagttacctcctgaacctgctatggacgcccttgacttaccagaggatgatgaagacccactccctaatgttgattctccagaggatattatgtcagcatctgaggcagactctactgaggagagtggccctggagggagagcgattagtgacgactcttcatcgtag

SEQ ID NO: 49627 - DNA, 351 bp, Glycine max
  Peptide Sequence Number=SeqID_141312
atgggtcgttcctccacccgccagtttcctagctggaagccgggagggcatggctgcaccaaatccaacctcctcggggagtcttcattgcatattgtggtgaattgcccttcgcgccttaaacccacactcacgaagcttctactgctgtggtacaatgggacctctttggcttgtggtcctgaccatgggccttggcctttgttcttcctttccgagacgtttctccttacgtcagcctatgtaggtgtgaggccctatctgtactgggaggtcgatctctccccttacctctcggtggctgccgtcgaaggcacgaaccaccatggaactcggcctcaagtggtgtag

SEQ ID NO: 49628 - DNA, 183 bp, Glycine max
  Peptide Sequence Number=SeqID_141313
atggtcattgcacttgatggtgcccatgttcgatacgttggatgttgtgtatgttcgtggggggtggagtgcacttaccttgtcgaatggcccattcgtgggggacaagcatgtgtatgttcatggggggtggagtgcactgaccttgtcggatggcccattcgcgggggacaagcgtggtga

SEQ ID NO: 49629 - DNA, 258 bp, Glycine max
  Peptide Sequence Number=SeqID_141314
atggagaaatccgagaacaaaaacattggagaaaagaaggcaaagaaggcctacatcacatgggatgataacgacttagaatcatctaatgattctgaaaaagaagtgattaacctatgtctaatgggaaaaaactatgaaagtgacgaagaggtaacatcttctaacaaatctatttcttttgatgagttacaagatgcatttgctgaattacatagcgaatctattaaacttacaaaacttgtttcttcatcttag

SEQ ID NO: 49630 - DNA, 832 bp, Glycine max
  Peptide Sequence Number=SeqID_141315
atgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgatttttcatggtgggctttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacg

SEQ ID NO: 49631 - DNA, 186 bp, Glycine max
  Peptide Sequence Number=SeqID_141316
atggatgacctgaactccacaagaacggatgtggagcagccaaggggatttgtcagacccaactcatccagacatgcaccccaaggagctgattataggaaccataacagagttcctactcagcaagggtataggaagggaggaattgacaagactctctttgtcaaacaagatgtgaaaacttga

SEQ ID NO: 49632 - DNA, 109 bp, Glycine max
  Peptide Sequence Number=SeqID_141317
atggatgatgacttatgttggttcctaagttgtggttctttcttgttggaggctcccaacacacttccaatgaaaggcctttttgttacaaaacttgaaagcaatgaag

SEQ ID NO: 49633 - DNA, 411 bp, Glycine max
  Peptide Sequence Number=SeqID_141318
atgtcacgtggctccccttcttcccaagaaatcgagcaattttgtcatctcctcttccatgcgggcctcctctgcatcggcgggggatcctacaggcgcctcccctgcatgggcctcgggccaatctctgggccatgcgacctcagccctaaactgctctggagtagtgatgcaagctccattggagcttgtaggcctaggatcttcttcatcaatggattcctttgcttcttggaagataaatggcagcggaatggagaaaggaagagagagaggagacgccacttcaaggagaagatgagtctagaagaagctcaccatcataggaggccatggataagagcttggaggaagaaggagatgaatgaagggagagggagagaagagaacgaaattttgtgctctaaatga

SEQ ID NO: 49634 - DNA, 96 bp, Glycine max
  Peptide Sequence Number=SeqID_141319
atgacatcaattgcctgctacaaattggagaggcgcgggggtttccaggtcctcagccccaaagcttacaaatctgttttaagttcaagcccataa

SEQ ID NO: 49635 - DNA, 403 bp, Glycine max
  Peptide Sequence Number=SeqID_141320
tggagagactctttccacgtggtccaggatcaaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggatgtggtgggatacgcgcactgaccgctagacttgcgagcgctgatgtgcggcggtgcttttgccgttacgcaccacccc

SEQ ID NO: 49636 - DNA, 450 bp, Glycine max
  Peptide Sequence Number=SeqID_141321
atgatcccatataaatcaataacacgtttaggtctttacttccagaatatcattgaggtaccctctgtttatcataaacaatgggctccagattacccaaattatgtggtgttggactacaatggaaagaagcaccatataagagttagaaaatttagtaaccgagtctacattgctgatggtctcaaacacttcaggagggatatgggaatatatgaaggagacgagtatgttactgtccttggtgttcgtgggcatcgtcacttttggaagttgagtatgcataatgggcttcaatgttttgctgagccatggttccaattcttaacagaaaatgatttgatggccggtgacgaagttgtcttttatttcaggccgaatcaacttctttgggaggtcattgccagaaagcaaactgtgtgggacgaggacgaggatgactccccgtga

SEQ ID NO: 49637 - DNA, 378 bp, Glycine max
  Peptide Sequence Number=SeqID_141322
atgggtgaagcgtgggaggtgcaagagaagatgaaggccgaaatggaggccatgaaagagcaaatggccacaatgatggaggccatgatgagcatgaagaagataatggaagggaatgcggttatggttgccgctactagcgctgtcgctaaggtgaacccgatgctcccacctggcctcaagcaaatgaatcatccaacctcaaatatggtaggcaaagatttgggaagtacggatgaccccatgatgtgcaaattcaaaacaagcacgccttcccgccatatggcttgcctcccaaactatacaccacccaatatggcgtacactctcaatgaaaatctcaataactccactccgatactcattgagaaccaataa

SEQ ID NO: 49638 - DNA, 198 bp, Glycine max
  Peptide Sequence Number=SeqID_141323
atgacaatcagaggaggagatggcggaactgcttcaagctcaagtgaagaaggtggattcaccactggagattgtgggttgtgcatgataatgaactgtcctcagaataagctttgtagcataggaactaaacgtcatgtcctccagttattgacggaggagatggagcggatgacaaagggatgtcctcagctctag

SEQ ID NO: 49639 - DNA, 234 bp, Glycine max
  Peptide Sequence Number=SeqID_141324
atggataaaagcttgaaggtaggagaagatgaatggagggagagggagagaaggatcacaaaattttgtgcctcaaaagagataagtgggctcatacttaaggctcatgagaaccctagggctttctcttgcatctctggtccaatcttcttggagtcttttatccaatgcccttggtggataggattgcatcattccctcccccttgaaaaggattggacctcaaatccgtag

SEQ ID NO: 49640 - DNA, 453 bp, Glycine max
  Peptide Sequence Number=SeqID_141325
gaaatctccgccccgttcgtaagccatttccgctcgccgcagtcgaacgaccgagcgtatgcgagtcagtgagcgaggaagcggaatatatccttaagccgtattacaattcactccgcgttttacaacgtcgtgcggaaaccctggcgttggaccgcaacttaatgcgccttgcagcacatcccccgtttcgccagctggaaagcgaagaggcccgcaccgatcgcccttcccaatgtgagttagcgtcagccgatggcaatgggacgcgcccacggcgcattatgcttccggctggtatgttgtgtggaattgtgcagcggaccgctacacttgccagcgctgatgtccggcagggcttatgccatgattacgccaagctcgaaataaccccgtcagtagctaaagggaacaaaagccactggtaccgggcaccccccatcgaggtcgacg

SEQ ID NO: 49641 - DNA, 318 bp, Glycine max
  Peptide Sequence Number=SeqID_141326
atgtgcatgatcagattgaggttgttggctcttaatgagtatgggagtggagttattgacatcctcattgggaatgtatgccacattgggtggtgtatagttgggaggccagccatatggtgggaaggcatacttgttttgaatttgcgcataatgggggggccgcccatacttcccaaatctttgcctgccatttgctctttcatggccttcatgtcggccttcatctgctcttgcaccttctctacttcacccattattctagctctagcacaggaaagaatgcaatgggcaatgcaaccaatgaaaagcatggat

SEQ ID NO: 49642 - DNA, 1132 bp, Glycine max
  Peptide Sequence Number=SeqID_141327
atgttcaaccgcgccacccaggcgctgcgtcaggtcggctcgaacatcaagccgttcctgtataccgccgccatggaccgcggcctgacgctggcctccatcctcaacgacgtgccgatttcacgctgggatgccggtgccggcgcagactggcgaccaaaaaactcgccgccgacttatgcgggtccgattcgtttacgccaggggctgggtgagtcgaaaaacgtggtaatggtgcgcgcgatgcgtgccatgggcgttgattacgccgctgagtatctgcagcgctttggcttcccggcgcagaacattatccataccgagtcgctggctctgggcgccgcatccttcacgccaatgcaggtggcgcgcggctatgcggtgatggccaacggtggcttcctggtcgatccttacttcatcgcgaagatcgagaacgaacagggcggcgtgattttccaggcgcagccgaagatcgcctgcccgcagtgcaatctgccggtgatctatggcgacaccaaaaagtcggtggcgctgaatgaagagagcgtggaaaacgtcgccacctcgaatcagcagcagaatcagaccgtgccgcagcccgagctggagcaggtaccggcgcagccgcagccggccggcgatcagcagtacgcgccgcacgtgatcaacacgccgctggcgttcctgattaagagcgcgctgaactccaacatcttcggtgaaccgggctggatgggaaccggctggcgtgccggccgcgatctgaagcgtaacgatatcggcggcaaaaccggtaccaccaacagttccaaagacgcctggttctccggttatggtccgggcgtggtgacgtcggtgtggattggcttcgatgattcgcgcgcgctgggtcgcaccacggtatcgggtgcgattccggatcagatctccggctacgaaggcggcgcgaagagtgcgcagccggcatgggatgattacatgaaagtggcgctggatggtgtgccggtgcagccgctgacaccgccggacggcgtggtgacggtgaccattgaccgcagcaccggcaagctggccaacggtggcggcaacacccgtcaggagtacttcattaacggcacccagccgccga

SEQ ID NO: 49643 - DNA, 681 bp, Glycine max
  Peptide Sequence Number=SeqID_141328
atggaagccaaggacgtgctcgccaagatcggctgcaagggaaaatgtggctacaagaaagcgctggccgaatgcccggacgtgaatgttcttgaagaccagactgcgaattggtctcgcgctgaagcgcagacccttatggagaattggctgaccgcacatcccggtcagatcaagggcgtgatcggccagaatgacgaaatggcgctcggagcgatcgaggcgatcaaggccgccaacctcaaggtgagtgatttcgcaatcgccggcatcgacggtattaccgatgcactgcatgcggtcaaggaaggcacgatgacttccattctgcaggatgcaaatgcgcaggcacaaggcgctctcgaccttgcgatcttccacgccaagaagggcgagtacaagcctcaatccgatatctgggcgcagtatccggatatgccgtttaacgacggcaagaacaagaactacaatgttccatggacgcccgtgaccgctcaaaacgtcgacaagctcctggaaagccgcaagtcacgctgcctgggcggccccgccacttatcgtgaaagtcatgatagggatgccgggccgccaggctcacaaaccagactcccgaggcacaaaatgtccgatcaagctccccaaattgacctgaacttcccgctttccggaaaaattgcaatc

SEQ ID NO: 49644 - DNA, 652 bp, Glycine max
  Peptide Sequence Number=SeqID_141329
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgctaacgaaggctttagaaaattgtagattggccaagttttgcaagatgagaaagactggtaaactgtttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49645 - DNA, 286 bp, Glycine max
  Peptide Sequence Number=SeqID_141330
gttgcaggatgtacaatttgtggtggagctcatgaatctggatgttgtatccctaatgaagagcaaattgcacatgaagttaactatatggggaatcaacccaaaggcaatttcgatacaagtggatttccaggatttcagaacaaccagcagtatcaacagtagagacaacaacaaaatcaccctggtatccaattcaatagagaccagggtggttcatctacaaggacacaacagcagatgccaagtctctatgaccaaaccacgaagctggaagagactctag

SEQ ID NO: 49646 - DNA, 432 bp, Glycine max
  Peptide Sequence Number=SeqID_141331
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaggagttagtcttgaagtcatgcgccggtaggctaaactga

SEQ ID NO: 49647 - DNA, 267 bp, Glycine max
  Peptide Sequence Number=SeqID_141332
atggagacacttcagaaggaactcaggggcagtaacaatgggcccatcggtggctaccgtaaatggttgaaagcccacgtgcaaggtttggattggattccgagtttgagaaccgctaaaagggaggaagttgaggcaccggaggaagacgaagaggtgcaagcccttaggacagaactcgagcaagctcaaacagtcaaagaaaggctaaaatcagcagctctgaagatccgaaaggagaatgccgaactgagagatataaattag

SEQ ID NO: 49648 - DNA, 258 bp, Glycine max
  Peptide Sequence Number=SeqID_141333
atgttgctgtggtgtttcgccctgcgcctgcctgggggcacagtacttcttgatgaaagctcgattagtagggggcctgatgcccttgctggaggtgacagagtggtcatgttggtgcgcatgatccgtactcgtctctttgcagcggcacgagtgaaatcttgccccggtatgcatagtagatgcgtgatagcctccctctctgaatgtgctcgcacagttggtcgccctccatatcagggggtgcccaggaattga

SEQ ID NO: 49649 - DNA, 627 bp, Glycine max
  Peptide Sequence Number=SeqID_141334
atggagcttgcatcaggtgttctcttctcatgtggaagctacccaaacatcctattgataggaacgaggggttgcattaactacaatcctgtgcttgctataagacagttagggtaccccatgaggggagcaccgacggaagaaagcctgtctcctttccttgtgagagattttggcgtgcaaaatttcaaggttatacaaagagttcataaggcgtggggaagcccgttaaggaaagataaagaacttgggggcattcgtaatggcatcattggtggttatcatgaatggctgaaagttcgtacacggggtttagattggctcgccaagttaaaaattatcaacgaagagaatttcgaagctccggaagaggatgaagaagttcgagctctgaaaaccgagctaggaaaagcgagacttgtcaaagaaaaattcaagttggtcgctacagaagtccggaaagagtgtgctgggttacaagaagaaaatccagctaccgcaagagcccttgaacaagaaaccaagagggctcgcaaggaggagcatggccgtgacaaattccgtggagctttgtggggcagcaacagtgagctcaagcttcgaagggaagagagagaccgatcataa

SEQ ID NO: 49650 - DNA, 159 bp, Glycine max
  Peptide Sequence Number=SeqID_141335
atggtgaatgagtccgagatcatcgattttcggaggcaggttttgtgggctgtaggaaaaagaaagggttttggagaggagaagagagaaaacgaaaatgagggaaagaaaatgcatcgtcagtctaaaactgacctaacatcgctatttatacctagg

SEQ ID NO: 49651 - DNA, 225 bp, Glycine max
  Peptide Sequence Number=SeqID_141336
atgaggtccttcaatggtgattttccaccatggagatgcagcggaagacaaaggagaagaggtgagaggaggtgccacccaatagggaaggaggagattcaccaccaagaatgtgtcttggataagaagcttggagaggatgcttcaatggaggaaaagaaagagacagagaaagagaaagggaagagcacgaaattgaaggaggaaaagggggagagaatttga

SEQ ID NO: 49652 - DNA, 692 bp, Glycine max
  Peptide Sequence Number=SeqID_141337
atgggatcgagtcaggtgccttcacttaaaaagaggttctatcaagtcaaggtcaagagcctaggaatcaccagtctgaaagagttagggcagttgatgggtcagctccagcgacaagcttttcgcaaagcttacggtaaaatctgggacctagccatggcagaggtctccacagaggccgttgcctccctcgcccagtattatgaccagccgttgaggtgcttcacctttggggacttccagctatcacccatggtagaagaatttgaagagatcctaggatgccctctagggggaaggaaaccataccttttctcaggattctatccctctttagctagaatttctaagatagtccaaatctcggcacaggaattagacaacagaaagcaagtcgaaaatggggtggttggagtaccgagaaaatgtttggaggcaaaagcaagaatcttggcaggtagaggcgaatgggccccgttcatagacatcctcgcacttttgatcttcggaggagtcctctttccaaatgtggatgggttggtggacctagcagcgatcgacgcttttctcgcctttcatgaccgcaaggaaagcccggttgtcgctatcctagcagatctatatgacacctttgaccgaagatgtgaaaagagcagtacaaggattgttttgctgtactccgggccctctat

SEQ ID NO: 49653 - DNA, 267 bp, Glycine max
  Peptide Sequence Number=SeqID_141338
atgaaaagtgataaagcctcacaagatatacactctatctctcaagcttgtagtgagcttcaaaacaaggaaagggaaacaaggctcaaaagggctataaaaggaattaattcaaggacgcatcaacaagaatcaagccaaggctattgtgcaagcaatcaatggggcaaaacacaccaaatgattataatgatggatggctcaaattctcacaaaggtaaaatcatcactttcaaattgagctttcaaaactatcatgacatgtag

SEQ ID NO: 49654 - DNA, 454 bp, Glycine max
  Peptide Sequence Number=SeqID_141339
atggtcatagaccagtcctttctctttgaactcactcaattatccagtgatggtgtaccatttgaaggtacacttgatgatgagtggaagttcgatttctctatttctgatacccgtcggatggtttgcaccaaccaatcggatatgactggaaggcttcttgccggttcattggcattcgaatgtcgcatcatgcactacttgattgtgcgcatcctacttcctagatcatcctaccttgcacatgtttctgaggaagatttgataattatgtgggttttcttaaccggacgcaccagcacaagccgcagaagaccattctccatcaccacctctcagagagatgattcttcatctcttatgcacaacattcttgacagattggatggactccacaccttcttcggtgagcgctttgactcattggacactgcattgatgccattgatgcacg

SEQ ID NO: 49655 - DNA, 507 bp, Glycine max
  Peptide Sequence Number=SeqID_141340
atggtatttttgaggtgttccagtggcttcagtttatatcagctgttcctcctgttcagttattgacggggtggtgcgtaacggcaaaagcacctccggtcatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaagcagccagcacgggagaaagatgaagtccagaagactcagcaagtctgctcttccatcttctcctgcctgctttatatcaagcttatcgataccgtcgacctcgagggggggcccgtcgggaaacctgtcgtgccagctgcattaatgaatcagccaacgcgcggggagaggcggtttgcgtattgggcgctagcggaatgtatactgtcttactatgttggccttgatgagg

SEQ ID NO: 49656 - DNA, 81 bp, Glycine max
  Peptide Sequence Number=SeqID_141341
atggggcctgatagtgtgatggacggtaggggcccaatagagcagcagcttaaccatggccctaagatatggaagctgtga

SEQ ID NO: 49657 - DNA, 450 bp, Glycine max
  Peptide Sequence Number=SeqID_141342
atgagaggagtgccatcagacgaaagcatcatgcctttcatcgcacgaggtttcagtgaccacaacgcgagggacagagagcttaggggaagcagtaatgggatcatcgacgactatcataagtggctgagagtccgaacacaaggattggattggctcccaaatctaaagactatgagagacgatgaggttaaagctgcggaagaaagtgatgaggtacaagccctaaaggcagagcttgaaagagcctgggtagtcgaagagaagttcaagtccatagccatcaaaggcagcaatagtgagctcaagctccgaagaggtgagactgaagggaatatgtgggccatcatcgatgagtgcaaagagaagctaaatctagcggcgactcacgagcaaaggctagaagatgagtacgccaagatatcagcagaaagggaagcaagggagagg

SEQ ID NO: 49658 - DNA, 1107 bp, Glycine max
  Peptide Sequence Number=SeqID_141343
gtcgactctagaggatccccgcttaggggcattcgtaatggcatcattggtggttatcatgaatggctgaaagttcgtacacgaggtttggattggctcccaagtctgagaaccgctaaaaggggggaagttgaggcaccggaggaagacgaagaggtgcaggctcttaggacagaactcgagcaagctcaaacagtcaaagaaaggttcaaatcagtggttctttggatccgaaaggagaatgccgaactgagggatgtaaatgtagctaccaccaaggccttggaacaagagaccaagagggctcgtagggaagagcacggccggaacaagttccgagtggctctgtggggtagtaacaacgagcttaaactccggagggaggaaagggaccaatcgtgggtagacagtttgatcttgaaggatgagttgaaggttgctcgagagaccaacatgttagccatcatcagcaagtaccaagaggaactaagtctagccacggcccacgagcatagggtggcggacgagtatgcccaagtgtacgcggaaaaggaggctagaggaagggtgatcaactcgttacaccaagaggcaaccaagtggatggaccgatttgctcttaccttgaacgggagtcaagaacttccccgattgctagccaaggccaaagcaatggcggacaccaaacgtgccacaaggcatccctatcgcaccagatccaaatctagaacgatgggtgaccaagaagagacacaggaacagatgaaagccaacatgtcggctttgaaagaacaaatggcttctatgatggaggccatgctaggaatgaggcaactcatcgagaaaaacaaggccaccgctgctgctgttagttcggcgaccgaagcagacccaactctcctagctaccgcacaccatcttcccccaaatacggtaggacgaggaaggaacacactggggcacaacagcaacccccatttgggatacaaccgagcggcttacccttatggattgccgcctaattacacgccgccagtcatgcaagatgatgcgggtcatatctcttctcccatacttgaaggggagcctcctcgacagcccgacgag

SEQ ID NO: 49659 - DNA, 351 bp, Glycine max
  Peptide Sequence Number=SeqID_141344
atgacattgctacttagcaacattctgcccagcgaccgcaacgccaatctccccctgcaaaagtatcagttggtctgtgtcgtcccgacatggggatcgcacccacaagacacccagtggacccggaaaagtccaacagggccctggggtttccagctctggttacgggcctctattagtcctatagggtgcccgtaccccccccggcaaggttatgtcatcataggtaaagtacctgtaacctccagcaagggcatcaggccccctactgatcgagctttcatcaagaagtactgcgtccctaggcaggcgcagggcgaaacaccacaacagcattgggatggccggtag

SEQ ID NO: 49660 - DNA, 462 bp, Glycine max
  Peptide Sequence Number=SeqID_141345
atggcaaaatcatcaaagaagcaaaaaggatcttcctgcaccaccaccgctgctggccactgccaccaaggaacttctggagacccacccacaccacgtcaaaggtactactctcaattctgtaatagagtcattctagaccctaagtaccttgatcttgaattttttgatgaagaaacatttgattgttaccaagagtttcaaaattctgctttgattgatttcatgactctgaaactgccctactttcctaacttagttaaggttttctataataatttgaaaattcaggatggtattctttactctgaggtgcataatattcccattgctattgatcagcccttgttctattctttgactaaactgcccagtcaaggtgttccttttgagggcatccttgttgatgactggaaatttgattattctagtcatgatgcttgtagaatggtctcacaatga

SEQ ID NO: 49661 - DNA, 414 bp, Glycine max
  Peptide Sequence Number=SeqID_141346
atgggagaaacaggtttatgctgttttgttgtagctggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49662 - DNA, 421 bp, Glycine max
  Peptide Sequence Number=SeqID_141347
atggtggaaccatcaaagaagcacaagggttcttcgagtcagagtcaatggcattccaagactcaggaaacgccaattccttcctctattccctctgcctcattgttttcatctgaagaacaacggatatggtacataaatctcttttcttctcgttccattattgatccaaaattcattgatatggatttcttttcaaatgagagttttgaatgcattcaggcatttgaaaactccaatcttattccatttatgtctttaaaattgcctgtttactctgatttagttaaagccttctattcaaacctagaaatccaagaaggcactttgatttctgaagtttatgggattaaaatggtcattgaccaatccctattctatgatttaacccaattatccagtgaaggtgtaccatttgaag

SEQ ID NO: 49663 - DNA, 408 bp, Glycine max
  Peptide Sequence Number=SeqID_141348
atgcaaagaagatctaatgcaggtgatttgatctctatcgatttggagattaacgctacttgcaggaggcgcaacatagagagaattataaattttttgcaggacttagaagctgcagcaactccaaaagaagaacctcgatcttctgaggcatcttctagctttcctattccagtaaaatctcatacagatttaattgaagaagttatcatggctgaagagccaaggagagtgaccctagaagattactcaagttcaagtgtgccgcaatttttcaccagcattgcacaaccagaggttcaggcacaaacaatcacatatcctccttctttgatacagctggttcaaaataatctatttcatggtctaccaatgaagacccataagcacacctggcacttacattga

SEQ ID NO: 49664 - DNA, 677 bp, Glycine max
  Peptide Sequence Number=SeqID_141349
atgacagcactgatacacgtactgggatcggatatcccgcaccacaaccagaccgtattgcggttctttaacgacgaactggccgccgacgcgcgggccaggacgtttatggtcgtgggtgatgcgacaggtatgcgcgaggcgtatccggcgctggaaattacctgctatccgggtaagaaatcgctggcgcaggcggtgattgccaaagcgaaagccgatcgccagcagcgcttttttttccacggccagtttaataccggtctatggctggcgttgttgagcggcgggatccgcccgtcgcaatttaactggcatatctggggcgcggatctgtatgaaaactcagccagcctgaaattccgtctgttttatcctctgcgcctcatggcgcaagggcgggtaggacgagttttcgccacccgcggcgatctcagctggtttgctaaccgccatccgcgagtgccgggagaactgctgtacttcccgacgcgtatggatccgtcgctaaattcccttgccgataccgccccgcgcggtgacaccctgaccattttagtggggaactccggcgatcgtagtaatgagcatattgcggcgctaagggcgattcatcagcagtttggcgatacggtgaatgtcatcgtaccgatgggctatccggccaacaatgaagc

SEQ ID NO: 49665 - DNA, 252 bp, Glycine max
  Peptide Sequence Number=SeqID_141350
atgattataaggggtcaagatatttatagtagtcaagaggagactacttcttccccttcctctagtggaagtgaagatgaagtaaggggtgaagagtctagtgaggaagtctacccccatgaagaaggtgacctcctaatggttagaaggatccttggaggttcagaaggaaaatcctcactacagagtcctgaatggccagttcacaactctattcggagtcatttctttcttaccactcataatctctaa

SEQ ID NO: 49666 - DNA, 699 bp, Glycine max
  Peptide Sequence Number=SeqID_141351
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcaggcggggcgtaatttttttaaggcagttatggtgcctagaatatttatctga

SEQ ID NO: 49667 - DNA, 257 bp, Glycine max
  Peptide Sequence Number=SeqID_141352
aagaagaagaagaagaagaatctgatgatgaagaggacttctcactctttgtgaagaagtttcataaattcatcaaaaatagaataatggagagaagccataacttcaacaatgggaagagatctcaagaagtttctccaacacttaaatgctataagtgtaatcaaacagatgacaatgactcatcagatggttcggagaaggagatcaaccttctatccaaggactatgaaagtgatgagaacatctctcaagaa

SEQ ID NO: 49668 - DNA, 297 bp, Glycine max
  Peptide Sequence Number=SeqID_141353
atgtttgcacattcgattaaaggttgccgtcccttgggacggacgtgtggggtgctaataccttccccatcgcgtcttttccggtttttccgacgttttcctcaaataaacgttggtggcgactccgcgcgtattcctttcgtggaacacgcatcccgcgagtctcgcgtcgccctcccgccaaagggtgttcaggaaaaaagcccagagtttcaagaacctcggggatttgaggtcaaatccttttcaaggggggagggaatgatgcaatcctaccccgcaaaggacattggatag

SEQ ID NO: 49669 - DNA, 205 bp, Glycine max
  Peptide Sequence Number=SeqID_141354
atgtcgcagaacttcacggattgcttaacgatgggtgtcaagttcctcgaagtggtcaagaaaaggttgcatgctattaaacaatggccctcatgtgaagatggatccactcctggaaatggtgcctcagctgatgctggcactgataagtctgctaaagctggaagtagggctgaagtagaagatgtagggatgccaactattg

SEQ ID NO: 49670 - DNA, 444 bp, Glycine max
  Peptide Sequence Number=SeqID_141355
atgaattgcgttttcgttcatgtgtcctccaccttcgaatttggagctatgcgtagtgattgcttagtgcaattctccattctcaatctttttcggagccccatgaattgggttttcgttcgtgtgccctccatcttcgagtttggagctatgcgtagggattgcttagtgcaattctccattctcacttttcggagccccatgaattgcgttttcgttcatgtgtcctccaccttcgagtttggagctatgcgtagtgattgcttagtgcaattctccattctcaatcttttcggagcccatgaattgtttttcgttcatgtgtccctccacttcgagtttggagctatgtgtagtgattgcttagcgcaattctccattctcactcttttcgaagcccaagaatgtgctttttcttttgggtgccttccacctccaatttag

SEQ ID NO: 49671 - DNA, 922 bp, Glycine max
  Peptide Sequence Number=SeqID_141356
gatccctgtcctctttccgaacgtggacggtttggtggacctagccgcaattgatgctttccttgcatatcaccatagcaaggagagcccggtggtagctatcttggcagacttatttgatacatttgaccgaaggtgcgagaagaacagcgcacaaattgtctactgtttacccgctctttgtgtgtggttggtttcgcacctattccaacaagacataaggcacccgtgtccgcttcaaatttatcgctcgtgcgtcgaaaagagaagagtagattgggaccaatacttggctgagataggaggcaacacaatcaactggtttcctcgatggaaggaaggaaaggagggagttctcttctcatgtggggactacccaaacgttccgttgatagggacgaggggttgtattaactataatcccgcacttgttataagacagttagggtaccccatgaggggagcaccgacggaagagagcctctcgcatttccttgtgagagatttcggcgtacaaagtttcaagatcgtacacagagtccacaaggcagttcatacacgagggttagattggctctccaagttaaaaattatcaacgtggagaacttcgaagctccggaagaggatgaagaagtccaagctctaaaattagagctaggaaaggcaagactcgccaaagaaaaattcaagaaaatgcggctaccgcaagagccctcgaacgagaaactaagagggctcgcaaggaaggccgagataaattccgaggagctctgtggagcagcaacaatgagcttaagctctagagagaggaaagagaccagtcacaagtacatggcatgtacaaaccagtctttgacccatgaacagaagctagtagaggacttcgcacaagcgtacgccgagaaggaagcaagagggagg

SEQ ID NO: 49672 - DNA, 321 bp, Glycine max
  Peptide Sequence Number=SeqID_141357
atgggcgaaagcctgacggagcaatgccgcgtgaaggtagaaggcctacgggtcatgaacttcttttcccggagaagaagcaatgacgcagccgcggtaagacagaggatgcaagcgttatccggaatgattgggcgtaaagcgtctgtaggtggctttttaagttcgccgtcaaatcccagggctcaaccctggacaggcggtggaaaactaccaagctggagtacggtaggggcagagggaatttccggtggagcggtgaaatgcgtagagatcggaaagaacaccaacggcgaaagcactctgctgggccgacactga

SEQ ID NO: 49673 - DNA, 293 bp, Glycine max
  Peptide Sequence Number=SeqID_141358
acggcgagttcgatgacatgcgggggtaccttatggttatccacaccttttgtcatccagagatggcgagttcgattacatgcacggatgacgagtccaatgacatctgggggtaccttatggttatccgcaccttttgtcaaccagaggccagcaagcccgttgacacgcaaagaccaacagatgacaagtccgatgacatgcgagggttttactttcttcatccagagacattcaagcccgacaacgcacaagattcttctttgctaggcggggacgatcgaactcgatag

SEQ ID NO: 49674 - DNA, 446 bp, Glycine max
  Peptide Sequence Number=SeqID_141359
gcatcgccaaagccttggagcaagaaaccaagagggcccggaaggaagaacacaaccgaaataagttccgaggagctttgtggggcagcaacaacgagcttaaactccagagagaagaaagagaccagtcacgagtggaaggcatgattctgaaagacgaattgaagacttgtctgaggtccaaaaggagtttgtctcagcagctaagcgagaccgaagcaaatatgttagccatcatcagcaagtacaaagaagaactggatttggcaacggtccatgagcataaggtggtagatgagtacgcccaagtgtacacgaaaaaggaggcaaggggaagggccaaggcgattgtagatgtttactcagcccccaaggaaatccatgggctcctcagctattgccagcatatgatagatttgatggctcgtataattaggaatcgttag

SEQ ID NO: 49675 - DNA, 854 bp, Glycine max
  Peptide Sequence Number=SeqID_141360
atggatggtttggtggacctagcagcaattgacgctttcctcgcctttcaacacaacaaggaaagcccggtcgtcgccgtcttggatgacatatacgacacattcgaccgaaggtgtgaaaagagtaacgcaataattgtttgctgcaagtctgccctctatgtgtggttggtttcgcaccttttccaccaagatgtgagacacacctgcccactgcaaagtcatcattcatgcacagaaaagagggaagcaatttgggaccaactcttggcaagcatagaaggggcgttggtcaactggttccctcgctggaaggaaggaagattaggaattctattttcatgcggaggatttcctaatgttcccatgatggggataaggggttgtatcaactataatcatgtccttgcaataagacagcttggctaccccatgaggggagcgtcattgatggagagcctcacaccttttgtcacatggggtttaagtgaccccaacgcaagggtgcttcaaggagtctgcaaggcatgggaggtggtgcagaggaaggacaaagaacttagagggagtagcaacgggatcgtcagcggctatcataggtggttgagagcctacacacaaggtctggattggctcttaaagctgagagccgctaaagaggaagaagctaaagccccggaggaaagcgaagaggtgcaagccctcaaagcagagctcgagaaagcccaagcagtcaaggaaagattcaaaacaacagttgtcagaatcaaaagggagaataacgaactgagggacatcaatacaactgttcggcttccaacaagtgtaccggatcgcacaagtagtataaaaca

SEQ ID NO: 49676 - DNA, 279 bp, Glycine max
  Peptide Sequence Number=SeqID_141361
atgataaatgatggaaaatacggatttggggatcccacggtcatgtggctccgcatgccaccagactcttgggtcacggtaacaaaaggtggggtggtcgacaaaagcggggcttttgctcctaccatttcgtttctcaatgaccatttagaggaaacactgggtccaacaaaaataggagaaaatcactcaaagtgtatcaatctcacacagtgcgtggcgagaaagtcgctagcgcataggatttttttggcaatcaaagggagaggaccactttag

SEQ ID NO: 49677 - DNA, 429 bp, Glycine max
  Peptide Sequence Number=SeqID_141362
atggaaaaatccgacaagatgaatttcaaagagaagaaagaaaagaaaggatatatcacttgggaagataatgtcataaattattcaagtgattcagagaagaaaatcataagtttgggtatcatgatgaaagactatgaaaatggagaagaacaaagtcgatacattgatagcaatttctccaaacacatggcatgcatcaaagtttattcatattgtctccccaagataaatgaatatgtgatttatggagacaacaaacgaaggccacatttctccccaagaaaagtgaatatgcgatttatggagacaacaaacaaaggccacttgatcaacaaccccaacaattggaagttggaagttggagtagtattggaagttgaagttaaaatggatagttggaagtctggaagttggaagttggaatga

SEQ ID NO: 49678 - DNA, 225 bp, Glycine max
  Peptide Sequence Number=SeqID_141363
atgacttaccctgcgttcattgctttcgttggtactgcttccattgtgatcaacaatcatggtgatggtgtgggtggggttgttggtgagaaaaaagaggataaagaggggatcgtagcgctctctcgtttagcaacaccaaccatgctggagctccatcaaccccagcaactaaccaaaggtctcgctccaaaccggaagcagccctttcataacctcttgtga

SEQ ID NO: 49679 - DNA, 312 bp, Glycine max
  Peptide Sequence Number=SeqID_141364
atgtgtaaccgggcttttcggccgcgattgacgaagggcgcagaagacgacgttagtctctgcgtgctatcaggcttttcgacttatagacagcaaagagtttatacggataaccactcgggtatttccacccgcttttcgtcttacagacagcaaaaagtttatacggataaccactcgggtatttccgcccgtcagcgtgactcaaaagtcagtatgacagatcttgtgagcgcggaagatgacgtaaatctccacgtgtcaacgggcttgtcggccgcgattgacgaaggtcgcagaagacgacgttag

SEQ ID NO: 49680 - DNA, 315 bp, Glycine max
  Peptide Sequence Number=SeqID_141365
agatcctttctaataggcgcttcagtcattgcatcctttggttatcaaaaagagcatgatggctcttgggcgaaaaagggtgctcgacatgttgatgaagaaggacatggtggagaagattcatctcttcttcaaaagattttggaaaggttcgatggtcttcaaaccttttttggtgaaaggtttgatactttggagttacaagtggacatgcgcttcaatgagatggagtcaagaatcaccaaggtcgaagaagatctttcttatattcgttcaagctttgatctaccaccaccgtcgccaccatcatcttag

SEQ ID NO: 49681 - DNA, 252 bp, Glycine max
  Peptide Sequence Number=SeqID_141366
atgagggacgacaagaggtcttcgtacgtcattgggatcggggtgaattctggaattagcctcgggggaaagttcctcatcgcgttggaaccggcaccaaagtgggcattgtcggccgggcgagtcgtggttggagccagagctaggggggcctccctttggatgggggtgggtgttctaggttgtacgggcgctaaattggaggagttcccggcgcgagctgaaaagctcggaagatgttgcgcatactga

SEQ ID NO: 49682 - DNA, 213 bp, Glycine max
  Peptide Sequence Number=SeqID_141367
atgagtgaagtagaggaggtgcaagagcagctgaaggccgacatggaggccatgaaagagcaaatggacacaatgatggaggccatgatgagcatgaagaagataatggaagccaatgcggttgcagttaccgctacctacgctattgctaaggtgaacctaatgcctccatctagcctcaaccaaatgaatcatccaactcagatatggtag

SEQ ID NO: 49683 - DNA, 318 bp, Glycine max
  Peptide Sequence Number=SeqID_141368
atgactaggggcaatccaggtgatttacaaccctttgatcctgaaatagatagaacctttcatagattagttaggcatagtgtgcatcctgatcactctgtgcatttcgagcattttgagcattttgagtatgttgttgctggtgattctgaatattctgattttgagcattcaactactaattttcatactgagaacatggctcaacctccacctcgtgagaggactcttagggagatggctgcaccttatttcacttacgaaagcttgtgcattcaacatcctgatgagggtgttcaatatgttctcaagacttga

SEQ ID NO: 49684 - DNA, 702 bp, Glycine max
  Peptide Sequence Number=SeqID_141369
aggactacacgtcctcaccatcatagggctacacaccttcatcttttgagcactacacgtcctcaccatcaaagggctgcaggccctcaccttcagaggactacatgtcctcgccatcagagtgtcgcacgccctcaccttcagaggactacacgtcctcaccttcagatagctggacgtctccaccatcagagggctgcacgtcctcgcctcagaggactgcacgccctcaccttcagagggctgcatgccctcaccttagaggactacacatcctcagcctcagatgggcaacacgccatcaccttgaggactacacgactacacgtcctcgccatcagagggttgcacgccctcacctttagaggactacacgtcctcgccatcagagggctgcacgcccttaccttcagaggactatacgtcctcaccttcagagggctatacgccctaaccttcagagggctgcacctcctcaccatcagagggctgcacgccctcaccatcagaggactacacgtcctcgccattagagggctgcacgccctcaccatcagaggactacacgtcctcgcccttagagagctgcacgccctcacctttagaggactacacgaccttgccataagagggtcgcacgacgtcaccttcagaggactacacgtcctcaccatcatagggctacacaccttcatcttttga

SEQ ID NO: 49685 - DNA, 757 bp, Glycine max
  Peptide Sequence Number=SeqID_141370
gggactacacgtcctcaccttcaaaggactacacgtccttatcttcagaggactacacgtcctcaccttcagaggactacacgtcctcgccatcagagggctacacgtcctcgccatcagagggctacacgccctcaccttcagaggactgcatgtcctcaccttcagaggactgcatgtcctcaccttcaaaggactacacgtcctcaccttcaaaggactacacgtcctcgccatcagagggttgcacgccctcgccatcagaggactacatgtcctcaccatcagaaggctgcacaccctcgtcttcagagggctacacgccctcaccttcagaggactacacatcctcgccatcaaagggttgcacgccctcgccatcagaggagtacacgtcctccccatcaaagggctgcacgcccttacctttagaggactacacgtcctcgccgtcaaagggctacacgccctcacctttagaggactacatgggctacatgtcctcaccttcatagggctacgtgccctcaccttcatagggctacatgccctcaccttcagagggctgcacgccctcgtctttagaggactacacgtccttaccttcagagggctacacgtcctcaccttcatagggctacacgcccgcaccttcatagggctacacgccctcaccttcagagggctgcatacaggtcctcaccttcagagggctgcacgccctcgccttcatagggctacacgtcctcgtctttag

SEQ ID NO: 49686 - DNA, 622 bp, Glycine max
  Peptide Sequence Number=SeqID_141371
atgcgtaataaaaaaaatctttgggtgttggggccccgcgacaaaaaattatcaggcattggtctttacagtactaacttaattaaagggctatcaagcaaaggatatattgatgatgttttatatatcccttttaaatcccgctccgtcatgagaactattgttttcccaagtgaattcagcaggcaagcatacctaacaacttttcaatcatcaggaaaggcaaagggaaaagttcgtgtagttattccaaactccttcgatttttcaaatgtaattgattctggaatgccgggaaataatgctgcaactaaagagcatatcatttcatttttgtatgtgggtagtgaagaagctcgtaagaatcttaatgtagctgttagtgctctagctgagttaggtcgcgataataatataagatttactaaaataggtaagcctattgttgaagagaatcgagaggaattattggcaatactttccgattccgcattggaatataaaatcattgattttgctgataaccagaaccttgagttttatctttcatcatgtgatttttttatcatgccgtcgctgcatgaaggatttggaagaacgcctatagaggctcagtatcatg

SEQ ID NO: 49687 - DNA, 723 bp, Glycine max
  Peptide Sequence Number=SeqID_141372
atgctggccggcggcaacttttatccgtggtcctgcaagccggaagatgtgtgggccgcgttacagaaagatcgcgagaacttattctttatcgatgtccaggcgcgcggcgcttatcccgcttacgccgcccgggtattccgcgagaaaggcgtggagattgtcatggcggagggcgatagcgaactgctgcgccacaccgtcgatttcatctccttcagctattacgcctcgcgctgcgcgtcggcagagatgaatgaacagaatagcagcgccgccaacgtggtgaagtcactgaccaatccgcatctggcgcgcagcgcctggggctggggcattgatccccttggcctgcgcatcaccatgaatatgatgtatgaccgctatcagaaaccgctgtttctggtggaaaacggtctcggcgcgtacgatgaaatcaatgccagcggggaaattgcagacgattaccgcatcagctacctgcaacagcacattcacgccatgggtgaagcgattgctgacggcgtgccggtgatgggctacaccacctggggctgcatcgatctggtcgcggcgtcgaccggtgaaatgagtaaacgctacggatttgtctatgttgatcgcgacgaccacggcaacggcacactcaaccggctgcgcaaaaaatccttctggtggtatcagcgggtcattgccagcaacggccgggatttggatttttaa

SEQ ID NO: 49688 - DNA, 283 bp, Glycine max
  Peptide Sequence Number=SeqID_141373
atggcaaggtatttgcatggtctcaatagggagatccaagacattgtagagttgcaccactatgcctctctgaaggatctcattcatcaagctatcaaggtggaacaacaagtaaagaggaagcaaacatacaagaagaatagaggatcttcattgaaatctcatgaaaagggtcatattgtctcccaatgtcctaacaaaaggagaatggttgtggtgggttatggggttattactagtgcatctttttctggctcttctagttcttctactgagagtgaaa

SEQ ID NO: 49689 - DNA, 315 bp, Glycine max
  Peptide Sequence Number=SeqID_141374
atgggagctaaacctatggaatattctcttgtggtttctgctgtaactacagcttacaatgctattgggcagaaagataaagcatatgattatcttgtgaagtcaatagagcctatagataaaaagttcaatgtgttcattaaaggcctccagcaaatgggtaaggaaaaagcgatgaatgaatctgaaaatgtacaaagaatcactccgttctatcggagtaacttatttgatattatgaaaccttttgattctacttattccaaggaaaaagaacagcagattacaacagcaatcatgaaagcgacccaataa

SEQ ID NO: 49690 - DNA, 402 bp, Glycine max
  Peptide Sequence Number=SeqID_141375
atgagggtagaaaacgagaggagaggacgccggaaaaaatggcaaaagaggacttcggcggagacttccggaagacccgtcagggcttcttccggaagttcccgaagaaccttttccggaacgtttccggatgaagcggtagtccgcgtctacccaaactttttcgggaagaccacttcttccggaagacttccggaaaacctcttccgggaactttccggaagaagtggttcatccggaagaattccggaagacgcgcacttccggaagaactttcaaagttccggaagacctttccggaagaaccccttcttccggaatgtttccggaagaaccacttcttccggaagtgattttatgaaaaatgaagtttgggtttttgatgtcatattttttttataa

SEQ ID NO: 49691 - DNA, 806 bp, Glycine max
  Peptide Sequence Number=SeqID_141376
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49692 - DNA, 471 bp, Glycine max
  Peptide Sequence Number=SeqID_141377
atggctcagttaatcgctgatgccatctatctatttgcaggtatggcacctaccaggcaccctctggacccggataagtccaacagggccctgggatttcccgctttgatcacaggactctgccagtcgttcggagtccccgtcgcacctagcaaggtgattcggccgcccatcacccgagcttttattgagaagtattgcacacagagacaggcccagggggatgctccgcaggccgcagacgcgccgccacctcatcaggctggcccagctggatcatttgatacggagcagtatttgcggcatttgttcagggcagaggtcgcatggcccggagattggcctgaggcccgagcaggagaggcaccagtagaggcaccagtagaggctcccgacgaggtagatgaggcccgcgaggacgaggagatgaccaatttacttgatttcttaggaggaagcggagccacatga

SEQ ID NO: 49693 - DNA, 171 bp, Glycine max
  Peptide Sequence Number=SeqID_141378
gattgtcatcatcaaaaagggaaagattgtggaagcaatgccttccaaggttattttgatgatgccaaagaatcaagagttaatcaaatttcaaagattcaagaatcaagtttcaataatcaagattcaagattcaagaatcaagtttcaagaatcaagattcaaggataa

SEQ ID NO: 49694 - DNA, 46 bp, Glycine max
  Peptide Sequence Number=SeqID_141379
gcttccgtctcttctgacggacgcgtggggtgctaataccttcccc

SEQ ID NO: 49695 - DNA, 417 bp, Glycine max
  Peptide Sequence Number=SeqID_141380
atggccagtgttctgcacctggtgattatcaacaagaagaggcccattatctgtagaatcaagcgagacctcaacaaaacttccaaggaaactactaaggctacaaaggtggctcaggtgtccatctcaaaccagaagaacactgatgcttccattaaaaatctggaagttcaggttggacaactggcaaaacaactgtttgagcatggaagtatatcttttttagcaaacacacagattaacattcctttttctgaggcattgaagcaaatgccaacatatgataaattcataaatgatttgcttacaaagaataggagaataatggatgatgaaacagtggagttggaggcaagttatagtgcaatcattcaaaaatccattctagagatcccaattgtttcacaattcctgtga

SEQ ID NO: 49696 - DNA, 393 bp, Glycine max
  Peptide Sequence Number=SeqID_141381
atggtgaaagttggaacctcttacgtgccgatcaacgtctcattttcgccaaaagttggcccagggcttcccgtgctccagtggcgtaatcatgttgtctatcagctgttccctcctgttcagctactgaacggggtggttatccgctcacaattcggcacacaagcatacgagccggaagcatcagcgctggcaagtgtaaagcctggggctgaatcggccaactgttgcgcgaagggcgatcggtgcgggcctcttgcgctattacgccagctggcgctaaagggcggatgtgctgcatactggcgattactatgttggggaagtgagagggccgcggcaaagccgtttttccataggctccgcccccctgacaagcatcacgaaatctga

SEQ ID NO: 49697 - DNA, 48 bp, Glycine max
  Peptide Sequence Number=SeqID_141382
atggctagacggaatgatcgtgtgatagctgatgctctccaagcctta

SEQ ID NO: 49698 - DNA, 237 bp, Glycine max
  Peptide Sequence Number=SeqID_141383
atgcggttgcaattgccgctaccagcgttgttgctaaggccaaagaatttgggaagtatgggcggcccccatgatgtgcaaattcaaaacgagcacgccttccccgccatatggcttgccctctcaactataccgccacccaatgtggcgtacactcccaataagaatgtcaataactccactcccatacccattgagagccagcaaccccaaactgatcatgcacatgtctcttaa

SEQ ID NO: 49699 - DNA, 1227 bp, Glycine max
  Peptide Sequence Number=SeqID_141384
tccatcgctgaatctgccgctgtcgctgaacgtctcagcgcgcctgccgctgtcgccatcggcgcaggcgaggtttttcccctcaccctaaccctctcccgcccgcgggagagggaaccgtctggcgcagccatccatcccggcacgccatctcaatctcgcgcgatccgctttctcctcatggggcagcaaagcgcatcacatttacccgcacctgcgcgcgatccactccctctccctatgggagagggccggggagaaaagggtgtgaatttccagcaacttaaaattatacgcgaagcggcccgttgcgaattcaacctgacagaagtcgccaatacgttgtttacctcacaatcgggggtgagccggcatattcgcgatctggaagatgagctgggcgtggaaatcttcattcgtcgtggcaagcggctgttaggcatgaccgaaccgggcaaagcgctgctgaccattgctgaacgcatccttgatgaggccggcaaagtgcgccggctggcggatgtgtttaccaatgaaaccagcggcgtgctgaccatcgccaccacgcacacccaggcgcgctatagcctgccgcgcgtcatcaaagcgtttcgccagctctatcccaacgtgcggctggaactcaatcagggttcaccgcaggagatcgtcgccatgctgttggccggtgaggccgatgtcggcatcgcctcggagcagctggtgaataacaccagcctggcggcattcccgtggttcagctggcaccactcgctgctggtgccgcacgatcacgagctgctggcgaatcagccggtcacgctcgtcagcctcagccgccatccgctgatcacctatcgtcaggggattaccggtcgctcacgcgtggaccgtgctttccaggctgctggcctccgcccggatatcgtgctcagcgcgcaggattctgacgtggtgaaaacctatgtcgaactcgggctgggcgtcggtatcctcgccgatcaggcgtgcgatatttacgacggcgaagacctggtgaagattgatgctcaccatctgtttgatgccaacaccgtgtggctcggactgaagcgcggccagctccagcgcaactacgtctggcagttccttgaactgtgtaacgctaacctgtcactggaagagatcaaacggcaggcgctctcttacgaaaccgacgacgaacccgccatcgatttccaaatctga

SEQ ID NO: 49700 - DNA, 366 bp, Glycine max
  Peptide Sequence Number=SeqID_141385
atgaggttaaagcttcggaagaaagtgatgagtgagactgaagggaatatatgggccatcatcgatgagtgcaaagagaagctaaatctagcggcgactcacgagcaaaggctagaggatgagtacgccaagatatcagcagaaagggaagcaagggaaagggtaattgattcattgcaccaagaggcagcaatgaggatggaccgatttgctcttactttgaacaggagtcaagaacttccccgattgttagccaaggccaaggcaatggcggacacctactccgcccccgaggagatccacaaacttctcagctattgtcagcatatgatagacttaatggactatatgattagaaaccgctag

SEQ ID NO: 49701 - DNA, 339 bp, Glycine max
  Peptide Sequence Number=SeqID_141386
atgctcaggcacggttatgagcccagaatgggtctaggcaaggatagccacgggaatgccgatgtggttgacattaggggtaacccgcacaaatatgggttggggtatgagcccgggaaacctggaagaaggaatgcatcgttaagactccaggcagatagggcatggcccggtcatgttagccagtgttgcaagtgtcaggataatgttcgaggaagaggtggcggcaataggagaagaggctccacaagatccaccgagtttcgtgcgaccatgccatcccaatttccaattagggaactagcgcatgacgagccagtcggaagtctataccgctga

SEQ ID NO: 49702 - DNA, 555 bp, Glycine max
  Peptide Sequence Number=SeqID_141387
atgggagttgttccctctacactccaccaaaagttgaaattcgtagtgagaggccgcagaggagtcattagaaaccactttccatcttttgaggtggtaagcatttcctccgtggactcattctctgggcaagcttgcctgtccgatgcagcagtaatgatggcccgagttatgttgggaaacggttacgaacccggaatgggtttgggcaaagacaacggcggcataactagcttgataaatgccaaaggaaatcgtgggaagtatggtttaggctataagcccactcaggcggatatgaagagaagcatcgcgggaaggaaaagcagtggccaaagctcgcagttgagacaagaaagtgaaggaagcccgccctgccacataagtagaagctttataagcgcgggtctgggagacgaaggtcaagtggtcgtgatatacgaagatgatgttccgagtacattggatttggtacgaccatgccctcctgatttccagctgggaaattggcgagtggaggaacgccctgacatttacgcagcgagcataatgtaa

SEQ ID NO: 49703 - DNA, 273 bp, Glycine max
  Peptide Sequence Number=SeqID_141388
atggtgaaagttggaactctacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 49704 - DNA, 428 bp, Glycine max
  Peptide Sequence Number=SeqID_141389
atgacttacaccaagaaaactgaccaaatgatgtttgaggcggcaaaggaaattgctaacaagattggaagattccatggaggaacaggcctcacaggattccatggaggaacaggcctcacaggattcctttgtcgcccatggacgttaagatccaatgtcacgatcaaacaatactttggaccgactccaagaacctcccacacatcttcgtccattgctccgaaagacatggagcagttgacgcaaaaaatcagggaccagctggaggagtcgatcacagaaaaagtgactcgacaagtactcgcactacctcctgagcctgtggatggtcgttcagctactcatgtcagcacaaaggaaaatgttgtcatctggttttgttcgttgcataataggctagacttcctgaaaggaattattatcag

SEQ ID NO: 49705 - DNA, 207 bp, Glycine max
  Peptide Sequence Number=SeqID_141390
atgataacaaaggtgatgaacaaaaagctcaaaagatcaaaaaacaactcaagtgaatcaaagaacatctcaagtaaatcaagaacaagtcaagagttcaagaatcaaggagaattcaagactcaagaagaaagcctagaatcaagaatcaagactcaagatctcaagaatcaagatcaagattcaagactcaagattcaagaatga

SEQ ID NO: 49706 - DNA, 105 bp, Glycine max
  Peptide Sequence Number=SeqID_141391
atgaaaattctaagttcgggagttgtatttacgtttgaggaaggtcgacaaaagcggggcttttgctcctacgtaccctcctttggagagggtgggatcctctag

SEQ ID NO: 49707 - DNA, 220 bp, Glycine max
  Peptide Sequence Number=SeqID_141392
actcacgggcgcatcttccaaggaaggaaaatgcgcggagtcgccaccaacggaaggtattagcaccccacgcgtccgtcacaaaggatggcagcgtttaaccgaacaaaggatcaagctgaatgttttgatgatgccaaaggatcacatgtttctcaaagctttattcaagacaaagaaattaaagatattcaagatggatgatcaagacagtctctag

SEQ ID NO: 49708 - DNA, 78 bp, Glycine max
  Peptide Sequence Number=SeqID_141393
atgtggggcatgtcataccctaatttcgtccggggacctttgctcgatgacgtgcgaccattctttggtcctcgtgag

SEQ ID NO: 49709 - DNA, 489 bp, Glycine max
  Peptide Sequence Number=SeqID_141394
atggggtacattcagaccgttcctccgccactggttcgtgattcgttgataggtactgatatagacgaccggtgggtacaattttcagatcatgtagcgcctacaggggagctctgtgtagttcctgggcaggtggccccagactacatggagtggttttttcagatttcacacccctttgtgatgccgacggaggacactgctaagccgagacctgcgcctccccctcccactcatgatgatgactttgtggagccacctgtcgccgaggttccagtcgcgtcagatccccctgcgcattctgtggttgattgcacaacgtgtgtcaggatggaaaggattgctgagcatttggagcgcgtcatcaacctcaggatggtgactgcatggactgacttatatgatatcatggatgtttgcctgaggatagctaaagatgacgacccagatgacagtcttaggccgcgacagagaccccgcatagattag

SEQ ID NO: 49710 - DNA, 101 bp, Glycine max
  Peptide Sequence Number=SeqID_141395
gttctagatcaattgaagaatcaacttttactgatgagattgaatccgacaatgaaggtggatctttggtcagtaacattactcactatttgcaagattag

SEQ ID NO: 49711 - DNA, 809 bp, Glycine max
  Peptide Sequence Number=SeqID_141396
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaactatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49712 - DNA, 354 bp, Glycine max
  Peptide Sequence Number=SeqID_141397
atgaatttgttgcctagcgctgttcatgtgtcctccaccatcgagtatggagccccgcgaattcattgcctagcgatgttcgccaattctccattctccacttttattcggagtcccttgatttcattgcctagcgctgttcatgtgtcctccaccatcgagtctggagccccgcgaattgattgcttagcgctgttcggcaattctccattctccaatcttattcggagacccatgaattcattggctagcgctgttcaagtgtcatccaccttcgagtctggagccccgcgaagttattgcgtagcgctgttcgccaattctccattctccacttttttcggagccccatga

SEQ ID NO: 49713 - DNA, 387 bp, Glycine max
  Peptide Sequence Number=SeqID_141398
atgaaggctgatggagaaatcactagtgagtctgaaatcagtgaagaagaagtggaagaagaagagtatgaggaggaagctatgcatggtgatatgttgatggtgagaaggctgttgggaaatcaaatgcagccactggatgacaatcaaagagaaaatattttccacaccagatgtgtaattaatgatattgatgaggacatgaccaagagcaagggcaaggatccacttgaaggacttggaggacctatgacaagggctagagcaaggaaagccaaggaagctcttcaacaagtgttgtccatactgtttgaatacaagcccaagtttcaaggagaaaagtccaaggttgtgagttgtatcatggcccaaatggaggaggactaa

SEQ ID NO: 49714 - DNA, 872 bp, Glycine max
  Peptide Sequence Number=SeqID_141399
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcgtttctagcgtcatttccatcatctgaaccgtattcctcaaagatttcgggagctgctgctgaaaattggatccgttgtggtttcttgtgcatagaaggtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49715 - DNA, 528 bp, Glycine max
  Peptide Sequence Number=SeqID_141400
atgtcacatgactatcatgctccaaatgggttactggatgaagtagttggtgactttagcagcgacgaagatgaaattttggcggacaataataacatcaatgacaatgacgataatgacatacagtttcttttccaaccaaaatcaactgaaaatatctatcttccatatccaaatagcgctgatgttggtgacaaccaagtggctgacaaccccgaatataggcattatttggaccagcaacaacaatctgactcgcacgatgtcgagttgtatgttggcaaaaatatccttgcaatggttgaagaaaacgagcaactaatcattcctacattcatcacattcgtaagacaagagttcggatacaccatcacatatcgtaaagcatggctagcaaaacaatgggccctcgagcatgcatatggtaattgggaagagtcatacaacatacttcacaaatacctacaaactattcctgcactggacgagtccaaccaaccaatcccaaacaaggttatattctattga

SEQ ID NO: 49716 - DNA, 851 bp, Glycine max
  Peptide Sequence Number=SeqID_141401
ttcgacaaggaaaaaataacaatgcttacagcctatgatttcactacagcaaagatggtagatgcaggaggagtagatgctgttttgataggagattctgcagccaatgtaatggcaggttttgaaactacgctgcctattactcttgatcagatgatctatcatgctcaaagcgttgtgcgtggagtagacagagctctcgttattgctgaccttccttttggaacttatcagagtaatcctgaaaaagcattagagtctgccgtgagaatgatgaaagagggcggtgcccatgctgtgaaaattgaaggcggtaaagagatttcaaaatcaatcaagaaaatagttaatgcaggaattcctgtgatggggcatttaggattaacccctcagtctatttataaattcggaacttacaaagtaagagcgaaggacgaagcagaagctgagaaactgatcagtgatgcgcagcttttagaagaattagggtgcttttctgttgttttagaaaaaattccggcagatttggctaaaaaagtatctgaaagtatctcgattccgacaatcggaatcggagcaggccctgactgtgacggacaggttttggtttatcatgatatggtaggaatgaaccagggattcagtccaaaatttttgagaagatatcttgatctttacagtgaaatcacaggggcggttgcacaatatgtaaaagatgtaaaagaggatggttcaatttcttttcaccggaaactaatgatatcctctcgaaaagggcctttgtattgttggcgcttttcttccattggaatcaaggctggctgcaatgaaaacacttgggcttcttgcag

SEQ ID NO: 49717 - DNA, 840 bp, Glycine max
  Peptide Sequence Number=SeqID_141402
atggaagaaagcatgtctcctttccttgtgagggatttcggtgcacaaaatttcaaggctatacaaagaatccataaggcatgggaaaccccgttaaggaaagatcaagaacttaggggcattcgtaatggcatcattggtggttaccatgaatggctgaaagttcatatacgagaggatgaagaagtccaagctctcaaaagcgatttaggaaaggcgaaacttgccaaggagaagttcaagttggccgctacacacatccggaaggagtgtgccggattacgggaagagaatgcaactaccgcgagagcccttgaacaagagactaagagggctcgcaaggaagagtatggctgtaacaaatttcgcggagctctgtggggtagcaacagtgaactcaagctgcgaagggaagagagggaccaattgcgagcgcatagcatggtcttgaaagaggagttaattacctgttcaaggtccaaaaggagtttgtctcagcgtttatgcgagacggagaccaacatgctagctatcatcgccaagtaccaagaagagttaggtctagccacggcccacgagcatagggtcgcggacgagtatgcccaagtatatgcggaaaaagaggctagaggaagggtgatcgattctttacaccaagaggcaaccatgtggatggatcggtttgctcttaccttgaacgggagtcaagaacttccccgattgttagccaaggccaaggcgatggcggacacctactccgcccccgaagaaattcatgggcttctcggctattgtcagcatatgatagacttaatgacccacataattagaaatcgctag

SEQ ID NO: 49718 - DNA, 501 bp, Glycine max
  Peptide Sequence Number=SeqID_141403
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacatagaaacagctatgaccatgattacgccaagctcgaaattaaccctcactaaagggaacaaaagctggtaccgggccccccctcgaggtcgacgctgcgcagcaggtgcagatttgggccgtaatttgtttcgattgatcgaattcctgcagcccgggggatccactagttctagagcggccgccaccgcggtggagctccaattcgccctatag

SEQ ID NO: 49719 - DNA, 108 bp, Glycine max
  Peptide Sequence Number=SeqID_141404
atggttttgagggacaaaaagaaggcttcatggggtgggaatgctagagtggaaaagggattggagggggaccttatagagaaacggagattcataagagagaggtag

SEQ ID NO: 49720 - DNA, 285 bp, Glycine max
  Peptide Sequence Number=SeqID_141405
atggtggtagtgatagaggcgacaaggagaaatggtaggggaggaaggttgaagaacttgaaggactttggtaagttacaagggatgaaggtgcaagaagtccaaaaatgggaccccgacattgcatcaggtaacaaagtggtgtgggttagatgctacagtattcctcttcaagcctgggaggaattttttttatctttgttagctaacaaggttggaagcttagaaggggtggatgaagacactctaactttgaagtatgtggaatatgctcgtatttggtga

SEQ ID NO: 49721 - DNA, 820 bp, Glycine max
  Peptide Sequence Number=SeqID_141406
atgagcgcggttttttatgctcgtaacccacttgccatgcctgctcatgaaaatcatgagcagggaatcattgtctctagcaggctgatcatgcaacgcatgcgtatgatgccagtcttactaagcaggcatcgaaagatgacatgctgcaggagtaatggcgtggattgggtattgtttaacgcttcacctgatgtattgcagcaaatccaggagtttgccccattgcagccagggcgtggtgtacgtgataccggtattcagggcattgtgctgattgatgcccagattgaccataccacaggcttgttcatgttgcgtgaaggccaggtcaaacgtgaaatctattgcacaaagatggtatacgaggacctgactaccggtaaccagatcctgaatattcttggtcattactgtggcattaaccaccatgaaatcgctattgatgccaatgatgtcagcaatgctcacagttttgaaatccccggcgtacctaacttgcgctttaccgctgtcgcactgaagagcgcggcgcctccatattccccacaccgcaatgatcctcatccgggtgacaccatcggtgtgttgattgaagaaatatccaccggcaaaaaatgctggtattcaccagggttggcagagattgagccacatttgccaccactgatgaaccaggcggattgtattatggttgacgggacattctggacgaatactgaaatgctggacatggggttgatgaccaagaccgcacgcagtatcggccataacccgcaatctggcccgggcggcatgatagaagagttggacaagtttg

SEQ ID NO: 49722 - DNA, 234 bp, Glycine max
  Peptide Sequence Number=SeqID_141407
atgggggtgcaaatagcaactaggcccacttgggccttccaggatgttcctccagaaggcggttgcttctggaggaagcaacctagctcgcctgggcgagctggaaaatccaagccgaggcgcttccgtaacgctttcgtgacgtttccgtgggtgatttgcaaatattttcaaccgttcttcgacgttcttcgttcactcttcgtcgttcttcggtcttcaaccgatttctaa

SEQ ID NO: 49723 - DNA, 363 bp, Glycine max
  Peptide Sequence Number=SeqID_141408
atgccaatctccccctacaaatggaccgcgcccacaagacacccagtggacccgaagaagtccgacagggccctggggtttacagctctggttacaggcctctgtcagtcctaccgagtgcccgttcccccagcaaagtcatgccatcgtgacataggaatggcacccacaaagacacccaatggacccggagaagtccaacagggccctgggatttccaactctgggatcgcgccagcaagacacccagtggacccaaagaagtccaacagggtcttggagttgccaagctctcattacgggcctcggtcagttcaacggagtgcctgtcgcccccagcaaggtcatcaggccccctactaa

SEQ ID NO: 49724 - DNA, 552 bp, Glycine max
  Peptide Sequence Number=SeqID_141409
atggctttggtgactaatcccttcctagggaggatttcatcaaaaaagaatggacctcaacatcggggaaaatcgtactcgaccccttctaagcaatatggtaaccgccccaacaataagaggattattgctttggggtttgctggtggtagtggtcgtaaacccgctactttctcaactcaaatcagttgttacaaatgtggtaagctagggcacatctcctcaaattttgctgataaagtcatgacctgtttcaattgtagacaaaaggggcatattcagagagattgttcatatcccaagaaggggcagagtggtggcggcctgaatgaccaaactagacatccgaagaccatggaaagattctttacccttaatggtgtcaaggctttgaaatccaaagatttaatccaagatactcaagtgtacatgatcttgtctaacctggaagtagagacaaaggtttccatgtgtgacctccctgttgttagagagtttccggaagtgttccctgaggatatttccagtctaccacttgagagagagagatag

SEQ ID NO: 49725 - DNA, 744 bp, Glycine max
  Peptide Sequence Number=SeqID_141410
atggcgagttattttattggcgtcgacgtaggaaccggcagcgcccgcgcgggcgtcttcgacatgactggccgtatgctcggccaggccagccgggagatcacgctctaccgcccgaaagctgattttgttgagcaatcctctgatgagatctggcagtccgtgtgtaacgcgattaaagacgtgatcagtcaggcggatatcaacccgattcaggtgaaaggcatcggttttgacgccacctgttcgctggtggtgctggataaagaaggcaaaccgctgaccgtcagcccgaccgggcgcagcgagcagaacattattgtctggatggatcaccgcgctatcacgcaggcagaacgcatcaatgccaccggccatcgcgtgctggagtttgtcggcgggattatctcgccggaaatgcagacccccaaactgctgtggctgaaacagcacatgccgaccacctggagtaacgtcgggcatctgttcgacctgccggatttcctcacctggcgcgccacccaggataccacgcgatcgctgtgctcaaccgtctgcaaatggacctatatcggccatgaagaccgctgggatccgagctatttccgccagattggcctggaggatttactggaaaacaacgcggcaaagatcggcagcgaagtgaaaaccatgggtgagccgctggggcatggcctgacgcagcgcgccgccgcagagatggggttgatggcgggcacggcg

SEQ ID NO: 49726 - DNA, 1035 bp, Glycine max
  Peptide Sequence Number=SeqID_141411
atggcacaacctccaccccgtgagaggactctaagggaaatggctgcacctgatttcacctacgaaagcttgtgcatccaataccctgatgaggatgtctcatatgttcttaaaactggactgattcatttgcttccaaagtttcatggccttgcagagggagtggcaaaggactggctgtattaccttgctccaaggtccatcacgagctgggatgaccttaagagagtattcttagaaaaaattttccctgcttccaggaccacaaccatcaagaaggatatctcagatgctgccagtggtggagcccttggagacatgactcctgctgaagccagaaatttaattgagaagatggcttccaactcccagcagtttagcgccagaaatgatgctatagtcattagaggagtgcatgaggtagctacaaactcaactgcattatctgaaactaagaagcttgaaggcaaactggatgcattggttaacttggtaacccagctggccttgaaccagaaatctgtacctgtcgcaagggtctgtggtttgtgctcctctgctgaccaccatacagacctttgcccttccatgcagcaacctggagcaattgagcagtccgaagcttatgctgccaacatttacaataaacctcctcaacctcagcagcaaaatcaaccacaacagaacaattatgacctctccaacaacagatacaaccctggatggaggaatcaccctaatcttagatggtctagccctcagcaacaacaacaggagccttctccttccttccaaaatgttgttggcccaagcagaccatacattcctccaccaatccaacaacagcaacagccccagaaacagccaacagttgaggctcctccacaaccttccctcgaagaacttgtgaggcaaatgaccatgcagaacatgcagtttcaacaagaaaccagagcctccattcagagcttaaccaatcagatgggacaattggctacacaattaaatcaacaacagtcccaggggatcctctag

SEQ ID NO: 49727 - DNA, 237 bp, Glycine max
  Peptide Sequence Number=SeqID_141412
atgacccaagagtctggtagcaggcagagacaccttctggttatccgcacctcgtcattcggagaccccgagttcgattggcaagcagaggccaatgtggtcatctgcgccctttctggagatgtcagcatctcccggtctgagttcctcatcataaatggaggatacgtaggagcaaaagccccgcttttgttgaccacccttccttttgttatcatgacccgtgaagtcaagtga

SEQ ID NO: 49728 - DNA, 228 bp, Glycine max
  Peptide Sequence Number=SeqID_141413
atggcctcgaggaagctggcctcaaagagatctaggaaggataaagcggctgaaggaaccagttccgctcctgaatatgacaagcaccgctttaggagcgctgaacaccagcagcgcttcgaggccatcaagggatggtcatttctccgggagcgacgcatccagctcagggacgacgagtatatcgatttccaggaagagatagttcgccggcggtgggcatcactg

SEQ ID NO: 49729 - DNA, 405 bp, Glycine max
  Peptide Sequence Number=SeqID_141414
atgaattgcgttttcgttcatgtgtcctccaccttcgagtttggagccatgcgtagtgattgcttagtgcaattctccattctcaatctttttcggagccccatgaactgcgttttcgttcatgtgtcctccacccacgagtttggagccatgcgtagagattgcttagtgcaattctccattctcaacctttttcggagccccatgaattgcgttttcgttcatgtgtcctccacccacgagtttggagccatgcgtagtgattgcttagtgcaattctccattctcaatctttttcggagccccatgaatttagttttcgttcatgtgtcccccacccacgagtttggagccttgcgtagtgattgcttaatgtgtcctccacctttgagtttggagccatga

SEQ ID NO: 49730 - DNA, 369 bp, Glycine max
  Peptide Sequence Number=SeqID_141415
gtgatattcgtcgatagtgggaatgaaaaggagcatgaaacattccttgcaacttggttggcagagattgatttctctcccaatggcttggatggtggaagcagtcaatactgtatcatcatcgtgattttccaaagaatattactcggtgaaagagcagtctatgcaatgatgctggtgtttccacctgaattttctcctttgaaaactattttatttggaaatccttcccaagacactgttgaaccactgatggaggctttggaggaagattataaagatggaaatgagataaatgaatcaaggcagtttattggaggagtattggatcttgaaaagagaatcaatagactagatacattgacttag

SEQ ID NO: 49731 - DNA, 233 bp, Glycine max
  Peptide Sequence Number=SeqID_141416
cgccaccgattacaaagttaaatcaatcggaggtatgtgcatcttaatccaaatgtgggcatgggaacgatgcacgaccttagcaccaaagaggacgcctcccgtcatagaaaataaaccactccgacacagcctggttcgtggtggtcccaccccccccgtttccatgttgttgagtggcaccaacccgatagagttttacgacaatttggattgcaacaacctattcccgg

SEQ ID NO: 49732 - DNA, 423 bp, Glycine max
  Peptide Sequence Number=SeqID_141417
atggcacatattgctgacaagataaaaaacattgatggatctaaagaaactctaaaacttactgtaaggataattgagctctggtttgttgggacaccgggcaggtctgaacaagctgagatgatcattgttgactctgacggtgatcagatccacgtggtctgtaagcaagaccagttaaaagcatggaaaatggatttgaaggaaggttgtacttatgtgatgcacaattttagagtcactaagaatgatagacagtacatagtttgtgatcatccatataaattgatatttattggagttacagttgtcagacagtgtgaattagatggccttcctttaaaaaagtatagatttgtagatttttcagatgtcattgctggccaattacagcctgacctattagtaggtgaaggcagctag

SEQ ID NO: 49733 - DNA, 393 bp, Glycine max
  Peptide Sequence Number=SeqID_141418
atgccattgggatatatcaacggtgcttccttagctcctgaaaatctcgataactcaaaaaatacgcccggtagtgatcttatttctttggtgaaagttggagcctcgcgtttgcgaagctcatcatcagtacgagaaacgttggcagtggcttgccctttggtgatcaacgcccttattcgaataccgtcgactaggtatttttcggcgcaaagtgcccgtactgacgggaattggtatccgcgtaatcggcaaaagcataccgccggaagcatagcgggcaagtgtagcctggggtgcgacgctgcgctaactcaccaccccgccgcgcttaatgcgccgctacagggcgcgtctttccagttcgaccatgtcaggctgcgcaactgttga

SEQ ID NO: 49734 - DNA, 409 bp, Glycine max
  Peptide Sequence Number=SeqID_141419
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctctgttcctgccttcggtttaccggtgtcattccgctgtatggccgc

SEQ ID NO: 49735 - DNA, 435 bp, Glycine max
  Peptide Sequence Number=SeqID_141420
atgaagcacttcactgacaccctcatcagtgccaacatacgcaagattagcgctaagccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49736 - DNA, 258 bp, Glycine max
  Peptide Sequence Number=SeqID_141421
atggaggttgatgataattcagattcagaaggggaagatgttgtggccaagaaattaggatgcaaaattgaagtgattccctctttaaatgtagttgtggctgatggaaataagaactttgataagctgactatggagtttgttacacaaggaaggagacatgtgctgagaggggcttctaatgctaagctaaaaatagtgaagaagcagcaattgcacaaggcactttcttcgtgtatgcacatttctatgttgtaa

SEQ ID NO: 49737 - DNA, 396 bp, Glycine max
  Peptide Sequence Number=SeqID_141422
atgcacaaatgccttaggtttagggtatcacagtacaaagtgaaggatgataacgagtgtagtagtgacgaaaactcaaagaagggcccccaacaaaggtgttgtggtatcttccgatcattccaaggtttaggtgactatttgctaatagagacgatgcaaaagaccttacatggcatgcaaatgggagaaactgcgatggaatgctccgtcatccaactgattcctccaagtggaagaagattgatagtttgtatccaaatttcgtttaagcactcaacacaattcgtggctagtcttgctagtaatttacaatctgcctccttggttgtgcatgaagcgaaaatacatgatgttgtctatgatgatatcgggcccaagagagccaggaaatga

SEQ ID NO: 49738 - DNA, 480 bp, Glycine max
  Peptide Sequence Number=SeqID_141423
atgatgcagtgtcccactgccgcttccctttctcaccgattagaactcaagggaagtgttccaagccttgttactttgaacattctcattaattgtttctatcatatgggtcaaatcacgtttggcttctctttattgcggcctacgattctcaagaggagttaccagccaaacaccataaccttgaacacactcatcaaaggtttctgtcttaagggacgcgtcaagaaaacactcacaaggattttagttatgctgaaagaagcaactaacttcttaaatgaaattgtattgaaaaccatcaacccaagtgtttatacctataatgatgcattatgtaaaaaagggaaggtgaaagaagccaaaacacacgaagatgacgtgacgataatggagggcacgattgacaatgattggggagaggacgatggagagaggctgacaggcgacaccacggaggctaggttacggagagcatga

SEQ ID NO: 49739 - DNA, 411 bp, Glycine max
  Peptide Sequence Number=SeqID_141424
atggtgaataggcaaaacagcttggtgaaggatggaagtagacccattgtttctcttgctttcttcatacatggattgcctaggcctctgttcacacgtaatcacaacaactcaaagaaaagaaggctggccaattcaaaatcatatattagtaaccgtgcaattttaatggactctgggtcattattttatactgctgcaagagcttttaagttccattctctatctcttgggtttatctctatctacattgttgagagtggtacaacatcggatcttagaatcatcgatgcacctttccatgaccagctctactttgctgttgctaatcaaccatgcttgcttgatgttggaattgatgcaatgtatacaaagccttccaatcagagcaacttcatttgcagacattaa

SEQ ID NO: 49740 - DNA, 1341 bp, Glycine max
  Peptide Sequence Number=SeqID_141425
atggtgaataggcaaaacagcttggtgaaggatggaagtagacccattgtttctcttgctttcttcatacatggattgcctaggcctctgttcacacatccaaagattggttgtcagatatctgaactccctaaaattccttgccaaagtaacgagtttgacagtgagcttcttcgtggtgtgcgcctccattttgatagggatttggaaaaggcacaacttggtctggggcatagttacagcagagcaaaggtgaaattcaatgttaaccgtgccgataatatcgtcattcaagcaattttccttcttgatacacttgataaggatattaattcattctccatgagagtcagaattattaaacttgaagagttgaattctctgctgttcatcaattgtgtgccgagaatggataaatcaaagctgtctgaagacaagattgcagccgtaactgacatagttcgtgatgaagataaagcgaaggagattgtggaagctgccaaggcctccatgggacaatatttgtccccagtggacttgattaatgtccaacaatttgcacagagagtaatggacctatccaagtacaggcggaagttgtatgattacctggttgctaaaatgaatgacattgcactaaatttggcctctttaattggtgaagttgttggtgcacgattaatttcccatgcaggtagcctcacaaatttagctaaatgcccttcttcaactcttcaaattcttggtacagagaaagctctgttcaggttcctgcttcacacatataaggcaatagttgcccatcactcaaatcccccatcatttgcagccaaacttccttgtcatggttcccaaaggggtactactacgtttggggagaaactccgtgagcaagttgaggagcgacttgatttttatgacaagggagttgcccctcgtaagaacatagatgtcatgaagttggctattgaaagtgttgaaaacaaagatacagcgatggaaatagaagcaccagttgaagtttcaggcaagaaagccaagaagaagcatacagctgtcgttacagatgacatggctgtagataagcccacagagactacaaatggtgatgcattggaggatcataagtcagaaaagaagaagagaaagaaagaaaagaggaaattggacacggagaacgatcaagccatggatgatggtgctaatggggttgaaagcgaacaagatggagcagttaaaaagaagaaaaaaaaggataaaaagggtgataatggagaagtactagtggctgctattgagactaagaagaagaagaataaatcaaaaaatagagatacttaa

SEQ ID NO: 49741 - DNA, 1050 bp, Glycine max
  Peptide Sequence Number=SeqID_141426
atggcggatgagagccccaaaccagagaccttcgaactcaacaatggaagcatgcaggtcctcctcaccaatctcggctgcaccatcatctccttatccgtacctggaaaagatggtctttttccgttccaatttttcattttcattttcattcattgctatttgcgtttcactctctctctttctgttttcaagaaaggtcttgctccttattttggctgcattgtgggtcgagttgctaaccgaattaaggatggcaagtttacacttgatgggattcattactctttgcctatcaacaatccaccaaacagtctccatggtggaaatgttgggtttgataagaaggtatgggaggtagttgaacataagaaaggcgaaaccccctcaatcacttttaagtgccacagtcatgatggagaggaaggttatcctggggatatcactgttactgccacttacacactcacctcaagcacaactctgaggcttgacatggaaggagtgccaaagggcaagcccaccatagttaacttagctcagcatacctactggaacttagctggccacaactcagggaatatacttgaccattcaattcagttatgggctaatcatatcacacctgtgaacgagaataccgtgccaaccggtgaaatcatgccagtgaagggtaccccttttgattttacatcttttaatagaataggcagcaccattagtcaggttggactgggatatgatcacaattatgtgcttgattgtggggaagagaaagagggtttgagacatgctgcaaaagtgagggatccatcaagttcaagagtacttaacttgtggacaaatgcccctggtgtgcaattttacactgcaaactatgtgaatggtgttcaaggaaaaggaggtgctatatatggaaagcatgctgggttatgtctcgagacacagggattccctaatgccataaaccagccaaattttccttctgttgtggttcgtccgggcgagaagtatcaacataccatgttgtttgagttttcacttgagtga

SEQ ID NO: 49742 - DNA, 390 bp, Glycine max
  Peptide Sequence Number=SeqID_141427
atggaaagagagacagaaaaccttaaccttcgtgagaatgacatggttgagaatggattgtgtttgttggggagaaatcaaagctcggttttctccgatttcagcttcggcgtaaagccaatgcaagaacttatggaatggaaggcagggcatatacaaaacttcttttctcttgaccagaattgcatgggcgtcgggagcggaggtgaaggggttgaaggagcggcgcttgacaaccttgccgaacctgttgaggtcggaaacggagttgcaaacggcctccgtgttgtgtccaatatcgtcgaggccgtgcgcctccaagagagcgtaacccgacgccgactcgtagaggaggaacagcgccattgcaaccctaaaacggagcagtga

SEQ ID NO: 49743 - DNA, 624 bp, Glycine max
  Peptide Sequence Number=SeqID_141428
atgaagcactattccactgctgtttccctttctcaccgattggaactcaagggaattcagcctgacttttttactttgaacattctcatgaattgtttctgtcatatgggtcaaatcaatttcggtttctctgtattggccaagattctcaagaggggttaccagcctcacaccataaccttcacaacactcatcaaaggtctctgtcttaagggacaagtcaataaagcactgcactttcacgacaagctattagcacaaggaattaagttcgaccaagttagttatgggactttgatcaatggagtatgcaagataggagacacaagaggtgccatcaagttggtgagaaagattgatggacgactgactaaacctaacgtggaaatgtacaacacaattattgacgccctgtgcaaatatcaacttgtaagtgaggcttatggtttattttctgaaatgactgccaagggaatttctgctaatgttgtgatagcaacgaaggcagcaggacacaggacacaggacaagggacacttacgcaaggcaggcccaaaaggattactaggagaccagcccaatatcaagattacatttagtttcagtatcacgagttcttgctga

SEQ ID NO: 49744 - DNA, 468 bp, Glycine max
  Peptide Sequence Number=SeqID_141429
atgatgcagtgtcccactgccgcttccctttctcaccgattagaactcaagggaagtgttccaagccttgttactttgaacattctcattaattgtttctatcatatgggtcaaatcacgtttggcttctctttattgcggcctacgattctcaagaggagttaccagccaaacaccataaccttgaacacactcatcaaaggtttctgtcttaagggacgcgtcaagaaaacactcacaaggattttagttatgaaaaacatggttcctaacatggtgacacgcaattctcttatcgatggtttgtgcaagttagggagaatctcttatgtttgggatcttattgatgagatgcatgatatagcaacacacgaagacggcgtgacgataatggagggcatgattgacaatgattggggacaggacgatggagagaggttgacgggcgacaccacggaggctaggtga

SEQ ID NO: 49745 - DNA, 51 bp, Glycine max
  Peptide Sequence Number=SeqID_141430
atggaaaacaaattcttgtacttcagtacatctggtactcattatatataa

SEQ ID NO: 49746 - DNA, 837 bp, Glycine max
  Peptide Sequence Number=SeqID_141431
atgtcatcagcttctaagctcacactgtacggaatcggaaccgcactgttccgcacccgtcgaactgcacctgtaagtgtaactccctttctcttcttcaaacccattcccttacctcggccgccgcgcttcctcctcctccgcgattcctcttcctcctccgccgccgccgcagaaatcctaccctccgttgaccacccctggccggaatgggtctccttcgtcgaccgcttgagcaccaaaggctacctccccaaaccctcctcttcttccgatgacaccgtaagcctttacaccaacatgaactctctcaaggacgcttgtctcagcttctcgcgtgaccgttacgaccttttcaagttgctgcctacgcacgatatccaagcagtagttgagggtgggtgccctaatcttctccgtaaagctgttaattcggccaagaggctgagagcacacctgcaattagatgaaggggatgtttgtggtgcttgcaatctacgaagctcttgtgatagagcttatgtgattctaaaggattttgaaactgatgctcgaactattgatatagttcgaatacttttgttctacgcactagatccactagtgctttctggtggagacaaaccaccgggccgagaagttattgaatcatccgccagaaaacttctctctcagctaattgagttgagtgagtcccctgctccagcccctgcttctgctcgttcaaagcctactgcacaggatgctgtgggagaaggccaatctctaagtgttacgactaatcaattgtttaaagatgctgagatgaagaaaggtgactggatgtgtccaaagtga

SEQ ID NO: 49747 - DNA, 129 bp, Glycine max
  Peptide Sequence Number=SeqID_141432
atgagcaagcttgatgggccttacccttgcatatgcaaagaggctgttttcggatttgaacccatgaccaacaagtcaccaaggcacaactttaccgctgcaccagggctcgccctcatgagaatttaa

SEQ ID NO: 49748 - DNA, 2568 bp, Glycine max
  Peptide Sequence Number=SeqID_141433
atgaagaaccttcttaagaagcttcatatcatgtctaaccaatcagagaatgaacaagggtcttcttcatcatcttcaaagggaggaaacaagtccaatctaggttcatcttcatcttccaagaagaaggttgtgcgctcaacgtcccctcaaagttctgagcaaaagcccttttccgggctctccagttggttgaattctctgaggggtgagagaatggagccatctgatgcagtgagcagtggtggtggtttggatgctgtgttttcagattcagctaggcttgattcagggtctagtggttcaagggatcctgaagtggaggaagagtatcagatacaactggctttggagcttagtgcaaaggaggatcctgaggccgtgcaaattgaagctgttaagcagatcagtttgggatcttgtgaccctggttacacaccagctgaagttgtggcctaccggtattggatgtgtagactggtactacttcattggcattgtttggagcatggagttttatgtaagagtatagatcttagcctgcagatgacgagaaaagaaaaatggaaggaaggatttatccgtgcttcacagaattacaatgctcttggttatgatgacaagaccttggatggtttctatgatctgtatgggagcttaactgagtcaacccctgcaagaatgccttcccttgtagatctgcaactgcaaggaacaccaatcgcaggtagtggtacatgggaagctgtcttggtcaatagggctgctgattctaatttgttgaaacttgtgcaaaaggtccaggagttgactggcaaatcaagtccagattttgtagttatagatagcaatttggtgcgcaagcttgcaatatttgtggctgactatatgggtggacccgttggggatcctgaaagcatgacaagagcgtggaggagtcttagttacagtctgaaagcaacccttggtagcatgattttgccacttggttctctaactattggattggctcggcatcgtgcgttgttatttaagagggtgctgaaagtactattggagaaggatatcctttgtatctttttgtctgaacgtaattttggaaggtttgcaatggttctagctgatagtttgggcatcccatgtcggttggtgaaggggctgcaatatacaggctccaatgatgtggcgataaactttgtcaagattgatgatggaagggagtacattgttgacctaatggcagatcctggaacacttattccttctgatgcaactggatcacaaatagactacgatgagtctttgtatgtggccagtccttcatcaagagaccttgattcctctcatgtagcatcatccagcagtggtgttggaagttcatacgaagaaacttcagatttggggatgttggacaaaggaaacaggtcaaaacatttttcccatacagggaaagaatatgatgtaagcaggtcctccacaggaaaggaagaatcaatgagacccttgaatgaatttaaaagtccttacaatgttgagaagatcacggggcaggaagctcctggcagacctaatcatccacatgtacatgcaagatctccttcttggactgaagggataagttctcctgcagtacgtagaatgaaagtcaaagatgtttctctatacatgattgatgctgccaaggagaaccctcacttagcccagaaacttcatgatgttttacttgaaagtggtgtggttgctcctccaaatctattttctgaaatttatgatgaggaattaagttcctcaactgaggccaacttactaactgaagaaaaagatgaacatgaacagggaagtggacggcaagaagctgagatagatggtaatgttagtcctgctcaattttttcctcctagagctcttcccaaggcaagttctagcagtcagctggagcatttgaaacctgtagaaggtttaggaatcaaccttcctcttcatacaggagaagcagctggacagcaaataccaactcaggtaaaatatgggcaaaatgtcccagttgctgccgctgccgctgctgctgctgctgttgttgcatcttctatggtagttgcagtggcaaaatcaagcattgactcaaacatagagcttccagtagcagaagctgctaccgctactgctgcagctgtagtaactgctgctgtcagtagacagtatgaacagggcagtcgaagtgatggagatacagacagtgctggctatgacctgaagggtagtggtgatggagagcatatagctttaggagcaaattcagaaggggacagaagatctgataggtcagtagtaagtaatgatagcacaaaatctgattctgcattagatgatcatgaagttgctgaggttgacattccatgggaagaaatcacgctcgggtcgtatggtgaggtatatcgtggtgaatggcatggaactgaaattgctgtaaaaaggtttctagatcaagatatatctggtgaatcacttgaagaatttaaaactgaggattctatgcattgttatttaaggcctgcccctctgaagtga

SEQ ID NO: 49749 - DNA, 726 bp, Glycine max
  Peptide Sequence Number=SeqID_141434
atgaccaccacaccgaatgttggctcttgttcttcttcttgcacacttccgttgcttctttttttagggcttttgtttgttcctgagggtgtggctttggttttggagtttcgttttggggttcagtttgatgggttttggagggttttcgttgctgcattgatgggttgcctttctgggattttgttcatccctgcttctagaagtgcacgttgcttttggcttgggaatgatcaaattcgttgcaatttgtcgatgataacttgtgggtggtttactcgtgcgattctttatgcaaaccagatgcttggaaatggtgtggcaaagagtggattcggtaatgccgagaaattggtggagaatgtggggttcttgccttctgattttggtagttttaggaagtggtgcttgttggggtcgggtttgttgcagattgtggctttgaggcctaacctgcagatgtatctgaatgaagctttgttgtcttggtaccaaaggcttcatgctagcaagggccacgtggaagtggtggcggtggcggtggtgccggacgccacgttgatcgctagtggtggaaaagatgggttggtgttggtgtggggtatggataatgggaagaagctttgtgagtttgagacttgttatgttactaaggagattgtcaaagatttaaaggtttctctcaacactgatgacgattggaatggcagcactactgataacaag

SEQ ID NO: 49750 - DNA, 642 bp, Glycine max
  Peptide Sequence Number=SeqID_141435
atgttcacattcaatatactttttgatggactatgtaaaggtggaagacttaaggatgcacaagaggttcttcaagaacttttggataaaggctatcatgtagatatctacacatataatgttatgatcaatgggctttgtaaacaggacctgcttgatgaagcattggccatgctgtcaaaaatggaagacaatggatgcaaggctaatgcagtaacttttgaaattatcatcagtgctctctttgaaaaagatgagaatgataaggcagaaaaacttcttcatgaaatgattgctagaggcttgtttcttcagatgttaaatttgcacaaaggaggcgaacatatggtgaataggaaaaacagtttggtgaaggatggaagtagacccattgtttctaatgctttcttcatacatggattgcctaggcctctattcacatgtccaaatgaaggcattttaatttctcctggattatatccgcacttggtgcttttgaattccattctctatctcttgggtttatctctagctatctacattgttgagagtggtacaacatcattgcttagaatcctcaatgcacctttccatcacgagctctacttcgctgttgctaatcaaccttgcttgatgttctaa

SEQ ID NO: 49751 - DNA, 660 bp, Glycine max
  Peptide Sequence Number=SeqID_141436
atgacgcatacacagcatgcgattgaattgggaaacggcatcgtcaacattttgaatggatgggggctgagagtgaaagtgagaataatggattgtgtttgttggggagaaatcaaagctccgatttcagatgccagaacttatggaatgggaggcttgaagaaatcttttgggagcaaaggtggtggaggggtggcgaatataattgataataatatgttgaaggtgtcaaatacttcattcaaacacgaggaagtgaaagaggacattatccagatgcacccaacaaaagccccagtttttggagacataatgagcgagatggaagaagatagtagagcaatggtcttcacagtggcaaggaacatatggtatggaaggaaccaatatgttttacagaataggagattggactttcgacagattcttgccaaggcaaaccagaatttacccctttgtttgatgagggatgtaccaaacgctcatagtcaacgggtacctgttgggtggaaacccccacctgagggcactttcaaagtcaaattaaatgctgctataagaaacaaccagggcacatgtatgggtttcattgatcgagaccatgaaggaaatgtcctagcagcttcctcaagaagcataagctcaactgggttttgttaa

SEQ ID NO: 49752 - DNA, 393 bp, Glycine max
  Peptide Sequence Number=SeqID_141437
atggctgtcaaagggatttctgttaatgttgtcacttgtaatactttattgtgtggcttcattgttggtaagctgaaagaagtaactaatttcttaaatgaaatgaaaaacatggttcctaacatggtgacatgcaactctcttatagattgtttgtgcaagttagggagaatctcttatgtttgggatcttattcatgagatgcatgatagtggtaaacccgcaaatggcttgcttgatgaagcattggccatgctgtcaaaaatggaaggcaacggttgcatccctaatgcttttacttttgaaatactcatttgtgctctctttgaaaaagatggaaatgataaggcagagaaacttcttcgtgaaatgattgctagaggcttgttgtaa

SEQ ID NO: 49753 - DNA, 111 bp, Glycine max
  Peptide Sequence Number=SeqID_141438
atggcatcaagccgagcacaaaacagatctgggctgctagtaaggagggcagtgaagccttctagcataaagccagcatgccggggcttgtttcgaggtgcaaccgcctag

SEQ ID NO: 49754 - DNA, 936 bp, Glycine max
  Peptide Sequence Number=SeqID_141439
atgcacgcaaagacagactcagaggtaacaagcctcgccgcgtcttcccccacgcgctcccctccacgccgtcctctttactacgttcagtctccctcgcgagattctcacgacggcgagaaaaccgcaacgacgtcgtttcactccacgcccgttctcagcccctctgcttcccctcctcactcgcgccactcctcttccacgcgcttctcgaagaaggaccatagccatagtcttaagccgtggaagcaaatcgatgttattgaagaagaagggcttcttcaaggggatgatcgccgcaacgggcttccacgtcggtgctactttcttgctttcgttgttgggtttttggttctcttctcgttcttctcgcttatcctttggggggctagtagacccatgaagcccaagatcaccatcaggcttcatgatccttggtttgagtttttcaggatgggaagtgagagcataacgtttgatcatgtaagggtccaagctggttcggatgcaacaggggtagccaccgatatgatcacattgaattccactttgaaattcacataccgcaacacaggcacattttttggggtccatgtcacatccacacccgtggaactttcttattcagacattgtaattgctgcgggaaatttgaagaagttttatcaatctaggaggagccaaagattgctgagtgtatcagtgatgggtaacaagatccctctatatggaagtggtgctagcctaagtagcacaacgggtgtgccaacactgcctgtgccattgaacctcagctttgtgctacgatctagggcttatgtgcttgggaaattggtgaagcctaagtactacaaaaccattaaatgttccatcacattggatcccaaaaagctcaatgctgctatttccctcaagaaatcttgcacatatgattaa

SEQ ID NO: 49755 - DNA, 486 bp, Glycine max
  Peptide Sequence Number=SeqID_141440
atgactaccaagtctcaggagttggccgttaagctcgactccatctttgaccagttatcaactcttacaaccactccatcatctcccaaatcacccccgtttcactcctacgtcaaccacattgatctgcaaactgtggaaaccatgaagtcaccaccaacaaccaaatctcaaaggtcacctatggttttcgcaatgccaacaacaacgatggagcaacaaagcacaacaaccatgctgactacgcctcccatggctgcttcccacctcccttcatggtggccaccacaatcgccattgcatccactcagctatccaccacacccttgcatttatactactctccacaggcccttttccctttgttaccatgcccatacccatcaccaccatctccattcaacgcttactgtgaccctacaactgtccaacatctatttgatggttaggttgggtaatagatgcgacatatgtgcgcacctttaa

SEQ ID NO: 49756 - DNA, 330 bp, Glycine max
  Peptide Sequence Number=SeqID_141441
atgggtggtttagtctctcattgtcatgagaagcttacaaatacaaaatgggatgaagatggtgaaagagaatggaggaaatggaaaggaaatgaaagcaaggctcccaatggtacatctgtaattaggatgctgcatagatatcttggtgccgaatgctttcagaggtctctagcttcatatataaaaagacatgcttgctcaaatgctaagactgaggatccatgggttgcacttgaggaaggatctggtgaacctgtgaacaagtcaatggccttatggacaaagcagaagggatatcctgctgtatctgttaaagtcaatgattga

SEQ ID NO: 49757 - DNA, 1290 bp, Glycine max
  Peptide Sequence Number=SeqID_141442
atggagagaggagaccaaaaccaaagtgcatctcttcagtctccattgattaagcactcacactcatcatcatcagggaggggtattgagagaagggaagttatagaagaagtgaagaagcagttatggcttgcagggcctttgatatcagtgacccttttgaatttttgcctcagtatcatatctgtcatgtttgttggccatcttggcgagttgtctctctctggtgcttccatggccacttcttttgcctctgtcacaggtttcagtttattggtaggaatggcaagttccttggacacgttttgtggccagtcatatggagcaaagcagtatcacatgttaggcatacacttgcagagagccatgttcactctcatgatcgtcagcattccgcttgcaattatttgggcaaacacaaggtccattctaactttccttggccaggatcctgaaatagctgcagaagccgggagttatgctagctctgcaattaccacattactacatgtacttatatgttggattctagttttcaagtctggacttgggaacagaggagctgctgtagcaaattctatatcttattggttgaatgttactatactctcactctatgtcatgttttctccttcatgtgcaaaatcttggacaggattttccaaagaggcactgcataacattccctcatttgtgaggcttgccattccttcagctgttatggtttgcttgaatactacagcagctgcttggatgatcccctttggactaagtggagcaggaagcattcgtgtctcaaatgaacttggagctggtcgtccgtggaatgcacgtttagcagtgcgtgttgtcttagtactagcaattattgagggcatcatagtgggaacagtgatgatacttgtacgcaatatctggggctatgcatatagcaatgaagtagaagtggtcgaatatgtagcaactatgttcccaattctggcagcatccaactttctggatggactccaatgtgttctttcaggcactgctagaggatgtggttggcagaaaattggtgcatttgtcaatctggggtcatactatatagttgggattccatcatctatcgtgtttgcttttgtattgcatattggtgggaagggactctggttggggatcatatgtgcactcattgttcaaatgtgttctttaatgatcataactattcgtactgattgggaccaagaggcaaagaaagcaacagatagagtctataattcagtaacacttgagagcttagtttcatga

SEQ ID NO: 49758 - DNA, 1437 bp, Glycine max
  Peptide Sequence Number=SeqID_141443
atggagaagaaaggcggcaagcggcggtcgatatgcaccgccgacgagcttcaccgcgtggcagtttcgaactccaattggaagctcgctctgtggcgctaccgtccttctcctgaggccctgtcgaggaatcacccgcttttgttgttgtcaggggttgctaccaatgcaataggctatgatctttctcctgagtcttcatttgctcggtacatgtcagcccaaggtttcgatacatggattcttgaggttcgaggtgctgggttgagcacacttggagatagcttggaggaagatgaggaatgcctcaagaatttttctaagattgattctgttattaatgatgatattggtgaaagcagtgcttcttttgtatcagaagttcctcatatgaaaacgagaggatcagaggtagtaactaaatatgaggaaatgcagctaatgacgaggttcatggagattcttacaaggatatctgaaaggcttgcaggatttctcaatggagatttgttggaaggacagaactctgcaattgctggacaaatcaaggatttcaatcggaggcttcgagctattattgaaggtcagctgttgttcccagcaaaaattttagaattgcaagaccgttttgctgccaatctagaagagttccagaaacagcttgagctgatggtcaagtatgattgggactttgaccattatttggaagaggacgtacctgctgctatggagtacataagggctcaatgccaaccaagagatggaaaattgctggcaattggtcactcaatggggggtatcttgttgtatgcaatgctttcaagttgttgttttgatggaaaggatcctgggttggcatctgttgttactttggcatcatcactagactataccccttcaagatcatctctcaagttgcttttacccctggcaaaacctactcgagttttgaacattcctgttattccagttgggccattgatggctactgttcatccccttgctagctatcctccatatgttttatcttggctaaattctcagatttcagctcaagatatgatggaccaaaaactatttgagaaacttgttttgaacaacttcggtaccgtaccttccaagcttctcttgcagttatcatccgttttccaaaaaggtggcttacgagacaggagtggaacattcttctacaaggaccatctccacaaaagtaatgttcctgtcctagcgattgctggtgaccgagacttaatctgccctcctgaagctgtatatgaaacggtgaagcttattcctgacgaattggttacatacaaagtctttggggagcctggtggtccacactatgcccactatgacttagtgggtggtcgtctggcagcagatcaactttatccatgtatcactgaatttctcattcatcatgacacggtttag

SEQ ID NO: 49759 - DNA, 138 bp, Glycine max
  Peptide Sequence Number=SeqID_141444
atggattcaacttatacaaattattctcggtgtgtaagttgtcaacaatggtattcgaatccatgccctttcggacctgtacctgaaactggcgccttagaccaaatcggccatcttaattttggtgttctgaaataa

SEQ ID NO: 49760 - DNA, 354 bp, Glycine max
  Peptide Sequence Number=SeqID_141445
atggagatagcagattttgttcctgtgtgtggaagcatgaagaggtacaggagaaaaagatcaacatatcataagcttaagagaggcaaagaggtaagtgattgcagtagtgttgagaatggttgcatgttgagaccaaaagtgaaaatggttgaagaagagataccaaaagctcatcatcaaccaccaacaaataagattaggttatccataaatctttggaaaaggttgagaaatgcttatgtacagcgtatgcttggcttggctgaacatgttgcgcatttgaacaatggggaaatttgctttctcaagaagatccatgatgatgaagttcagcttttgttagcttcatga

SEQ ID NO: 49761 - DNA, 96 bp, Glycine max
  Peptide Sequence Number=SeqID_141446
atgaaagagaaggaagagaataagagaaagagaaggaagcatgtggagaaggaaaagtatggacagacagagcagagggagcatgtgattgtgtaa

SEQ ID NO: 49762 - DNA, 393 bp, Glycine max
  Peptide Sequence Number=SeqID_141447
atgtctcttcccaaacttcgaatgaagaatggcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49763 - DNA, 1129 bp, Glycine max
  Peptide Sequence Number=SeqID_141448
agcttttaagtttcattctctatctcttgggtttatctctatctacattgttgagagtggtacaacatcgttgcttagaatcatcgatgcacctttccatgacaagctctactttgctgttgctaatcaaccttgcttgcttgatgttcgaattgatgcaatgtatactaagccttccaatcagagcaacttcatttgtagacatcaaattaaaaaagttatgctagagcctagaaggaaaaatagcaagcacaaggtgggtttctgtatgctcacactagggttagttgaagttgttaacaaaattgcaccaaatcatgctagggaatattacaataacagaaagcggttaaacttgtctcctagcagcactacacagcaaggtggaaatgttgggtttgataagaaggtatgggagatagttgaacataagaaaggtgaaaccccctcaatcacttttaagtgccacagtcatgatggagaggaatgttatcctggggatatcaccgttacttccacttacacactcacctcaagcacaactctgaggcttgacatggaagaagtgcctaaggacaagcccaccatagttaacttagctcagcatacctactggaacttagctggccacaactcagggaatatacttgaccattcaattcacttatgggctaatcatatcacgcctgtggacgagaatacggtgccaaccggtgaaatcatgctagtgaagggtaccccttttgattttacatcttttaatagaataggcagcaccattagtcaggttggactgggatatgacgacaattatgtgcttgattgtggggaagagaaagagggtttgagacatactgcaaaagtgagggatccatcaagttcaagagtacttaacttgtggacaaatgcccctggtgtgcaattttacactacaaactatgtgaatggtgttcaaggaaaaggaggtgctatatatggaaagcatgtcgggttatgtctcgagatacaggagtttatacaatttgaagatgaagatatgtcacaagtgggaaaagaagatgaagatgtggagatgaagaagactcaagctactttaaatatggaatcatttgttgttggagatgtttaa

SEQ ID NO: 49764 - DNA, 705 bp, Glycine max
  Peptide Sequence Number=SeqID_141449
atggaggaggaccagcaatgtgaattcagccagaggaggagccaggcagacggcttcgatgaggaagccatcgcccaacacctgtgcatatcggggcaggatttctcccgaaccactgcggggaggtgggtgcggatcatgcacaccagcatgactaccctgacccaaatatggatgacactactgctcagcaatgtcttgcctagtgaccacaacttcgaccttcctctgcctaagtgccagttggtgtatgccatcctgacacggatgagcgttcacgtggcccaggtgattgttgatgccatttatttgtttgtaggaatggcacctactaggcacccgttggacccggagaagtccaacagggccccggggtttccggctttgatcacgggcctctgccagttctacggagtgcaggtcgcccccaacaagtactgcacgcctaggcaggcacagggtgacgcacatcaggccgcgggcgcatcgctaccacctcggcaggccgatttggttggaccattgaccgtggagcagtatctacaacatttggtttgccagcaagcagccaaccaccatggacaggtgcagatacatgagtgtctcgatcggttcagcctcagccagcaggggcatggttccgccccttttgtatgccttaccccgaagcagtttggggctgaggtcgtatggcctggagactag

SEQ ID NO: 49765 - DNA, 258 bp, Glycine max
  Peptide Sequence Number=SeqID_141450
atggaagccatcacaaacggcatgatgaacctgaatcgccagcggcatcagcaccttgtcgccttgcgtataatatttgcccatgaaactgccggaaatcgtcgtggtattcactccagagcgatgaaaacgtttcagtttgctcatggaaaacggtgtaacaagggtgaacactatcccatatcaccagctcaccgtctttcattgccatatgaaattccggatgagcattcatcaggcgggcaagaatgtgaataa

SEQ ID NO: 49766 - DNA, 180 bp, Glycine max
  Peptide Sequence Number=SeqID_141451
atggtggagggagggggtggcagtgaggtgaggcaaggggccgttgttgatcaagcttatcgataccgtcgacctcgagggggggcccgctgcattaatgaatcggccaacgcgcggggagaggcggtttgcgtattgggcgctagcggagtgtatactggcttactatgttggcactga

SEQ ID NO: 49767 - DNA, 156 bp, Glycine max
  Peptide Sequence Number=SeqID_141452
atgtcagtgaaaaaccaccctggggcacttagaagcttaaaggagcactcaaacccggtgacccccaaggcctacactccgaagagtccgttagggcctctccctcctgattcaggtccaacccctaaaatcattttagcacacagacactactag

SEQ ID NO: 49768 - DNA, 76 bp, Glycine max
  Peptide Sequence Number=SeqID_141453
atggagctaagctcaagcttctttaggaatcttcttaagcaagcttctctaggaggtgagcttagttatgagaggg

SEQ ID NO: 49769 - DNA, 180 bp, Glycine max
  Peptide Sequence Number=SeqID_141454
atgcccttggggggggggggggtaaaattgcatcatttcctcccccttgaaaaggatttgacctcaaatccagaggttcttgaaactctgggcttcttccttcaacacatgataaggtctaaaaacccctttcttgggcatcttcccatgagggaaaatggttcctcaccaactcaatga

SEQ ID NO: 49770 - DNA, 635 bp, Glycine max
  Peptide Sequence Number=SeqID_141455
cttttaccttttgcaaacccccaataagaaagaaccataacttaggaaccaacatcagtcatcattcatctagtgttaatggtgagggtactagtcataaggaccctttatctagaatcttagatgagttgagttccctcaatttatggagagaaaaactagaaagaaaagaaaaaggaaaagagagggtggaaataaatcaagatgagagggaacaaataagggaagaagaaaaaaggaaaatactaaaagaattaagaaaagaaaaacatgcctcctatagtagtcatgactcttgcaagagcctaagtgaagaactttgtgactattatgaaggaagacataggtcacatcttagacctcattcctataggaaagaaaaggaaagaaagcctcaagaggctaacattaacctcccatacttccatgggaaggacaatgtagaggcttacttagattgggaaataatgatagagcaacaacttaaaaggaagtctacttccaaatcttatggctttcactcttatccaaagaaagatcaaggtcaaggcatcttaggggtggcatcatctaagcccaaagatgataaggggaagacaatagaaaagcaaccccctaaggctagtatgtgttag

SEQ ID NO: 49771 - DNA, 219 bp, Glycine max
  Peptide Sequence Number=SeqID_141456
atgggatcaagtcaaaagccttcgcttaaaaagaggttctatcaagtcaaaatcaagagcttggagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaag

SEQ ID NO: 49772 - DNA, 297 bp, Glycine max
  Peptide Sequence Number=SeqID_141457
atggcggcgcagctaatccgtgatcgagtagagatggagtgcctaaagggagcttgggagaccctcgaaggcaacacgaggtgccgatttcggggcaccattcgattcacggctacttctttggtgcatccagatgaacctgcacggacgcttcagcgcacggtggagtggacaactccttggattagttttgaatttgataattgtatacatgtggctgaagccaccactgtggacacctttgctctggatgacactatatattttgtaaaactcccatattttggacagctttaa

SEQ ID NO: 49773 - DNA, 516 bp, Glycine max
  Peptide Sequence Number=SeqID_141458
atgaagcacttcactgacaccctcatcagtgccaacataaaaaacacagaaattgcaaccagcgtcatttggctcactcaagcctctgatgtgtggaatgcactgcgcaatcggttttctcaaggggactacattcgaatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49774 - DNA, 521 bp, Glycine max
  Peptide Sequence Number=SeqID_141459
tcggggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaattcgctccaagctggactgtatgcacgaaccccccgttcagtccgaccgctgcgccttatccgaggagttagtcttgaagtcatgcgccgggtaaaggctaaactgaaaggacaagttttggtgactgcgctcctccaagccaggttacctcggttcaaagagttggtgagctcagagaaccttcgaaaaaccgctcttgcaaggcg

SEQ ID NO: 49775 - DNA, 576 bp, Glycine max
  Peptide Sequence Number=SeqID_141460
atggatgctcatccgtgtcaggatggcgtacaccagctggcacttcggcatggggaggtcggaattatgatcggtgggcaggatgttgctgagcagcagagtcatccatatctgagtcagggtggtcatctgggcgatggcctcctcatcgaacccatcagaccggttcctcctctggccatactcgcattcctggccctcttccaataccatcggatatcccaggagctggctgatagcgtcggcatcgaacgggatccactgacccctaacccaggatctcatgtcacgcacgccctcctctgttggccaagcattggcataaaactcaaggactatttccggatcaaacttggccatgggagtaatcagtggtgcccaccgccggcgccctatttcctcctggaaatcagtatactcgtcgtccctgagctggacgcgtcgctcccggagaaacgaccatcccttgatggcttcgaagcgctgctggtgtacaacgctcctaaagcggtgactgtcgtactccggggcggaactagttccttcggccgccttgtccttcctggacctctttga

SEQ ID NO: 49776 - DNA, 498 bp, Glycine max
  Peptide Sequence Number=SeqID_141461
acgctggcgctgcccgactgggatccgagccacatcatcgccgtggccgccaaactctccggcagcgatgcggcgcactggcagcagggccaggcgaagctgaaagcgctgattcctaacatcaaatcgttctacaccgatgatgccaacagccagcagctgatctctaccggagaaacgccgctggcgataccgaaagagggcgcgatcctcggcgtggataccgtcggcatcaataaaggcagcaaacatgccgatctggcgtacaagttcatcaacatcgcactgaaaccggaaattcagcagcaggtggcgaagatctatcgcggtagcccgacggtgaccaacgcgcatatcgatccggagctggcgaagctgccaggcatgctgaccacgccggcgcagtggaatgccaccatcaataccgatccccaactgcgtgcggagaaaaccgccgagtggcgtcagtggttctctgaaaacatcatgtctcactga

SEQ ID NO: 49777 - DNA, 396 bp, Glycine max
  Peptide Sequence Number=SeqID_141462
atggagaggattatgattgatcctgccagtggtggagctcttggtgatatgactcttgttgatgctagtaacctgattgagaagatggtttccaactcccaacaattcagtgcaagaaatgatgctattgtccttagaggagtccatgaggtggccacagatttatcttcatctactgaaaataaaaagcttgagggaaaacttgatgccttggtcaacctagtagctaagcttgccatgaatcagaaatctgcatctgcacctgttgcaagagtttgtggtctatgttcttctatagatcaccatacggatctctgtccttctttgcagcaatctggagtcaatgagcaacctgaagcttatgctgcaaacatttataatagacctcctcagtag

SEQ ID NO: 49778 - DNA, 334 bp, Glycine max
  Peptide Sequence Number=SeqID_141463
aaatagggggaggaccgaagaggaaaggggttcagcattcttggcacttcgtattcactggaaattgctgaggaaaattgtttcacttgaagaaaatctaagccgaagcgcttccgtaacgtttccgtgggtaattacgcgaagattttcaactgttcttcgacattcatcgttcgttcttcgtcgttcttcggtcttcaaccgtttccttcggtttttccgaagttttccacaaataaacgttggtggcgactcagcgcacctttcctcctttggaaagcgcacccgtgagcctcgccttgctctccccccaaagggcatgttgcgacagtga

SEQ ID NO: 49779 - DNA, 669 bp, Glycine max
  Peptide Sequence Number=SeqID_141464
atggtaagcatttgggacctagctagggtagaagtctccatggaaccaattgcctccctcgcccagtattatgatcagccgttgaggtgcttcatctttggagacttccagctatcaccaatggtggaagaatttgaagagatcctaggatgtcctctagggggaaggaaaccatacctcttctcagggttctacccctcattgggagtcctctttccaaatgtggatgggttggtggacctggcagcgatcgacgtttttctcgcctatcataaccacagggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctcgaggaaggaagaatcaagattctatcttcatgcgaaggatgtccaaatgttcccttgatgggaaaaaggggttgtattaattataatcccgtcctcgccataagacagcttggctaccccatgagaggagtgccatcaaacgaaagcatcacgcctttcatcgcacggggttttagtgaccacaacgcgagggtactccaaggagttcgcaaggcatgggatgcggcgtga

SEQ ID NO: 49780 - DNA, 255 bp, Glycine max
  Peptide Sequence Number=SeqID_141465
atggcatcttctggcactcctgctatcttcaccatgttgcaaatgtcaatgcatgtggccagatgtgcgtacagatcttcacttgcatcatcctctatggacgatcttctactgtcgcaacctacccttcgacgagagggcgacgcgagggctcacgggtgcgtcttccaagggaggaaaatgcacggagtcgccaacaacatttattcgaggaaaacgtcagacaaaccggaatgtgtggtctacgaactttaa

SEQ ID NO: 49781 - DNA, 144 bp, Glycine max
  Peptide Sequence Number=SeqID_141466
atggacagcagaaaccaatcaaggtacataggaacggatgcgagtgggggtggggtcacgaccgaccgatcgttgccccttctctgcgtgaaacaagcagagaacgtcgctgcaaggcagcccataatcgacgcctatttctga

SEQ ID NO: 49782 - DNA, 868 bp, Glycine max
  Peptide Sequence Number=SeqID_141467
aggactacacgtcctcgccttcagagaactaaacgtcctccctttcagaggattacatgtcctcgtcgtcacagggctacaagtcctcgcctttagagggctacacgtcctcgcctttagaggactacacgtcctactcttcagaggactacacgtcctcgccttgagagggctacacaggactacacgtcctcgccttcagaggactaaatgccctcagcttcagaggactacatgtcctcgccttcagagggctacacgactacacgtcctcgcctttagagggctacacgtcctcacctttagaggactacacgtcctcgccttcagagaactaaacgtcctccctttcagaggattacatgtcctcgtcgtcacagggctacaagtcctcgcctttagagggctacacgtcctcgccttcagaggactagacgtccttgcctgcagagggctacacgtcctcgccattagagggctacacgtcctactcttcagaggactacacgtcctcgccttgagagggctacacgtcctcgcctttagagggatacacatcctactcttcagaggactacacgtcctcgccttcagaggactacacgtccacgccttcagaggactacacatcctcccctatagaggattacatgtcctcgccgtcagagggctacacgtcctcgcctttagagggctacatgtcctcaacttcagaggacaacacgtcctcgccttcagaggactacacgtccaccccatcagtggactacatatcctctccttcagaggattacacatcctcggcatcagagggctacacatcctcgctttcagagggctacacgtcatcgccttcagaggactacac

SEQ ID NO: 49783 - DNA, 470 bp, Glycine max
  Peptide Sequence Number=SeqID_141468
gaaacagctatgaccatgattacgccaagctcgaaattaaccctccactaaagggaacaaaagctggtacccgggccccccctcgaggtcgacgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49784 - DNA, 383 bp, Glycine max
  Peptide Sequence Number=SeqID_141469
gactacacgtcctcgccttcagagggctacacgccctcgccttcagaggactacacatcctcaccttcagaggactacacgtcctctccttcagaggactacacgccctcgccttcagaggactacacgccctcgccttcagagggctacacgccctcgcgtttaaagggctacacgcccttacctttagaggactacacgtcctcaccttcagaggactacacgtcctcaccttcagagggctgcacgcccttaccttcatagggctacacgccctttccttcatagggctacacgtccttgccttcagagggttgcacatccttgcttttagaggactccacatctgcgccttcagagaactcaaggtcttcagcccttaa

SEQ ID NO: 49785 - DNA, 432 bp, Glycine max
  Peptide Sequence Number=SeqID_141470
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggtaaggaattcaagaccagcctggccaagatagtgaaaccccgtctctactaa

SEQ ID NO: 49786 - DNA, 222 bp, Glycine max
  Peptide Sequence Number=SeqID_141471
atgttgctaagtagcaacatcatttatatctgtgtaagagtgttcatgttggtgcgcatgatccacactcgtctctttgcagcggcacgggtgaaatcttgccccggtatgcatagtagctgcgtgatagcctccctctctggttgtacttgcatagctggccctcctccaggatcagagggtggcccaggaactgataaaaggaaactactggccccttaa

SEQ ID NO: 49787 - DNA, 434 bp, Glycine max
  Peptide Sequence Number=SeqID_141472
atggcaaagtcattcgttgggcattcatatacgggtcgactgacaaaggatgagaagattgttgttgctgatatgatgaagttcatcgtgaagccaagaaatattttgttgacgttgaaggaacacaatgacaacagttatacaacaatcaaacaaatttacaatgtgagacatgcttaccgttcttccataagagggagtaacaccgaaatgcaacaactgatgatgttgcttgatcgagatcaatatattcactggcataggctgaaggatgataatgtttggtttcagggtcttttcatgagagttgatgcactccctggggttattgtcaccgacagggatttgtctttgatgaatgcaatgaaaactatattcttggatgctacgaacttgctgtgtcggttccacattgacaagaatgtgaaggcaaa

SEQ ID NO: 49788 - DNA, 243 bp, Glycine max
  Peptide Sequence Number=SeqID_141473
atggtatcaaggtacgctttacatgaaattgctgttgagtatgagcgtgtagcgtatgcaggcaaaaacccttcacgatgtggatgtgtcatgaggaatacccacggtcttccatgtgcatatcaagggttaagtgagactcaagtgaccataactgaggagatggaaaccatatcgaaacactttcagcagctcgatgtttgtggtaaaatacatttgaagtcaaagttgcaacttgcttga

SEQ ID NO: 49789 - DNA, 246 bp, Glycine max
  Peptide Sequence Number=SeqID_141474
atgtctttcaactcccgacatgtcacggaacttcacagattgcctaacgatgggcgtcaagcgcagaatgaccataatttgtctctgcgtgccatcggacacgatcgggcccggatggaaaggcacagaatgaccataatttgtctctgcatgccatcagacacgatcgcttctggatggcgaaaaggtgtgcggaatgaccataatttgtctccgcccagcactcgactcactgcccctgaatga

SEQ ID NO: 49790 - DNA, 414 bp, Glycine max
  Peptide Sequence Number=SeqID_141475
gattctttggaggaccaggcatcacaggtttcctttgtcccccatggacgtttaggatctcctgactactgccattgggcgaccagaacaccttggtcatatgtgtgttgctggagccggtgtgaccatcaagcaatactttggatcggctccacgaacctcctgcacttcttcctccatggctcccaaagaactagagcagctaactcaacaaatcagggaccagctggaggagtcgatcacagaaaaagtgacttggcagatgatgttatccttcagctagatccagtctcagtttcagtcacagattcaatcatagggacttgcactgtcagcacaaagaggagttgtgttgatccctcaatgactgatccagacacgggtgactcagacaaatgcaggttgtacatatga

SEQ ID NO: 49791 - DNA, 821 bp, Glycine max
  Peptide Sequence Number=SeqID_141476
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgattcatcttttgtcgtgggaagtcggaagatccatatcgtcttcttaactgcacacatggggcgcagtgcctcatatacgaaaaagcgcaagtgggggatgtacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49792 - DNA, 99 bp, Glycine max
  Peptide Sequence Number=SeqID_141477
ggttgtccttgtgtggttcagaacttgtaaagtgattttgcaagatagtggaactctcaagcgggttgcttggggactggacgtaggcacaagagtgag

SEQ ID NO: 49793 - DNA, 676 bp, Glycine max
  Peptide Sequence Number=SeqID_141478
acacgccctcacctatagaggaccacccatcctcaccttcagagggctacacgccctcgccatcagaggactacatgtccttaccttcgtagggctacacgccctcgccatcagaggactgcacgtcctcaccttcagagggctgcacgctctcaccttgagaggactacatgtcctcaccatcagagggctgcacgcccttacctccagaggactacacatcctcgtcttgagagggctgcacgccctcacctttagagggctacccgccctcgccttgggtactagttaccctcaccttcagaggactacacgtcctcaccacttcagagggctacacgccctcgccatcagaggactgcatgtcctcaccttcgtagggctacacgccctcacctttagaggaccacccacgtcctcaccttcagagggctacacgccctcgccatcagaggactacatagggctgcacgcccttacctccagaggactacacatcctcgtcttgaaagggctgcatgccctcacctttagagggctacccgccctcgccttgggtactagttaccctcaccttcagaggactacacgtcctcaacttcagagggctacacgccctcgccatcagaggactgcatgtcctcaccttcgtagggctacacgccctcacctttag

SEQ ID NO: 49794 - DNA, 219 bp, Glycine max
  Peptide Sequence Number=SeqID_141479
atgacgccctctagagaatccacatcagggagtgggtcctcatcaccctctgaaaagtcaagagcatccacagcaggctcaggaggtaactcctctgggtcctcctcagggtcttcttcagatgacaacacctctatcacttggactggctccactagtcgatatggagtaggtgtagtgatcgaggccgtacccgaatcaaataaacatgaaaatgca

SEQ ID NO: 49795 - DNA, 480 bp, Glycine max
  Peptide Sequence Number=SeqID_141480
atggattggcaattcgtatggcttatacaaattaccaatcccccccaacaatggttgcacaataaatccgacatagaggaagaaagacttacggtgaggaaggagaagacgaggacgactacggtggcgatgataggaggcatgaacagcggcggcagtgcgaagaagaagaaacaaacaatgaaggagaagaaggcgcagggtggtagacctaaacccgtgaacatccctaatcatcccaaactcattaccaacaacaacatagattcaacaacaacaaaatccaaaaaaaataaaattgggggtgggtgtgtgcacaaattgatgatgaggggtgaggtggtcgatgtggaacagatagatggtggtgatgcttggaactctacaaagtgggtgtgcgtgcggtctagagggtgtagaagcaagcttcatgatgatgaaccaagcaattttgatgatgccaaaagcccaagtgattga

SEQ ID NO: 49796 - DNA, 794 bp, Glycine max
  Peptide Sequence Number=SeqID_141481
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaattctctagatgcagagccaatctcattttccggcaagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49797 - DNA, 291 bp, Glycine max
  Peptide Sequence Number=SeqID_141482
atgatttgggtcccaaaaggatctgttattcatactaacacacaaggtgatgcaagctccattggagcttgtaggcctaggatcttcttcatcaatggattcctttacttcttggaagatgaatggcagcggaatggagaaagggagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 49798 - DNA, 782 bp, Glycine max
  Peptide Sequence Number=SeqID_141483
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggttcgaccccacctgcccccgcagtcggcgcacaacgcaccaacgagcgggttgatcccgatcttgcgacacacgaggagagcaatgggcgcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49799 - DNA, 803 bp, Glycine max
  Peptide Sequence Number=SeqID_141484
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaaattcgatcgtccgccttgggggcgttgacgacgatccgcccgttgctgagctcgccgctgatgacgtaggtgccgccgccgctgatggtgacggtgccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49800 - DNA, 202 bp, Glycine max
  Peptide Sequence Number=SeqID_141485
atggggtcctttggagaagctggttgggagtgggaattctcatggagaagaaatcttttcgacaatgagttgggaagagcttcagcctttattgaacaggctacaacactaagccctaatgcagctttgaaggattattgggtgtggggagctgacccaaagggaatctttactactagaactgcctatctttgtattaaag

SEQ ID NO: 49801 - DNA, 926 bp, Glycine max
  Peptide Sequence Number=SeqID_141486
ggtaagctgattaccgtgaacaccgacgtgctgtcactgaccatcaacacccgtggtggcgatatcgagcaggctaaactgttggcctacccggatactctgggttcatcgactccgttccaactgctggaaaccactccgtcgttcgtctatcaggcgcaaagcggcctgaccggtaaaaacggcccggataacccggccaacggcgaacgcccgctgtatcaggcggcgcaagacagctacaccctgccggaaggccaggacgagctgcgcatcccgctgacctacaccgataaagacggcgcagtctacaccaagaccttcgtgctcaaacgcaaccactatgcggtcggcgtggattacagcatcgacaacaaaggcgcgacgccgctggagctgaccctgttcggccagctgaagcaaaccaccgaattgcctaaacaccgcgacaccggcagcagcaacttcgcgctgcacaccttccgcggcgcggcgtactcgtccagcgaggacaagtaccaaaaatacgcgttcgacaaagatgaaaacctgagcgtcaccaccaaagacggttgggtcgccatgctgcaacagtacttcgccaccgcgtgggtaccggcgaccaaaggtgacaacaccttctataccgccaaaccgggtgacaacctgtccaccatcggcttcaaatctacgccggtcgtggtgcagccgggcgctcagcagcagctgaacgcgaccctgtgggtcggcccggagctgcaggaccagatggcccagctggcgccgcacctggacctgaccgtggattacggctggctgtggttcatctcccagccgctgttcaaactgctgaagttcatccacggctttatcggtaactggggcttctccatcatcatcatcaccttcatcgtgcgcggcatcat

SEQ ID NO: 49802 - DNA, 153 bp, Glycine max
  Peptide Sequence Number=SeqID_141487
atggatttgaggtcaaatccttttcaaggggtagggaatgatgcaatcctaccgcccccaaaggcattggatagaagactccaagaagattgggccagagatgcaaaagaagaccctagggttctcatgagccttaggggctctataatgtag

SEQ ID NO: 49803 - DNA, 186 bp, Glycine max
  Peptide Sequence Number=SeqID_141488
atggagaataagatcaataacaatgaattaaagccttggatcttcttgatcaatggagtgctttgcttcttaaagatgaatggcagcagaatggagaaggagaaagatgattggagacgccacttcaaggagaagatgaatctagaagaagctcaccaccataggaagccatggataagagcttga

SEQ ID NO: 49804 - DNA, 396 bp, Glycine max
  Peptide Sequence Number=SeqID_141489
atgtctcttgctactctctttggaaaacttcaagaacatgaaatggaacttatgagacttcatcaacatgatgagaatgatataaagagaaaaggaataacactcagaacctcatcatcttttattcaagaagaaagtgacaaagaggacttgactgaaacagaagaagatgatgatgattttagactctttgtgaaaaggaaaggaccagctaccagagccatgagcaagaggctccaagaggattgggctagagttgataaagaaggccttagggttctcatgaaccttaggcttctcaaggaagttttctcaaagaagcttctcaaggaagttttcttaagaaagcttctgaaggaagttttcttaagaaagcttctcaaggaagctatctag

SEQ ID NO: 49805 - DNA, 704 bp, Glycine max
  Peptide Sequence Number=SeqID_141490
atggctatcttggcagatttgtttgacacctttgaccggagatgtgagaaaaatagtgcacggattgtctgttgtttacccgctctctgtgtgtggttgatttcacacctattccaacaagacacaagacacccgtgtccgcttcgaagttatcgctcatgcaccgaaaaaggaagagtcgattgggaccaacatttggcggagatagggggcagcgcaatcaattggtttcctcgttggaaggaaggcaaggaaggagttcttttctcgtgtggtgactaccctaatgttccattgatagggactagggggtgtattaattataatcccgcgctcgcaataagacaactagggtaccccatgaggggagcgccaacggaagggagtctctcacctttccttctgaaagatttaggcgcgcaaggtctcaaggttatacaaagaatccacaaggcatggaggagtccgttgaggaaagacaaggagcttaggggcatccgtaatggcgtcatcggaggttatcatggatggctaagaattcacacgcgagggttagattggctctccaagttgaaagttatcgatgaggagaacttcgaagctccggaggaagatgaagaagtccgagctctaaaattggagctagggaaggcaagactcgccaaggagaagttcaaatcagctgctacacacatccagaaaga

SEQ ID NO: 49806 - DNA, 118 bp, Glycine max
  Peptide Sequence Number=SeqID_141491
atggttaaagcacgtcaaaagggggggaaaagagggaggtggttgccgcccagctcacccaggcgagctgggttgcttccagcagaaggcaccgtcttctgttggaacaccctggaag

SEQ ID NO: 49807 - DNA, 234 bp, Glycine max
  Peptide Sequence Number=SeqID_141492
atgagtttgaaaaaatgcacaactgccccatgtgtggggtatcacggtacaaaagtgaaggatgatgacgagtgtagcaatgatgaaagcatcaagaaaggccccctagcaaaggtgttatggtatcttccgatcattccaaggttcaagcatctgttgctagtgcagatgacacaaaaaaccttacatggcatgcagatgggaaaaattatgacaaaatgctctaccatctga

SEQ ID NO: 49808 - DNA, 834 bp, Glycine max
  Peptide Sequence Number=SeqID_141493
atggccaagttcgacccagacatagtcctcgagttttatgccaatgcttggcctacagaggagggtgtgcgagatatgcgatcttgggtgaagggtcagtggatccctttcgatgcggatgccctcagccagtttctgggatatcctttagtgttggaggagggccaggagtgcgagtatggccagaggaggaaccaggccgatgggtttgatgaggaggccatcgctcaattgctgtgtataccggggcaggattttgcccggactgctgctgggagacgggtgcggatcatgcgcaccaacatgaccaccctgacccagatatggatgacgttgctgctcagcaacatccagcccagcgatcataattccgacctccccctgccgaagtgcaccttggacccggataagtccaatagggccctgggatttcccgcattgatcacaggactctgtcagttgttcggagtccccgtcgcacctagcaaggtgattcagccacccatcacccaggcttttattgagaagtattgcacgcagagaccggcccagggtgatgcaacacaggccgcagaggcgccgccacctcatcaggctggtccagctgggtcatttgattcggagcagtatttacggcatgtgagccagggttttacttcttttccatgccctactccggatcagtttagggcaaaggtcgcatggcccggagattggcctgaggcccaggcaggggaggcacccgtagaggctcccggcgaggcagatgaggctcgcgaggacgaggagatgaccgatgtgcttgatttcttgggagggagcggagccacatga

SEQ ID NO: 49809 - DNA, 171 bp, Glycine max
  Peptide Sequence Number=SeqID_141494
atgtcggggcgttcttccactcgccaatttcccagctggaaatcaggagggcatggtcgtaccaaatccaaagcttccttcactttcttgtctccaacgcgagctttgaccactgttcttccttcccgcgatgcttcttttcatgtccgcctgagtgggcttatagcctaa

SEQ ID NO: 49810 - DNA, 486 bp, Glycine max
  Peptide Sequence Number=SeqID_141495
atgggtgaagcagaggaggtgcaagagaagatgaaggccgacatggaggccatgaaagagcaaatggccacaacgatggaggccaggatgagcatgaagaagataatggaagccaaatgcggcaaagatttgggaagtacggatgaccccatgatgtgcaaattcaaaacaagcacgccttcccgccatatggcttgcctcccaaactatacaccacccaatgtagcgtacattcccaatgaggatgtcaataactccactcacatactcattaagagccaacaacctcaatctgatcatgcacatgtctctcgacccatggaggagacacatgaaattccccaccacgatctagccgacttcgagccttgcctcggatatgccactgaagggcaagcagttggtggtatacccctgcaaaacactttggagggccctcagtgtcacccacaaccacaaccctcacattccacagcactagtttaa

SEQ ID NO: 49811 - DNA, 303 bp, Glycine max
  Peptide Sequence Number=SeqID_141496
atgaaggctcaaacttatcaaggtaatccttgtggcgtctaccctgacttatcttccttcaccggaagtggcgtctaccctgacttatcttccttcattggaagtggcgtctacccggacttatcttccttcaccggaagtggcgtctaccccgacttatcttccttcactggaagtggcgtcatccaaatatccgtagcctgtatcaagcgatccacgcccagaaatgttcgatcgccgtcatccggtgatgcttcttttttaaacctcaatcggtcatctttcctggccgacgtcggctag

SEQ ID NO: 49812 - DNA, 129 bp, Glycine max
  Peptide Sequence Number=SeqID_141497
atgacaccggtaaaccgaaaggcaggaacaggagagcgcacgagggagccgccagggggaaacgcctggggggcggagcctactggaataaacgcattgccgcggcttaaacctccacttcccaattaa

SEQ ID NO: 49813 - DNA, 863 bp, Glycine max
  Peptide Sequence Number=SeqID_141498
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatttcaaaaaactcggtaaacgtaaaacttggcttttgtttacgcaaatagctttggtgttgggggtcgttgctttggcacttacccaattcgattacggtcttgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49814 - DNA, 726 bp, Glycine max
  Peptide Sequence Number=SeqID_141499
atggcagagccatcaaagaagagaaagggatcatcctccaccgctgctgctgctgcccatcgccgccacagaccatctgaagcatccacagcacctactcatccatctttatcatctccaagatcatcaacattgttttcttccgatgatcaacgtctacgtcaaggtgcaccttttgagggcaccattgttgatgactggaaattcgattattcgagtcatgatgctcgtcgcatgttctgcaatgatcaagctgaaatgaccggtagattgttggccgggtcattaagctttgataatcgcatcatgcattatatcattgttagaattttgcttcctcggtcttcaaatttagcacaagcctctgaggaggatttgattcttatgtgggcttttcttaccggtcgtcagatcgactgggcccatttggttcggtaccgaatgcataaggcattacgggccaatgcacatcttccttatccacatttgattactctgtatttgcgtcattttcaaattccgcttgatgatgaaccctttcttcaagtcaagcgttcctttgcaattggtgctggtgcagtgacatcctttgggtatcgtaaagatcggaatggacaatggctgaagaaggatgcactccctcctcaagatgaacgtactccttcagctccccctcaacgtgaagattctgcactcatgaatgaagtgatcgcttcgactcgttag

SEQ ID NO: 49815 - DNA, 450 bp, Glycine max
  Peptide Sequence Number=SeqID_141500
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatcgtaagtcagaaagggatagagatagatcccgagaaagtaaaggccatccttgaaatgccggaaccacacacggagaagcag

SEQ ID NO: 49816 - DNA, 293 bp, Glycine max
  Peptide Sequence Number=SeqID_141501
cactgatcacaggactctgccagtcgttcggagtccccgttgcacctaccaaggtgattcggccgcccatcacccgggcttttattgagaagtactgcacccagagacaggctcaggggaatactccacaggccgcgggcgcgccaccaccacctcatcaggctggcccggctgggtcattcgacatggagcagtatttacggcatttggttcgccagcaggcagccaaccaccgggcacatgtgcagacccatgattgcctataccagatgagcctcagcatgcagagctag

SEQ ID NO: 49817 - DNA, 890 bp, Glycine max
  Peptide Sequence Number=SeqID_141502
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagatggtttatgtgtgcgtgtcggggcattgcgctgccacagccaggcattcactattaaattgaaaaaagatgtgtctattccgaccgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49818 - DNA, 426 bp, Glycine max
  Peptide Sequence Number=SeqID_141503
atgcctggctgtggcagcgcaatgccccgacacgcacacataaaccatctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49819 - DNA, 378 bp, Glycine max
  Peptide Sequence Number=SeqID_141504
atggatgaagtagagaaggtgcaagagcagatgaaggccgacatggaggccatgaaagagcaaatggcacatgaaattccccaccacaatctagccgacttcgagccttgcctcggatatgccactgaagggcaagcagttggtggtataccaatgccaaacactttggagggccctcagtttcgcccacaaccacaacccttgcattttgcggtgggaagagcccctcctgctatggctgaaaagggaaaggtggatcatctaaaggaaaggctcagggccattgaaggaggtgaagattatgcctttgctaacctagaaaagttgttcctaatacccaaacatggtcattcccaagttcaaggtgccggactttga

SEQ ID NO: 49820 - DNA, 561 bp, Glycine max
  Peptide Sequence Number=SeqID_141505
atgggtgaagtagatgaggtgcaagagcagatgaaggccgacatggaggccatgaaagagaaaatggccacaatggtggaggccatgatgagcataaagaagataatgaaagccaatacggttgcaattgccgctaccagcgctgttgctaaggtgaacccgatgcccccatctgatctcaaccaaatgaatcatccaacctcagctagggcaggcaaagatttgggaagtacaggcggcccctattatgcgcaaattaaaaacaagcatgccttcccaccatatggcttgcctcccaactatacaccacccaatgtggcatacactcccaatgaggatacacatgaaattccccaccacaatctagccgacttcgagccttgccttggatatgccactgaagggcaagcagttggtggtatacccttgcaaaacactttagagggccctcaattttgcccccaaccacaacctttgcatttcacagcaggtaaaatccctcctattatggaaggaaagggaaaagttggatcatctggaggaaaggctcagggccattga

SEQ ID NO: 49821 - DNA, 887 bp, Glycine max
  Peptide Sequence Number=SeqID_141506
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggtcatctgcatgacctacctcctcatgaaaaataggcttgtctccaagccatacaacagtagctctaaattgctctgtagtagacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49822 - DNA, 231 bp, Glycine max
  Peptide Sequence Number=SeqID_141507
atggcagcagaatggagaaggaagagagagaggagaggccacttcaaggagaagatgagtctagaagaagctcactaccataggaggccatggataagagcttggaggaagaaggagataaatgaagggagaggaagagaagagcacgaaattttctgctctaaaagagctctaaaatctgaacccactaatccaaggtcaagtccaagattctccactaagtgtgcttag

SEQ ID NO: 49823 - DNA, 426 bp, Glycine max
  Peptide Sequence Number=SeqID_141508
atgttgataactcaaaaaatacgcccggtagtgatcttatttcattatggtgaaagttggaacctcttacgtgccgatcaacgtttcattttcgccaaaagttggcccagggcttcccggtatcaacagggacaccaggatttatttattctgcgaagtgatcttccgtcacagcaccgccggacatcagcgctggcaagtgtagcggtcacgctgcgcgtaaccaccacacccgccgcgtttaatgcgccgctacagggcgcgtcccattcgccattcaggctgcgcaattgttgggaagggcgatcggtgcgggcctcttcgctattacgccagctggcgaaagggggatgtgctgcaaggcgattaagttgggtaacgccagggttttcccagtcacgacgttgtaaaacgacggccagttaa

SEQ ID NO: 49824 - DNA, 258 bp, Glycine max
  Peptide Sequence Number=SeqID_141509
atggtgggttacacaccttcaagttttacagatttggtcttcgccagcgaaaggatcgaagtggttctgaaaggaggaaaatttaatcatcctgcttggacgactgagaaaactagggcaaatgaagagggtgagaatgaaggagaaacccatgttgcgactgccattcctacatggccaaacttcccaccagcccaacaatgtcgttactcagccaataacaaccattctccttacccaccacccagttatccataa

SEQ ID NO: 49825 - DNA, 201 bp, Glycine max
  Peptide Sequence Number=SeqID_141510
atgcgtgacatgggtcatgaagatgaggaggaggatgatgatgataataacaataacaatgatgatgatggtggtggtggtggtgatgatgatgacaacgatggtgatcatgttcctcaacaacaacatacaattacacctgaggacactactaaaaaaaaggctttcaacatcgcttcattaacatcggttatttcataa

SEQ ID NO: 49826 - DNA, 210 bp, Glycine max
  Peptide Sequence Number=SeqID_141511
cgtgttagcagctcaacagtgagtgacccttctttcttaggagaccccaggtcgggttccttcttccgagggcaaggatgccaccagaaattctctctgggtcaaggtttaagtggggtgagttcgaaggattttgcatcctcaattgtagaacgggaactcagacatgatgtatgtcaggggttggtttggccagcggttcagggataa

SEQ ID NO: 49827 - DNA, 516 bp, Glycine max
  Peptide Sequence Number=SeqID_141512
atgatcgtcacagttcgaccggagagggtggtacgccagttcggttacatccagagcatccctccgctgcctgttagtgcacgattgtcacacgatcagatagatgacaggtggatggagtttgcggatcacttactacctgcgggtcagctttgtctagtgcctgagcaggtatctgcggattacatggagtggtttttccgcatatctcaccctttcatgacaccgacccaagcaggtgaccagcagagggatgcaccagctgtagaccctgaggactacatacagccgtccagcccccaggttccagtggcatttgacccccctccacatgtggatgattacgagggatatgaggcgattgcacagaggttggagcgtgtgctcaaccttaggatagtcattgcaggcacagagttatatgacattatgcaggactgcctgacgatcgcgagagggggacccagtgttgatgggacggtcagggctcgtcagagacaccgcacggaccattga

SEQ ID NO: 49828 - DNA, 326 bp, Glycine max
  Peptide Sequence Number=SeqID_141513
tcattataaggtctgacacaaacactggtagtagaggaaggacttcgtttgtgttaattggttgtgaaaggagtggcgagtataggtgtaggaagaaagaatttgttagaagagatactggaactaggaaatgtgggtgtccctttaagctttgtggcaagccagtggttggaggacaagacactacctacaaaacaaacaggtatagactcccactgctcgattttgttggggtgacaccaactgggacgacattttctgctggttttgcatatttggaggataaacgtcttaataatgtggtttgggctttagaacggttctga

SEQ ID NO: 49829 - DNA, 411 bp, Glycine max
  Peptide Sequence Number=SeqID_141514
atgcaacagggacaggcagatattctcatagctaggttccctgaccctaactatggtgtcaaaacggttttttcaaaggaagcgcaaaacatacaatggtggttccaaagttcgaaaagatgcaaagacaagctgaaactaacaaggaacaagcatagaatcacggttacctcaaggaaaaccacgaaggtcagaccgagcttcattctcaaccaaaaccgcgaggcaagtttggaagattctgcttcggttgaagggttcctctgggtgtggggtttcaatggagaacaatggcggtttgtggtggctgtgagtgatggagaaagagcttgggacattggaaatggttttgggagaaagaaggagaagaaaatggcatttttccaaggctacatgaaaagcaaaggctga

SEQ ID NO: 49830 - DNA, 260 bp, Glycine max
  Peptide Sequence Number=SeqID_141515
atggccaggcgcccatctgtcgcacatcaagtgcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 49831 - DNA, 872 bp, Glycine max
  Peptide Sequence Number=SeqID_141516
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcactaatgcatcatctattgtgatatctagccagaagcacattgactttgctctcacctcaccatatggtggtggtcgcccaggtcgcaccaagaggaagcgtgcaaagtccgccgagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49832 - DNA, 649 bp, Glycine max
  Peptide Sequence Number=SeqID_141517
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatattctaaatcatctagagatgccgaggatgcaggatttaatgatgccattgctgaggatcgaactgatcagtttgtgaacacgctacagccagagttagaagcccttgagaataagaaggacgattttattggtgactttagcaagatggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 49833 - DNA, 886 bp, Glycine max
  Peptide Sequence Number=SeqID_141518
gacttccagctagtgccgactgtgaaagagtttgaagaaatcctgggatgcccactgggaggaaggaagccatatcttttctctgggttctatccctccacgacaagagttgccaagtaccaaggaagtgtttggaggaaagggcaaaggccttggcaaatcaaggcgaatgggctttcttttattgacatcttggcgcttttgatctttggagttgtcctctttctgaatatggaagggttagtaggaagtgtttggaggaaagggaaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgtatgacacgttcgaccggggatgtgaaaagagcgacgcaagaattgaaggaagaatcaggattctatcttcatgcgaaggatgtcccatgagaggagtgccatcagacgaaagcatcacgcctttcatcgcacgaggtttcagtgaccacaacgtgagggacagagagcttaggggaagcagtaatgggatcatcggcggctatcataagtggctgagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacgagctaaag

SEQ ID NO: 49834 - DNA, 210 bp, Glycine max
  Peptide Sequence Number=SeqID_141519
atggctgttgtcggaggagctgggttggatgatgaaggaatgtcatcggttcttgccctttttcttgatgccatctacaagaaagggatccaaacaactacaaaaaatcaaaataaaaatttcactaagtatgggagcttagcgaacagggtcgttcagctcagaaaatgccgtaatgaattgcgcttagcctatggaagttcggcttag

SEQ ID NO: 49835 - DNA, 484 bp, Glycine max
  Peptide Sequence Number=SeqID_141520
atgggtaaagcggaggaggtacaagagaagatgaaggccgacatggaggccatgaaagagcaaatggccacgatgatggccatgatgagcatggggaagataatggaagccaatgcagttgcagttgccgctaccagcactgttgctaaggtgaacccgatgcccccatctggcctcaaccaaatgaatcatccaacctcagctatgatttgggaagtacgggcggccctattatgtgcaaattcaaaacaagcacgccttcctgccatatggcttgcctcccaacttacaacacccaatgtggcgcacactcccaatgagaatgtcaataactccacttctatactcattgagagccaacaacctcaaacttatcatgcacatgcctctcaaaccatgggggagacacatgaaattccccaccacaatctagccgacttcgagtcttgcctcagatataccactgaagggcaagcagttggtg

SEQ ID NO: 49836 - DNA, 183 bp, Glycine max
  Peptide Sequence Number=SeqID_141521
atgtcaagaaaagctataagagaaatcttagttaggtggttggatgaccttaggcagaacaacaagaaggaggtgaagcaaaagctaaggagaatgaaacccgagacgtcgctgaagatcaaggaggaggtgaaaaagcagttcgacatcgatttcttggcggtggctcgataccccgagtga

SEQ ID NO: 49837 - DNA, 210 bp, Glycine max
  Peptide Sequence Number=SeqID_141522
atgtaccctctcttgttctcagttacaacaacacaagtagatgtaccctctacttgtaccacaaaggatgtaccctccaatgtgttaagacaaagttctcaggcggacaaggtttggaaaccagaaaactcagaaaggtttttggcaacggaagaagaagaagaagaagttcaaaaggatattcaaaggttgtgtagaaaagttgtttaa

SEQ ID NO: 49838 - DNA, 393 bp, Glycine max
  Peptide Sequence Number=SeqID_141523
atgaccactcttacacggatatgtatgacattgctacttagcaacattctgcctagcgactgtaatgccgatctccccctacagaagtatcagttggggtcgcacccacaagacacccagtggacccgaagaagtccaatagggccctggggtttccagctctgggatcacgcccgcaagacaccctgtggacccggagaagtccaacagggtcttggagttgccagctctgattacggtcctctgtcggttctacggggtgcctgttgcccccagcaagccaggcaggcgcagggcgaaacaccacagcagcctagggatggccggcagcgggcaacagatgcaccgccaccacctctagagttcacctcagcttatccacaaaaaggttag

SEQ ID NO: 49839 - DNA, 579 bp, Glycine max
  Peptide Sequence Number=SeqID_141524
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgaggagtggacaaagaatatgaatacgacgatgatgagtgcattaaacatctatggctatgtcgttgcggctgttgttgtgttccttatattattgctttggcagcggaacagatttttcttcgcttcatctccgtcgtctccatccgcttccttactgctttccgattctatcaattcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagg

SEQ ID NO: 49840 - DNA, 282 bp, Glycine max
  Peptide Sequence Number=SeqID_141525
atgggatcaccaaaaggatcgcttatttttgcgaatgattccgtcgacctcaggctccagtggcgtatcatggtttctatcagctgttcctcctgttcagtactgacggggaattggttatccgcgtcacaattcggcacacaagcataccagccggaagcatcaggggcaagtgtaaagcctggggtgcctaagagtgagctaactcaccatcacccgcgttcgcgctctaactgcgccgctttccagtcgggaaacctgtcgtgccattcgctgcattaa

SEQ ID NO: 49841 - DNA, 360 bp, Glycine max
  Peptide Sequence Number=SeqID_141526
atgaatttattgcctagcgctgttcatgtgtctcccccaccttcgagtctggagcccgcagaagttattggtttagcgctgttcgccaattctccattctccacttttttcggagccccatgtatttatttgcctagcacgtgttcatgtgtcctccaccttaacgagtctggagccccgcgaagttattgcgtagcgttgttcgccaattctccaatctccactttttttcggagccatatgacttcattccctagcactgttcatgcatcctccaccaacgcgtctagactgcccgcgaagttattgcgtagcgctgttcgccaatctccattctccacttttttcggagccccatga

SEQ ID NO: 49842 - DNA, 387 bp, Glycine max
  Peptide Sequence Number=SeqID_141527
atggctcagcctaaaatctggcttggcgtcagcctaaaaatgtatttcggctatcagcaaacgctggcgtggtgtcgcgaggttgcgacgctggcgcagcatccggcagtgcagcgcggtgatgtcgggctgtttgtgctgcccgcttatccggccatcccggcggtaacggagatctttgccggcacgccggtgcgcgtcggcgcgcaggacgtgtgtcaggcggaaaacggcgcctggaccggtgaggtcagcgccagcatgctgcaggagctggggtgctcactggcggagatcggtcacgccgaacgccgtcgccattttcatgaagataaaacgcagattgccgccaaagtggcgatggcgctgcgttatcgcctgaccccg

SEQ ID NO: 49843 - DNA, 289 bp, Glycine max
  Peptide Sequence Number=SeqID_141528
gaaagctggagttgctgcacatgatgtccaacgttatgtcaaggaatcagattgggctccacaatgcacaaggcaagataaaagccaccttgatgttaccctaacatcaagtgttggacctgagtgtgtagagttgatctctattgttcagagagcaatctctggttgcacgggtagtgtcaaatataatctgcttgatctgaagcgtgatgtcgtgacatccggtacgacatctgtcattggtatcagaatttcaattggtatcagagcaggcactctaaatcactga

SEQ ID NO: 49844 - DNA, 537 bp, Glycine max
  Peptide Sequence Number=SeqID_141529
atggtagccacaacctaccaaacatcccatgagtgttcggaagaaaccattattgatatcttagtagcaggatattccggacaattgaaaggttggtgggataattatctcactaatgatgaaaactcaaattttattggagacccgtcactttggaaagataggtctgcagaattattatccaatcttaagtgtagaactttagcagattttaggtggtatagagataccttcctaactagagtctacatcagagaagatagtcaacaaccgttctggaaagaaaaatttctagctggtcttccaagatcattaggagataaggttagagacaaaatccgtagccagtctcttaatggagacattccatatgagagtttaagttacggtcaattaatttcttatgtccagaaagtggccctgaaaatctgtcaagatgacaaaattcaaagacaattagccaaagagaaagcccaaacaaagaaggatttaggatctttctgcgaacaatttggactatcagcttgtccaaaataa

SEQ ID NO: 49845 - DNA, 226 bp, Glycine max
  Peptide Sequence Number=SeqID_141530
atggctgccagaacggcagccagcccagcatcagatgctgaaagaggagccgcagccgcaggtggttttggcgttgggattggtcacgataaagcgggaaccttccagaccttcggtgtagtcaaccgatccacccaccagatactgcaggctcatcgggtcaaccaccagcgccacaccctgcttctcgatggtcatgtcgccgtcattcatttgatcgtcaaaa

SEQ ID NO: 49846 - DNA, 459 bp, Glycine max
  Peptide Sequence Number=SeqID_141531
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattggtcttgaactcctgacctcaagtgatctgctgcctcagcctgccaaagtgctgggattacaggcatga

SEQ ID NO: 49847 - DNA, 462 bp, Glycine max
  Peptide Sequence Number=SeqID_141532
atggggtcaaaccaagcgccttattttaaaaaaaggttctatcatatgaaagtcaagagcctagaactagccagcttgcaaaagctagggaagcagatggatcaagttcaacatcaagccttctgcaaggcatatgggaaaatctgggatttggccatgatagaagtgtccgttgaagccatcgcatccctcgctcaatattatgaccagtcgctcagatgcttcacgtttggggactttcgattggtaccaaccatagaagagtttgaagggatcttgggatgcccgctaggaagaaggaagccatatctgttttccggattctacacctccatggcaagagtagcaaatgtggtcaagatcttggcacaagagttagaccgagtgaagcaaaagaggaatggggtggtagggataccatggcagcacttggaggaaagggttgaagctttggcagattaa

SEQ ID NO: 49848 - DNA, 348 bp, Glycine max
  Peptide Sequence Number=SeqID_141533
atggcgactaagatgaagcaatgtctgtttaaagctttaggctcaatggccccacatagagaatggccaaggtgtagccatgacgttcaaaggatattcccactcaggaagaagtcggtcgccaaccttcacaacattcttttatcgttgtcagaggcctcccgtgggcattccttgtcttcgatgtatcgtttgatattgaagtaccaaggcttaccatctttctcttcttctattaagcaacaatgtgcaagctcatcacgacatctgaattcaatgtacgacaaatctccatgcgggcttagcaggaacatggacgctagtgtgacaagggcgtcggccatctga

SEQ ID NO: 49849 - DNA, 234 bp, Glycine max
  Peptide Sequence Number=SeqID_141534
atgccactgaaagactctactgagacaaagacgggctgtcaagaacgtagaggaggtttgaaaaaggatcttagagtgtctagggttgtgccaggagggtctcttaatgccttcctttttcttctcatcggagttatttcacaaagacttgccatggtaaagaagaagggggaacaagcacacttggagagcgcagtacaacggatagttgtatgctgcgttcgggaaggatga

SEQ ID NO: 49850 - DNA, 570 bp, Glycine max
  Peptide Sequence Number=SeqID_141535
atgtcggccttaaaagatcagatggcttctatcacggaagccatgctaaaaattcaaaaatcaatagaagacaatgctacggcggccgcttccaatacagctagggaagcgaaactggtgctacagcccgcaatgaacttgggccgagacagaaacgtgacgggtttcaatcggaggtatagtcctcaagcctacccttatggtttgcctccagacttcactccccgtaccgctccagacgatttgagccaagcccctaccttcgaggggcaactccctcctcatgccgactatcctctgcaggaagatgatgaaggagatgcccatttaggccctctacttcccccaaaggaaccggccccccatgagttgcccaaaccaaacataatccgccatgccccatctcaatccccacccgttaaggaactcgttcccatttcaaaagacaagggaaagattgatctgcttgaagagaggttgagagcggtggaaggcctcggcaaccatcctttctcggatttagccgatctgtatctggtacctgacatcatcattcctcccaagtttaag

SEQ ID NO: 49851 - DNA, 510 bp, Glycine max
  Peptide Sequence Number=SeqID_141536
atgaacgtccatgtggctcagttgatcgctgacgtcatttatttatttgcaggtatgccacctaccaggcaccctctagacccggataagtctaacaaggccttgggggttcccgtcacacctagtaaggtgattcgaccgccgatcacccgggccttcattgagaagtattgcacgcctagacaagcgcagggtgatgcaccgcaggccacagacgcaccgtcaccacctcatcaggctgatccagctgggtcatttggcatggagcggtatttgcagcacttggttcgccagcaggcggccaaccacagggggcaggtgcagatccatgagtgtctctaccagctcagcctcaatcaattcagggcggaggtcgcatggcccggagattgtcttgaggcccaggcaggggtggcgcctgcagaggctcccggcgatgcagaggaggccctcatggatgaggagatgacagatttactcggtttcttgggagggagtggagccacatga

SEQ ID NO: 49852 - DNA, 327 bp, Glycine max
  Peptide Sequence Number=SeqID_141537
atggcatccttcagccaccttcagtcgcagatgcaatctcagggagttgcagtgcctcctgagcctgtggttggtcctagtccctccggtcctcgagtgagcacaaaagggagttgtgttgatccctcaggaaacgatcctgagaccggtgactttgacaggcacttcacacctttccttgcttggccgacacatctggtcaagtctttatcacagcaggtagctgtgtctccgccaaaaccacctccgaagcccgatccggaggtcgatgatccgctttatctgatgacattgaccatcccagagcttttcttgaggccttattag

SEQ ID NO: 49853 - DNA, 1210 bp, Glycine max
  Peptide Sequence Number=SeqID_141538
aaaggccgagcagggcactgccgaccggggccagcacggaaactttccttcatcgacgtggcttcgcgggggaagaccagggtcagaacgtgcttctcgcccgacacttcatcttcgcactccacgcgcgaatgcatcatgacgatgccttcgggaatctggtccggtgccagcacggtggcacggttgagttcttcagcaagcgcgagcgcggcaggcgtctggctcagcgcaggggattcgagcatggcgtccaggcggtccatgtcgaaggtggaaacggtgatcgacggcggcaggccgctggcggtactcatggtgaagctccttggttgaaagccatgcaaaaggcggcacctgctggcgccgcctgtctgtattgtggggacaaatgcggccggaatcgactcctgccgattccaggccggtactgcgggggctcagccgttcagcgcggggccgggcagggcggcagtgtcgccggcggcgttgaccgcctccagggtgaacagcgcctgcggcaggcgcttgaactggtcggccagctccataaggaagtcgttcatggccgagctgcggcgccagatcatggcgatgcggcggctgggacggccttcgccggtgaaatcgagcaggcggatgttgttcgagcgcgggaccggcggttgcaccgacaggctcggcagcagagtgatgccgacgtcggcggcaaccatctgccgcagcgtctccaggctggtggcgcggaactcggacttctcgttggcaccgaacaggcggcagacttccagtgcctggtcgcgcaggcaatgcccgtcttccagcagcagcagcttctgcgtggccagtcctgcacgtccagccagcaggaacggctcctcgaacaggaattcggcgtgcagctggtcgtcgatcaccggcagggccagcagcgcagcatcgagtttgccttcgcgcaggcggtcgagcagcacatcgctcttttcctcgaccagcagcagttccagctccgggaagcgatcgcggatgcgcgggatcacatgcggcagcaggtacgggcccagggtcgggaagatccccaggcgcaccgtaccggcttccgggtcgcggctgcgtcgcgccgcttccttcagctgttccacttcggacacgatcacccgcgcccgcgcggcagcctcctggccggccggggtcagcatcaccttgcgcg

SEQ ID NO: 49854 - DNA, 471 bp, Glycine max
  Peptide Sequence Number=SeqID_141539
atggtggaaagttggaacctcttacgtgccgatcaacgtctcattttcgccaaaaagttggcccagggcttcccgggtatcaacagggacaccaggatttatttattctgcgaaagtgatcttccgtcacaggtgctccagtggcttctgtttctatcagctgtccctcctgttcagctactgacggggtggtgcgtaacggcaaaaagcaccgcccggacatcagcgctggcaagtgtagcggttcccgctgcgcgtaaccaccacacccccccgcgcttaaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 49855 - DNA, 327 bp, Glycine max
  Peptide Sequence Number=SeqID_141540
atggcaaaggggtgcgaaatgaccaaattttgtctccgcgtgtcatcgggcccgccgcctctggatgacaaagggtgcagaatgaccaaattttgtcttcatcacatgctcagggcccgccgcctcagtatgacagatcttgtggggcgcgacaaaagcaaggctcttgctctactcctgccaatgaggaatcagacctacgtagttctaaataaacttggagacttgaaaaatttgtctccaccggaagacgctgacatctccggaaagggcgcagatgaccacattggcctctgctcatcaatcacactgggggtcactgaatga

SEQ ID NO: 49856 - DNA, 366 bp, Glycine max
  Peptide Sequence Number=SeqID_141541
atgtcgtcgtggcatagggatcgtgcccgcaagacacctagtggacccgaagatggccaacagggtcttggagttgccagctctaaatacgggtctctgtcagttcaagggagtgcctgttgcccccagcaaggtcatcaggccccctaccaatcgagctttcatcaagaagtattgcgcccccaggcagacgcagggcgaaacaccacaacagcattgggatggccggtagcgggcaatagacgcaccgccgccacctctagagttcacctctgctcatccacaaaaaggtttgagtattgcctacaccacatggctgaccagcaggctaccaagtccaaagccaaagataagcaaaagtgctag

SEQ ID NO: 49857 - DNA, 312 bp, Glycine max
  Peptide Sequence Number=SeqID_141542
atgtcccatgctgtcaaggaccatcgagggaaatgggccccgaactacgaagggccttttgttgtgaagagggctttttccggaggagccctggggcaggatcaccttgggctaccttctgaggtagagacaaaacgtgagcggcagaaaccaatcaaggtagggtacttaaggacggatgcaagtggggatggggtcacgaccgaccgatcgttgccccttctctgtgcggaacaagcagagaatgtcgctgcaaggcagccccgtatcctttgtattttgcagctttcttttactatttgtttgttttaa

SEQ ID NO: 49858 - DNA, 744 bp, Glycine max
  Peptide Sequence Number=SeqID_141543
ccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgtttcttcatcgatgcaagagccgagatatccgttgccaagagtcattgtatcgccggggtttgtgtttgtcgcgaggacgaggaggccgggcgcacggggcgccgtggtcatcccctccctcccgacggttcagtggacttctcacaacgtcgcgggcagcgaaccgctcacgtcgccgcatccgaacacttcaccggaccattcaatcgtaggagcgacgggcg

SEQ ID NO: 49859 - DNA, 345 bp, Glycine max
  Peptide Sequence Number=SeqID_141544
atgggggtacaaatagcaatcaggcccacttgggccttccaggatcttgcaacagaaggcggtgcctttttggtggaacaacctagctcgcctgggcgagctgggtggcaaccacctccctcttttccccctataaatagggggaggatggccaggagaaaaatgttcaaccctcctggtatccgagaatcacttaaaattagtgagaaaaattgtttccgtgaagaaaatccatgtcgaggcgcttccataacgcttccgagacgtttttgtgggcgatatcgcaaaggttttccaccgttctttgtgttcgttcttcgtcgttcttcggtcttcaaccggtaa

SEQ ID NO: 49860 - DNA, 213 bp, Glycine max
  Peptide Sequence Number=SeqID_141545
atggcaagcccatttcacctcgaccttgccgctttcagccgctacttgctacgcgaaccgcgcgacgggcgaccgcttcgcggttacagcttcgaaccgcgcttgcttaccttcggtccaagcgcggtaggtttaagcctcttgtgctgcaagcacaaggccctctgccgctgtcaagctaaggcgcctaaccgcgtagcggttgatacgtag

SEQ ID NO: 49861 - DNA, 474 bp, Glycine max
  Peptide Sequence Number=SeqID_141546
atgtgggctttccttaccgatcatcagatcgactgggctcacttggttcggtaccgaatgcataaggcattacgggtcaatgcacctcttccatatcctcaattggtcaccctttttctccgtcattttcaaattcctcttgatgatgaaccttttgttcaagtcaagcgttcctttgctataggtgctggtgcagtcacttcatttagttaccgtaaggatcgtgatggtcaatggctgaagaaggatgcactccctccacaagatgagcgtactccttctcctcctcctcagcgagatgattcagcccttatgactgaagttctttcaaagttacggggtcttcacacttatgttggtgaaagattcgattccttggatggtcgctttgaaggcatggatacccgcatcacccagcttgaagaggatatcacttatcttcgtcggtgctttgaccttccaccactgtcttag

SEQ ID NO: 49862 - DNA, 396 bp, Glycine max
  Peptide Sequence Number=SeqID_141547
atgttaggattcacaagcgattctcctcaaatttcagccagcccgcatcaattagactttgcaccttacgcttcagggccctacaatgctcaatggaatgccccggggcttctccatgacaagcacacgttgcattcgagtcgtatcctcggagaaatggaggttgaggaaccttggttggagttatggctaccattgaattatcgagtagatataggagcaagtcagcataggacaccagaatgggggtggtgtttagcattggttgtgtggaaggtgggttttgtggttgatttagggatggcctttgtggataactgggtggtgggtaaggagaagggttgttattggttgagtaatgacattgttgggttggtgggaaacttgaccatatag

SEQ ID NO: 49863 - DNA, 890 bp, Glycine max
  Peptide Sequence Number=SeqID_141548
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttatatgtatcttgtgggattgattggcaagattttaaacgagttaagaaagctatacagggtgattgcatcaatgccaagctatcgcttttatgcgagcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49864 - DNA, 697 bp, Glycine max
  Peptide Sequence Number=SeqID_141549
atggagattattatttccgttccactaataacttgtgatttttgccgaagggagcattaccaggataattgttatatgtactccacaaataactctgggtggagacagttaactccctataatcagtatgaagagcaaagagtccccgatcttgacattgtgtttgcagaattcatggcatatcatgctagttctaaagctaatcataatgcaatacaaaagcaggagattcaatgtgctaaagttttttttgaagattatcaaggggaaccagagtcacaattctactatcaaaatgaattagaaaggagtttcaatctggacattttgttaatgcaattcaaggatacaattggatcaattcaacgggcatttaaaagtgcagaaattcaggttggtaagctggtagaagaagtgactcaagctatgagcagaagagaagaagagattgtaaaggttgacactcaagaggagagccctgtgaatgagcatgatttagaagaagaagataaggagaaagcgcaacaatggaaacaatgcttacaaacacacactcaacaagaagataatttccaagttaacacatgttctcatcaactgactatcaaagaagaaaggcatgaagaccatgaggcttcaatcattctaggacaaccctgtctgacatttgctagttgtgttttcgacatgggtaaag

SEQ ID NO: 49865 - DNA, 492 bp, Glycine max
  Peptide Sequence Number=SeqID_141550
atgaccatgattacgccaagctcgaaattaaccctcactaaagggaacaaaagctggtaccgggccccccctcgagttagaattaataatctagcaaagtttgtatttgaatacacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49866 - DNA, 126 bp, Glycine max
  Peptide Sequence Number=SeqID_141551
atgtacaattatcatgagaaaggaagagctcctgatcttgaaactggctctaaaggtgatggctattcaatgcaacagcaggaaactcagtttgaaaaagactattcttttgcagattatcaatga

SEQ ID NO: 49867 - DNA, 491 bp, Glycine max
  Peptide Sequence Number=SeqID_141552
atggagtctcattctgtcacccaggctaaagtggagtggtgtgatcttggttcactgcaacctccacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49868 - DNA, 1029 bp, Glycine max
  Peptide Sequence Number=SeqID_141553
atgtgcaagtgccgttcacatggaacctttcccctcttcggccttcaaagttctcatttgaatatttgctactaccaccaagatctgcaccgacgaccgctccgcccgggctcgcgccctgggttttgcagcgaccgccgcgccctcctactcatcggggcttggtccttgccccgacggccggtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgttttcaagacgggccgaatggggagcccacaagcccgacgcccaggagcgcgcaggtgccgaggcacgccaagggcgcgcgctgccatccacaatcgcgatgatgacgtctccacgagcatatcaaacagccccgggcttgggccacccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtttcttttcctccgcttattga

SEQ ID NO: 49869 - DNA, 267 bp, Glycine max
  Peptide Sequence Number=SeqID_141554
atggctaccattgaattatcgagtggatatgggatcaagtttagcataggacactggaattgggactttgtggttgatttagggatggcctttgtggataactgggcggtgggtaaggagaaggtttgttattggctgagtaaagacattgttgggttggtgggaaacttggccgtacaggaatggcagtcacaacatgggtttttccctcatcctcaccctctttatttgccccagttttctcattcgtcaaagcaggatgattaa

SEQ ID NO: 49870 - DNA, 318 bp, Glycine max
  Peptide Sequence Number=SeqID_141555
agatctttcttgatcggtgctgctgtggttgcatcctttggttaccgcaaagagcatgatggctcttgggtaaaaaagggtactcaaccaaatgatgatgaaggacaattactggttgaaggagactcttttctccttcaaagtattttggacaggttcgatggactccaaacttatattggtgaaaggtttgatgctttggaacaacaagtggacacgcgattcgacgagatggactcaaggatcacaaaggttgaagaagatgtcaccttcattcgcacatgctttgatctaccaccaccaccaccatcgtcttag

SEQ ID NO: 49871 - DNA, 255 bp, Glycine max
  Peptide Sequence Number=SeqID_141556
atgatacgcggagataccttacggttatccgccccccctttgccattcagacacagtcgtgttcgatggcaagcagagaccaagtttggtcattctgcacccatgatacgcggagataccttatggcccacttgggccctccagaagattcctccagaaggcggttgcttctggaggaagcaaccttgctcgcctgggcgagctgagctcgcctgggcgagctgggcggcaaccacctcccctattttgctataa

SEQ ID NO: 49872 - DNA, 979 bp, Glycine max
  Peptide Sequence Number=SeqID_141557
cttgtctcagcgtttatgcgagacagagaccaacatgctagctatcatcgccaagtaccaagaagacttaggtctagccgcggcccatgagcataggattgcggacgaatatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattggaaaaacaccataactaaacgcgccgcagggatccctatcgcaccagatccaaatctagaacgatggagaagaaacgcggccaccgccgccgctgccagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccgtcttgcaagaagatgcgggccacattgcttctcccgtccatgaaagagagcctcctcagcagcccgacgaagtccacaaagaccctcaagattatgctcggagggatgtcgagttctatcccccgatccccgaagggccggcaccaggcacgttgcctcaacccaacatcgcagtaccaccaatagttctgtccacggaagggccgcccccagtaactgaagaaaggaggaagctcgatctccttgaggaaagattgagggccgtagaaggatttggggactatccgttcgcagacatgacggatctttgcttagtacccgatgttgttattccctcgaagttcatggtcgacggcatcgataagcataaagggacgacttgtcccaaaaaccatctcaaaaatactgcc

SEQ ID NO: 49873 - DNA, 423 bp, Glycine max
  Peptide Sequence Number=SeqID_141558
gatgtaccggacacactaaaggagctagtatggaatgagattttggccaagtttgatatcccagaagccctacatgcaaagaaaaaggaccaacataaagaagatccttccgtcaaatatggctttgatgcacagatatgggaggaatttgtggcaacccgcaaaacccctaattggcaggaaatccaaaagaataatgactgtccccatttgctttcccgcgggggatatgatttgctagaaaagaagctgttagacgagaaaatcaagaaaaggcaacatgacgcattgatgactgaaaatccagcactcattgaggacctcccatctcccattcaaagacatgtcaagtggaagatggcacgcacgaaccgatatgggatgatgacatctaaggctgctagacaaattgctgataaaatt

SEQ ID NO: 49874 - DNA, 468 bp, Glycine max
  Peptide Sequence Number=SeqID_141559
atgggtgatcaagaggagacacaggaacagatgaaagccgacatgtcggctctgaaagaacaaatggcctccatgatggaggccatgttagttcggctgccgaagcagacccgactctctttggcaactgcgcaccatcctccctcaaacatagtaggacggggaagggacacactggggcacgatggcagccctcacctgggatacaaccgagcggcttacccttatggattgccgcccaactactcaccacccgtcttgcaagacgatgcgggccatattgcttctcccgtccttgaaagagagcctcctcaacagcccgaagaagtccacaaagaccctcaagactatgctcgaagggatgtcgagttctatcccccgatccccgaagggccggcacccagcacgttgcctcagcccaacatcgcaacacaaccaatagttttgtccacggaaggaccgtccccg

SEQ ID NO: 49875 - DNA, 432 bp, Glycine max
  Peptide Sequence Number=SeqID_141560
atgacattcaagggtctccgaataaaagtggaaaatggagaattggcgaacaacgcatcgaattcctgcagcccgggggatccactagttctagagcggccgccaccgcggtggagctccaattctccctatagtgagtcgtattacaattcactggccgtcgttttacaacgtcgtgactgggaaaaccctggcgttacccaacttaatcgccttgcaccacatccccctttcgccagctggcgtaatagccaacaagcccgcaccgatagcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49876 - DNA, 545 bp, Glycine max
  Peptide Sequence Number=SeqID_141561
gtggactacacgtcgccttgagaggctacacgcctcaccttgggtacttgtacctatcaccttgagaggactacgtgtcctcgccttgagaggactgcatgtcctcaccattcagagggctacacgcccttacctccagaggactacatgtcctcgccttgagagggctacacgccctcaccttggaggactacacgtcctcaccatcagagggctgcacgccctcacctccagaggactacatgtcctcgccttgagagggctacacgccctcaccttgggactacacgtcctcgccatcagagggctgcacgccctcacctctagaggactacatgtcctcgccttgagggggctacacgccctcaccttgggtactagttaccctcaccagggctacacgccctcaccttgggtactagttaccctcaccgttgagaggactacacgtcctcgccttgagaggactacacgtcctcaccatcagagggttgcacgccctcacctccaaagaactacatgtcctcgccttgagaggactacac

SEQ ID NO: 49877 - DNA, 234 bp, Glycine max
  Peptide Sequence Number=SeqID_141562
ggattggggtacaagaacttagttgtgtatgtgtgtcttaatgcagtcttggttgcgtttagtcttacaagaaggatctgcgggcgaggcttgatcaggactaggctaggatattgtcgcaacctaccctttggcgggcgagcgaggcgaggctcacaggtcgacaaaagcggggctcttgctcctacgtaccctccatcgaagagaaaatcagtcctacgtagttctttctaa

SEQ ID NO: 49878 - DNA, 238 bp, Glycine max
  Peptide Sequence Number=SeqID_141563
cttgggaggattgatggggactcggcattgagaggaacgagggtaagggctacgtgggagtacgtgagctcagttggaggtgggcaacaggggatggagaccttggggacgttaggtggggtgctattgcccaaaaccaagcttgaccaatcccgacccaacccgggcatagttgtggaggcctctggtaatcgattaccaggctgtgtaatcgattacacagagaaacatgccactg

SEQ ID NO: 49879 - DNA, 67 bp, Glycine max
  Peptide Sequence Number=SeqID_141564
ggaattggaatgaggataggtgtcattccttgaagaatttgagtcaagaagcaaagggccaaccacc

SEQ ID NO: 49880 - DNA, 198 bp, Glycine max
  Peptide Sequence Number=SeqID_141565
atggatgattttcaggtttcaaatgaacacgagatggaattattgagattacaccaacatgaagaaaatgacaagaaaaagaaaggaattgctcttaaagcatcatcttcaattcaagaagaaagtgatcaggataatgatccagatgatgatgatgatctaagtctttttgtaagaagattcaataagtttctgtga

SEQ ID NO: 49881 - DNA, 990 bp, Glycine max
  Peptide Sequence Number=SeqID_141566
atggggacaaatcaaagcggcaaaaggttttatcaagtcaaggttaaaagtctagatgtcactagcctcaaggaattgggacgattgatgggacctctccaaaggcaagccttccgcaaagtgtacgggaagattctagatttgaccgcagcggaggtatttacggaagttgtcgtatcccttgcccaatactatgaccagccgttgaggtgtttcacgtttggggacttccaaatggtaccaactattgaagagtttgaggagatattaggatgccctcttgaggggagaaaaccgtatcttttctccggcttcttccctttgagcaagattgcagctgtggttggagattcagcaaaagagttggatcgtatgaagcaaactcggaacggcgtagtgggcctacctcggaagtacttggaaggcaaggcaagggatatggcaagccaagagaagtggggcccgtttgcggatatattagctttgttgatttttggagttgtcctctttccgaacgttgacggtttggtagacttagccgccattgatgctttcctcgcatatcaccatagcaaggaaagtccagtggtggctatcttggcagatttgtttgacacctttgaccggaggtgtgagaaaaacagtgcacggattgtctgttgtttacccgctctctgtgtgtggttgatttcacacctattacgacaagacacaagacacccgtgtccgcttcaaagctatcgctcatgcgccgaaaaaggaagactcaattgggaccaacatttggctgggatagggggcagcgcgatcaattggtttcctcgttggaaggaaggcaaggaaggagttcttttctcgtgtggggactaccctaacgttccactgatagggactaggggttgtattaattataatcccgcacttgccataagaaagctagggtatcccatgaggggagcgccaaccgaagaaagtctctcgcctttcctt

SEQ ID NO: 49882 - DNA, 135 bp, Glycine max
  Peptide Sequence Number=SeqID_141567
atgtggaccaccacggggggggagaagcttgccgcccagctcgcccaggcgagcaaggttgcttcctccagaaacaacagccttctggagggcccaagtgggcctggttgctatttgcacccccctgtttactaa

SEQ ID NO: 49883 - DNA, 186 bp, Glycine max
  Peptide Sequence Number=SeqID_141568
atgtctggacctggctccactcctggtggtgcccttccgtcaattccttcaagtttcagccttgcgaccatactccccccggaacccaaaaactttgatttctcacaaggtgccgaacgtgactatcatatcctcgtccgatccctagtcggcatcgtttacggtcaagactacgacggtatctaa

SEQ ID NO: 49884 - DNA, 201 bp, Glycine max
  Peptide Sequence Number=SeqID_141569
atggctacattgggacaaggagagttgattcaaggctatatccttataatgggtcttgattctatactgccagttcttagcaccctgatagcaatgtatgaagatgctaaatataatcccggcaaaggaagggaaaaaattaatggaaatattagcaaattctgcataaactgtaatttaaaggcaatcaaagtatcttaa

SEQ ID NO: 49885 - DNA, 1155 bp, Glycine max
  Peptide Sequence Number=SeqID_141570
ctctcctttagaggaccacatgtccttgccttaagagggttgcacgcccttgccttcagaggactacacgttctcaccatcagaggactacacgtcctcaccttcgaaggactacacgtcctcgcctacaaagggctacatgccctcaccttcagaggactacacgtcctcgccttcagagggctacatgccctcgccttcagaggactacatgtcctcgccttcagagggctacacgccctcaccttcagaggactacacgtcctcgccttgaggactacacatcctcaccttcagagggctacacgccttcaccttcagaggactacacgtccttgccttgaggactacacgtcctcaccttcagaggactacacgcctttgccttcagagggctacacgcccttgccttcagaggaatacatgtcctcaccttcagaggactacacgtcctcaccttcagagggctacacgccctcacctttagaggactacataggactacacatcctcactttcagaggactacacgtcctcgccttgaggactacacgtcttcgccttgaggactacacgccctcgccttcagaggactacacgtccttaccttcagaggactgcacgtccttgccgtgcagctactatgcataccggggcaagatttcacccagtgaccacaatgccgatctccccctgcgaaagtatcagttggatcgcgcccacaagacacccagtggacctggagaagtccaacagggccctggggtttccagctctggttatgggcctctgtcagttctaccgagtgcctgtccccccagcaaggtcatgccatcgtggtgtaggatcgcgcctataagacactcagtgggcccagagaagtccaatagggtcctggggtttccagctctgattacgagcctttgtcaattctacggagtgctcgtcgcccctaacaaggtcatcagacctcctactaatcgagctttcatcagaaagtattgtgcccctaggcaggtgcaaccaagtccaaagccaaaggtaagcaaagtactagtccgtgaccgacaagtcatcaagcgtccagctcaagacgttaaagaagcgctactaggaggcaacctagtaccttttaattctctgcttgttatttga

SEQ ID NO: 49886 - DNA, 527 bp, Glycine max
  Peptide Sequence Number=SeqID_141571
tgagaggactacccgtcctcgccatcagagggttgcacgccctcaccttcagaggactacacgtcctcgccttgagagggctacacgccctcaccttgggtactagttaccttcaccgtcagaggactacacgtcctcgccttgagaggactacacgtcctcaccaccagagggctgcacgccctcacctccagaggactataagtcctcgccttgcagagggctacacgccctcaccttggttaccctcaccgttgagaggactacacgtcctcgccttgagaggactacacatcctcaccatcagagggctgcacgccctcacctttagaggactacacgtcctcgccttgagagggctacacgccctcatcttgggtactagttaccttcaccgtcagaggactacacgtcctcgccttgagaggactacacgtcctcaccaccagagggctgcacgccctcacctccagaggactataagtcctcgccttgagagggctacacgccctcaccttgggtactag

SEQ ID NO: 49887 - DNA, 282 bp, Glycine max
  Peptide Sequence Number=SeqID_141572
atgacgaacaccacctttagcacaaaccaaaacaccaaccaagaaatgaaatttgcagcgaaaaagcctgtagaattcaccccaatttcggtgtcctatgcggacttgctcccatatctacttgatactgcaatggtagccataacccatgctaggtttcctcaacctccatttttccgagggtacggctcgaacacaatgtgtgcttatcatggaggagccccggggcattccattgagcattgtatgaccctgaagcgtaaggtgcaaagtctaaattga

SEQ ID NO: 49888 - DNA, 717 bp, Glycine max
  Peptide Sequence Number=SeqID_141573
cagcaacaacaacagcagcctgctccttccttccaaaatgctgctggcccaagcagaccatacattcctccaccaatccaacaacagcaacaaccccagaaacaaccaacagttgaggcccctccacaaccttccctcgaagaacttgtgaggcaaatgactatgcagaacatgcagtttcaacaagagaccagagcctccattcagagcttaaccaatcagatgggacaagtggctacccaattgaatcaacaacagtcccagaattctgacaagctaccttctcaagctgtccaaaatcccaaaaatgtcagtgccatttcattgaggtcgggaaagcaatgtcaaggacctcaacccgtagcaccttccttatctgcaaatgaacctgccaaacttcactctattccagaaaaaggtgatgacaaaaatttacctaacaatttctgtgcaggtgaatcttcttccacaggtgtcgcaacctacccttcgacgggagggcgacgcgtgactcgcggaatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaagggtgtttccctttgctcctacgtattcctcaatttgggatgagaaaatcagacctacgtag

SEQ ID NO: 49889 - DNA, 377 bp, Glycine max
  Peptide Sequence Number=SeqID_141574
gactctgccagtcgttcggagtccccgtcgcacctagcaaggtgattcggccgcccatcacccgagcttttattgagaagtattgcacacagagacaggcccagggggatgctccgcagaccgcagacgcgccgccacctcatcaggctggcccagctggatcatttgatacagagcagtatttgcggcatttggttcgccagcaggcggccaaccaccgggcgcatttcagggcagaggtcgcatggcccggagattggcccgaggcccgtgcaggagaggcaccagcagaggctcccgacgaggcagatgaggcccacgaggatgaggagatgaccgattttcttgatttcttaagagggagcggagccacatga

SEQ ID NO: 49890 - DNA, 147 bp, Glycine max
  Peptide Sequence Number=SeqID_141575
atgtggtacctcaaagccttacactggggcaatgaaaggcaccatccttacactggggcaatgagggacatcgtgcatgagcctcaagtgaacataggggcagatcaaaaaagggggcagacaaaccctggaatttcaatagattga

SEQ ID NO: 49891 - DNA, 237 bp, Glycine max
  Peptide Sequence Number=SeqID_141576
atggccaagtttgacccagatgtggtcctagagttttatgccaatgcttggcccacggaggagagcgtgcgggacatgcggtcatgggtaaggggccagtggattcctttcgatgcagacgccctcagccagttcctgggagacccgctagtgttagaggagggccatgaatgcgagtatagtcagagaaggaacagggccgatgatgcaatcctaccccgcaaaggcattggatag

SEQ ID NO: 49892 - DNA, 159 bp, Glycine max
  Peptide Sequence Number=SeqID_141577
atggcagcggaatggagaagaagaagagttgagaggagacgccacttcaaggagaagatgagtcaagaagaagctcaccaccataggaagccatggataagagcttggagccccactaatccaagatcaagtccaagattctccactaagtgtgcttag

SEQ ID NO: 49893 - DNA, 432 bp, Glycine max
  Peptide Sequence Number=SeqID_141578
atgcttgtcaggggggcggagcgctatggaaaaacggctttgccgcggaatcccttcacttaccctttctcctggcatttcctagaaaatcgaattcctgcagcccgttgtagggccactttcagcgtgccgcatgcgaccgagcgtaggagctcaacaattcgccctatagtgatctgtatctacatattcagctggccgtgcagctttttctgccacaacgcattcgtgactgggaacaccctggcgttacaggccaacatagtaacgccgtatgcacacatccgctttagcgccgctggcgtaatacgcaaaggcccgcccgatcgcccttcgcgcaacagttgcgcagccgattcattaatgcagcgaatggcacgacagcgtttcccgactgtgaaagcggcgcagttagagcgcaacggcgggtaa

SEQ ID NO: 49894 - DNA, 488 bp, Glycine max
  Peptide Sequence Number=SeqID_141579
atgcctgtagtcccagctcctcaggaggatcatgtgagccccagaggtcatagctacagtgaacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49895 - DNA, 234 bp, Glycine max
  Peptide Sequence Number=SeqID_141580
atgctccaaccatatgggatcagtgtaggcttaaaggagcactcaaacccgatgacccccaaggcctacactccgaagagtccgtcagggcctctccctcctgattcagctccattggagcttgtaggcctaggatcttcttcatcaatggattcctttgcttcttggaagataaaatggcagcggaatggagaaggaagagagagaggagatgccacttcaaggagaagatga

SEQ ID NO: 49896 - DNA, 159 bp, Glycine max
  Peptide Sequence Number=SeqID_141581
atgagcaccgaacctccaccttgtgagaggactctaagggaaatggttgcacttgatttcacctatgaaagcttgtgcatccaataccctgatgaggatgtcccatatgttcttaaaactggactgatccatttgcttccaaagtttcatggcttgcag

SEQ ID NO: 49897 - DNA, 381 bp, Glycine max
  Peptide Sequence Number=SeqID_141582
atgacacactttgatggcctgtatctcttttcttcatttattggaggtttcactagaagattcaacaccaatctgtgtctgttcttcctctaccagctcaatatctttcgtttcacttttgcttttgtaaactacactgtaatttacaaaacaaaagttggaaggaaagatattgagctggtagacgaggaagaagcacagcttggtgctgatcgttctagtgcaatctctaataaatctgagatttataaggaggaagcacggaatgcagcacagaagcataaaccaaagagggtggagagtgtcaatgctgatgcagaagcctttggtgatcactggaaaattcagattgctttatgcattctgaagctgaagcactag

SEQ ID NO: 49898 - DNA, 883 bp, Glycine max
  Peptide Sequence Number=SeqID_141583
aggagaatagattgggaccagcttttggccgggataggaggtagaacaatcagttggttcccccgatggaaggaaggaaaagaaggagtccttttctcatgtggaggatacccaaacattccgctagtaggaacgaggggttgtattaactacaatcccacgctcgctataagacaactagggtaccccatgaggggagcaccgacggaagaaagcatgtctcctttccttgtgagggatttcggcgcacaaaattccaaaactatacaaaaaatccataaggcatgggaaaccccgttaaggaaagatcaagaacttagaggcattcgtaatggcatcattggtggctaccatgaatggctgaaagttcatatacgaggtttagattggctcgccaagttaaaagtcgtcagcaaagagagttttgaagcaccggaagaggacgaagttcaaaatgcaattaccgcaagagcccttgaacaagagaccaagagggctcgcaaggaagagtatggccggaataaatttcgcggagctctatggggtagcaatagtgaactcaagctgcgaagggaagagagggaccagtcgcgagcacatagcatgaccaacatgctagctatcatcgccaagtaccaagaagagttaggtctagccgcggcccacgagcataggattgcggacgaatatgcccaagtatacgcggaaaaagaggctagaggaaaggtgatcgactctttacaccaagaggcaaccatgtggatggatcagtttgctcttaccttgaacgggagtcaagaacttccccgattgttagccaaggccaaggcgatggcagacacctactccgcccccgaagagattcatgggcttctcggctatt

SEQ ID NO: 49899 - DNA, 324 bp, Glycine max
  misc_feature (289)..(289): n is a, c, g, or t
  Peptide Sequence Number=SeqID_141584
atggctccaaagaaactctccacgaagaggtctagaagagacgccacaagagaagggtccagtgccgccctcgagtttgatagtcatcgtttccggagtgctgagcaccagcagcgcttcgaggccatcagaggatggtcgttccatagggagaggcgtgtccagctcagggaggatgagtatatggactttcaagaggagatagctcgcagacgttggacactgctggtgattcccatggccaagtttgaccctgagatagtcctagagttctatgctaatgcttggnccacaaaagagggagtgcgagacatgcgttcgtgg

SEQ ID NO: 49900 - DNA, 346 bp, Glycine max
  Peptide Sequence Number=SeqID_141585
atgggatttttacaagatgataaagaatttattgaggcaatcaaagaagcaaaagactggggttcaacacattatataagaaagctatttgtgttgttacttttaactgcaacaatgagcaaacctgaacaacttgatgatagaactcttcaaaatttggtcttgcttgaaattgaacaactgctgcaagcaaatcaaagatcgctaagagactatccttcaatgccatatccagaggatgcgaattgtccagcttatctagacaatagccttatattagttgaactgaactacaacaatgaagaacttagattagagtttgaacatctattttctcacatggcag

SEQ ID NO: 49901 - DNA, 207 bp, Glycine max
  Peptide Sequence Number=SeqID_141586
atgaatgatagaggattacttaaggaggaagaatttggcttagctccattggagcttgtaggcttcttcatcagtagagtcttttgcttcttaaattttgatagcagtgggatggagaaggagaaggatgattggagatgccacttcaaggagaagatgagtctaaaagaagctcaccaccataggaagtcatggataagagcttga

SEQ ID NO: 49902 - DNA, 725 bp, Glycine max
  Peptide Sequence Number=SeqID_141587
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggatgatgttcctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49903 - DNA, 288 bp, Glycine max
  Peptide Sequence Number=SeqID_141588
atggtgaaagttggaacctcttacgtgccgatcaacgtctcattttcgccaaaagttggcccagggctgtcccggtttgcaacagggacaccaggatttatcgttttctgcgaatgcttccgtcgcgaacagctaaccaccacacccgccgcgcttaattgcgcttgcgctacagggctgcccgctttcccattcggaaaccatgtcaggctgcgcaactgcattaatgaatcggccaacgcgcgggcgatcgagtgcgggcctcttgcgtattacccagggcgctaa

SEQ ID NO: 49904 - DNA, 264 bp, Glycine max
  Peptide Sequence Number=SeqID_141589
atgaagacgaagctggtgtttgttacctatgatgatgttttgaattgggctcgcgttattgtttatgaaattggttttatgacagtgattatgaggttagacacaaatactggtataaaaggaaggacgtcatttgtcttaattggttgtaaaatgagtggtcagtatagtgtcgggaagaaaattttggtaagaacaaatactggcagtagaaaatgtgggtgtccctttaagctgtgtgggaaaccagtggttggaggataa

SEQ ID NO: 49905 - DNA, 384 bp, Glycine max
  Peptide Sequence Number=SeqID_141590
atgggggtgcaaatagcacccaggcccacttggggccctccagaagattcctccagaaggctgttgcttctagaggaaagcaacctggctcgcctggggcgagctggagcttcgccagggcgagttgggcggccccccccctcccctatttttgcttataaattagggggagggaagtggaagaaagaaaagggggttcagccccttgagggcacttttctctctttcgaaatttgcttgggaaaaaatttgtttttctgtgaagaaaaatctaagccgaggcgcttccgaaacgttttccgtaacgttttccgtgaagaatttcgcaaaggtttcaaccgttcttcgacgttcttcattcgttcttcgatcttcaacgggtaa

SEQ ID NO: 49906 - DNA, 781 bp, Glycine max
  Peptide Sequence Number=SeqID_141591
ttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgattcaaatgctttcaatcttgttacgtgctacgctaccagatctgttcctagtaaatccgtttctcattttcaaatcgcgaatcgagcaattgatatctctctgttctttttcctctctgttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49907 - DNA, 828 bp, Glycine max
  Peptide Sequence Number=SeqID_141592
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagctcagcagcaagcacagagactacatcaagctcaggagttggaagggcaacctgttgaaatggacaccgtctcaataattgcaacatttccttcagaattacgagaagaggcaagttctattaacatccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49908 - DNA, 467 bp, Glycine max
  Peptide Sequence Number=SeqID_141593
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttcccccctggcggctccctcgtgcgctctcctgttcctgcctttcggtttaccggtgtcattccgctgttatggccgcgtttgtctcattccacgcctgacactcagttccgg

SEQ ID NO: 49909 - DNA, 573 bp, Glycine max
  Peptide Sequence Number=SeqID_141594
atgggaacaaatcaaaccggcaagaggttctaccaagtcaaggtcaaaagcctagataccaccagcatcaaggaattagggcggttgatggaacccctccaaatgcaagccttccgcaagacttacggaaagatcttagagttgaccatagcagaggggaagaaaaccatatctttcctccgggtgtctcccctctttgagcagaattgcaactgtggtcaaggattcagcaagaagtacctagaagacaaggcgaggggtatggccaatcaaggagattgggtcccgtttatggatgtgttagctttgctaatttttggggtcgtcctctttccaaacgtggatggtttggtggacctagcagcaatcgacgctttccttgcctaccaccatagcaaggaaagtccggtggtagctgtcttggcagatctatttgacacatttgaccgaagaatagattgggaccagctcttggccgggataggaggtagaacaatcagttggttcccccgatggaaggaaggaaaagaaggagtccttttctcatgtggaagatacccaaacattccgctg

SEQ ID NO: 49910 - DNA, 885 bp, Glycine max
  Peptide Sequence Number=SeqID_141595
atgtctcctttccttgtgagggatttcggcgcacaaaattccaagactatacaaagaatccataaggcatgggaaaccccgttaaggaaagatcaagaacttagaggcattcgtaatggcatcattggtgggtaccacgaatggctgaaagttcatatacgaggtttagattggctcgccaagttaaaagtcgtcagcgaagagagttttgaagcaccggaagaggacgaagaagtccaagctctcaaaagcgagttaggaaaggcgaaatttgccaaggagaagttcaagttggccgcaacacacattcggaaggagtgtgccgggttacgggaggagaatgcaattaccgcaagagcccttgaacaagagaccaagagggctcgcaaggaagagtatggccggaacaaatttcgcggagctctatggggtagcaatagtgaactcaagttgcgaagggaagaaagagaccagtcgcgagcacatagcatggttctgaaagaggagttaattgcttgttcgaggtccaaaagaagcttgtctcagcgtttatgcgagacggagaccaacatgctagctatcatcgctaagtaccaagaagagttgggtctagccacggcccacgagcatagaatcgcggacgagtatgctcaagtgtacgcggaaaaagaggctagaggaagggtgatcgactctttactccaagaggcaccatgtggatggatcggtttgctataccttgaacgggagtcaagaactccccgattgttagccaagaccaaagcgatgtcagacactttctctgccccggaagagattcatgagcttctcgcctatagtcagcatatgatagacttaatggcccacataattagaaatcgttag

SEQ ID NO: 49911 - DNA, 720 bp, Glycine max
  Peptide Sequence Number=SeqID_141596
atgaagcgcgcgtctctcataactctattacttatcagttcgctcggtgcccttcattcggcccgcgcgatggactatccattgccgcccgcaggcagccgtctgattgggcaaaatcaaacctacacgatacaggaaggggataataaactgcagaccatcgcccgccggtttaatactgcggcgcaggtgctactggagacgaacaatactatgcgcccggtcaaccctgcgccgggcactgtcatcaccattccgtcgcagatgctgctgccggacacgccgcgcgaggggattgtggtgaaccttgccgagcttcgcctgtattacttcccgccgggggaaaatagtgttcaggtcttcccgctcggtatcgggcagttggggctggaaaccccggtcaccactacgcggagcccgctcgctggagcagggattaaattgcctcctgtggtccctgccgggccaaataaccccctggggcgctacgcactgcgtttaggcgtgggtaatggggaatatctcattcacggcaccagcgcgccggacagcgtcggcctgcgggtcagttccggctgtatgcggatgaatgctccggacattaaagccctgttcgagcaggtgcgggtgggcacgcgggtacagattatcaatgaacccgtgaagttctccgttgagccagatggtggagggggaaaacccgcaggtctcgccaattag

SEQ ID NO: 49912 - DNA, 222 bp, Glycine max
  Peptide Sequence Number=SeqID_141597
atgaccaagagcaagggcaaggatccacttgaaggacttggaggacctatgacaagggctagagcaaggaaatccaagaaagctcttcaacaagtgttgtccatactatttgaatacaagcccaagtttcaaggagaaaagtccaaggttgctaaaggcccaagtggagaagggcgaaagcccaagtggagaaggataaagccctcgagtggagaaggatga

SEQ ID NO: 49913 - DNA, 639 bp, Glycine max
  Peptide Sequence Number=SeqID_141598
atggagagaagtatgatagatgctgccagtggtggagcccttggagacatgactcctgctgaagccagaaatttaattgagaagatggcttctaactcccagcagtttagcgccagaaatgatgccatagtcattagaggagtgcgtgaggtagctacaaacccatctacatcatatgaaactaagaagcttgaaggcaaactggatgcgttggtcaacttggtaacccagctggccttgaatcagaaatctgtacctgtcgcaaggcaacctggagcaattgagcagcctgaagcttatgcagcaaatatatacaatagacctcctcaacctcagcagcaaaatcaaccacagcagagcaattatgacctttccagcaacagatacaaccctggatggaggaatcaccctaacctcagatggtccagccctcagcaacaacaacagcagcctgctccttccttccaaaatgcttttggcccaagcagaccatacattcctccaccaatccaacaacagcaacaaccccagaaacagccaacagttgaggcccctccacaaccttccctcgaagaacttgtgaggcaaatgactatgcagaacatgcagtttcagcaagagactagagcctccatttag

SEQ ID NO: 49914 - DNA, 432 bp, Glycine max
  Peptide Sequence Number=SeqID_141599
atgcccagcgaccgcaatgccaatctccccctacaaaagtatcagttggtctgtgtcgtcccgacgtggggatcgcacccacaaagacacccagtggacctgaagaagtccaacagggtcttgagttccagctcggtatacgggtctctgtcagttcctagggagtgcctgtcgcccccagcaagtttgtcatcaggtagaccccccccaatcgagctttcatcaagaagttctgcgtctccatggcaggcgcaggcccgcgaaacaccacagcagcctggggatggccggcagcgggcaacagacgcaccgccatcacctctagagttcacctctactcatccacaaaaaggtttgagtatagcctacaccacatggccgaccaataggcgaccaagtccaaagccaaaggacgcacctagttgctcatga

SEQ ID NO: 49915 - DNA, 425 bp, Glycine max
  Peptide Sequence Number=SeqID_141600
atgggaagaccaataagatttcttttgtacatgagggacataagatcaaacttgcaccactttcacctaaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49916 - DNA, 231 bp, Glycine max
  Peptide Sequence Number=SeqID_141601
atgttgattaatgttggaaatgcattggcatgtgcatgttgtgtatgttcgtgggggacactgtgcactgaccctccagggtctttggcactagcttttggccacgttcatacgttggatgttgtgggggctgtcacctggaagggaacacctttgggctcccaaactgatcacctatgggaggtgggctgttacgtgcacaaccgggtggtctcaacaaactcagcatag

SEQ ID NO: 49917 - DNA, 323 bp, Glycine max
  Peptide Sequence Number=SeqID_141602
atgaaagcaccccaaaatatccaaagctcataccagcccaatcccccaaattttttaatccgagccgggaattctctcccgactcaagtaaaaggaccacccgcagcagaaagagcgccgacccaacgcacggcttcagccgctccccggccagttaataatacagcccccgacgcaacctataaatatgcacagcacccgcccccgaaagataacttctcccctattcccatggcatactccgagttatggccttcattattggagaatcatttggtagtggccatacccgagaaggtcttccagccaccctaccccaagtg

SEQ ID NO: 49918 - DNA, 216 bp, Glycine max
  Peptide Sequence Number=SeqID_141603
atggaagtagggtggcctattggaggctcccaacttacttatgaaaagctttttgttacaaaatttgaaagcaatgaaattcttcttagtccaatagctcttaaggtggttttcccttgcttcttgactcaaattcttcaagggatggcaccaatcctcctttccaattccctatatggcaactcacaagcaaggaaacaaagagacaagcaataa

SEQ ID NO: 49919 - DNA, 270 bp, Glycine max
  Peptide Sequence Number=SeqID_141604
atggtgtttgatggttctggagtgagtaaggatatgatgtttatctctgccaaccaagttgtgacatctttaaaagaagatgctcaagtgtacatgatcatgtctaacctagagacaaagatttccatgtgtgacctccctgttgtcagagagtttcctgaagtgttccctgaggatatgatagccatgagcaagaggctccaagaggattgggctagagctgctgaagaaggccctagggttctcatgaacctcaaggtagatttttga

SEQ ID NO: 49920 - DNA, 270 bp, Glycine max
  Peptide Sequence Number=SeqID_141605
atggaggacctgttgcaacagatgatagatcgaggccggctggaagtcggcgatgaggggagtaaagaacagcatatatgtatgcagtccacagatgagggaagttttggaaggcctaaacctttggtgccacgcaattccgtggaggtatgcgcctccaagcgaaaggaaggaagaggccaccgacatcagcttgttgttggccaaggtaaccaatatcacggggctgagcggcgtgacccgcagcggtcgcgtgttcgcaccccctga

SEQ ID NO: 49921 - DNA, 839 bp, Glycine max
  Peptide Sequence Number=SeqID_141606
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgccacccgcgctgcccgcacaagtacctgcagatcaacgcctggtacgcgaggaaccccgcgttctgcattggccaagtcacgcaggagagcaacgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49922 - DNA, 534 bp, Glycine max
  Peptide Sequence Number=SeqID_141607
atgattacgccgcatcttaacgaacgcgaccgcgaacgctttaaaacagggctcgcccgggtatttatcgataattacgcggccattccatcggaatcgattcgccgcctgctggcgctgcgtgaggccggggtgattagtattttgccgctcggggccgattatcaactggaagttcaaccacaacggacggtcattcaccatcacaaccaacgcagcgaatttgacgtctttattgacgccagaggccaaaaggcgctgaagagtaaagacatccctttcccgacgctgcgccagcaacttctcgcctgcggtgatgagatcccggatatcggtgatgattacaccctgcaggcgccggcgtgcgctcgcggccgcattgccttcggcgcgctgccgtggttgatgcatgaccgccctttcgttcagggcctcgtcgccagcgcggaaatcggcgccgcgatggcgagatcggtttcacagcaggccagcggccgccggcgcatgctgtggttcagtcatgaagagtggtga

SEQ ID NO: 49923 - DNA, 228 bp, Glycine max
  Peptide Sequence Number=SeqID_141608
atggacacccgtctccgtgtgattggtgatcccatgaatggagttcaacggcagaggggggggtgcttagtaaaaatgggggtgcaaatagcacccaggcccatttgggccctccagaagattcctccagaaggcggttgcttctggaggaagcaaccctgctcgcctgggcgagctgagctcgcctgggcgagctgggcggcaaccacctcccctattttgctataa

SEQ ID NO: 49924 - DNA, 249 bp, Glycine max
  Peptide Sequence Number=SeqID_141609
atggctattgtcgcaacctacccttcggtgggagggcaacgcgggggctcacgggtgcgtcttccatgggaggaaaatgcgtggagtcgccaccaatgtttattcgaggaaaacgtcgaaaaaatcggaaagatgtggtctacgaacttcaagcgtgaaaggttcgggagttgtttttacgcatggggaagggtgtttccctcgctcctatatatcctcaattgccatgaggaaatcagacctacgtag

SEQ ID NO: 49925 - DNA, 851 bp, Glycine max
  Peptide Sequence Number=SeqID_141610
atggtgaaaggtgggaacctcttacgtgccgatcaacgtctcattttcgccaaaaagttggcccagggcttcccgctgtccctccctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcttggcttataagcttcagcctgccatcatattcattgatgaagtagacagttttttgggtcagcgtcgtacaacagatcacgaggctttgttaaacatgaaaactgaattcatggctctgtgggatggatttacaacagatcggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49926 - DNA, 624 bp, Glycine max
  Peptide Sequence Number=SeqID_141611
atgtcctcccctttagaggactacacgtcctcacctttagagggttgcacgccctcgccttcagagggctccacgccctcgtcttcagagggcttctcgccctcgcattcagagggctacgtgtcctcaccttcaaaggtttacacgccctcgcctttagaggactatacgtcctcaccctcaagaggactacacgtccttgctttcagaggactacatgtcctcgcctttagagggctacacgccctcaccttcagagagctacacgccttcaccttcaaaggactacacgtcctcaccttcaaaggactacacgttctcaccttcagagggcttctcacccacgccttcagaggactacacgtcctcaccttcagaggggtacacgctctcaccttcagagggctgcacgccctcaccgttagaggactacacgtcctcgctttcagaggactgcatgtcctctcctttaaaggtctgcacaacctcgcttttagagggttgcacgccctcgctttcagagggctacatgccttcacctttagagggctacgcgtcctcactttcagtgggctccacatctgcaccttaagagaattaaagtcttctgcccttaatgcttaa

SEQ ID NO: 49927 - DNA, 210 bp, Glycine max
  Peptide Sequence Number=SeqID_141612
atgacagtagacacgcgaccggtgttctactatggaaaaaaggtgggttacacaccttcaagttttacagatttggtcttctccagcaaaaagatcgaagtggatccgaaaaaaggcaaatttgatcatcctactaggacgactgagaaaactggggcaaataaagagggtgaggatgagggagaaacccatgctgtgactgccatccct

SEQ ID NO: 49928 - DNA, 459 bp, Glycine max
  Peptide Sequence Number=SeqID_141613
atggatgatctaacagttgctttcccgggggctaggagggcgagggtgaggccagttgatattccatctacttttgcaactccatcacctactccaacatctacttttgcagctccttcagtcccagctcatatggtatcttctccagaatccatcctatcagtggatcagttcttagagaaggtagcttggcttggggcccatccttctcttgatagggaaggtggaggtcccacagcccaggtagcccaacaggtacaggatgcttcatttgagaccaccattccagagccattcactcttcatcatgaggtaggtgaagaacagcttgtagctgacccttccactcctttacttgacataccagagaaccagaccacaccagtcctggcactgaacacctctcctccagctactccagtacttcacttgacagatgaggaggatgctcagacttag

SEQ ID NO: 49929 - DNA, 382 bp, Glycine max
  Peptide Sequence Number=SeqID_141614
atgactagaggcaatccatctgacttacaaccctttgatcctgagatagataggacatttcatagattagttaggcatcattttataccttttgatcattctgagcattccattactggtgaatctgtgcattctgttattggtgattttgaacatcctgatcttgagcactataattttgagcattctgattctgagcattctgattttgcacattctgagaacatgacacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcag

SEQ ID NO: 49930 - DNA, 821 bp, Glycine max
  Peptide Sequence Number=SeqID_141615
atggtgaaagttggaacctcttacgtgccgatcaacgtctcattttcgccaaaagttggcccagggcttcccggtatcaacagggacaccaggatttatttattctgcgaagtgatcttccgtcacagtgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcccacggtttgcaagccctgggcgtgacccgtcctgaggcgctgcaacaacacgtgcaccaaagtcgctcaaaactgaccttcgcccagacttttcccaccggcacccacgccatgtggctgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49931 - DNA, 912 bp, Glycine max
  Peptide Sequence Number=SeqID_141616
ggagttctcttctcatgtgggggctacccaaacatcccgctgataggaacgaggggttgcattaactacaatcccgcacttgctataagacagttagggtaccctatgaggggagcaccgacggaagaaagcttgtctcctttccttgtgagagattttggtgcacaaaatttcaaggttatacaaagagtccataaggcgtgggaaagcccgttaaggaaagataaagaacttaggggcattcgtaatggcatcattggtggttatcatgaatggctgaaagttcgtacacaaggtttagattggctctctaagttaaagattatcaacgaagagaacttcgaagcttcggaagaggatgaagaagtccgagttctgaaaaccgaactaggaaaagcgagacttgccaaagaaaaattcaagttggtcgctacagacgtccggaaagagtgtgccgggttacgagaagaaaatgcagctaccacaaaagcccttgaacaagaaaccaagagggctcgcaaggaagagcatggccgtgacaaattccgtggagctttgtggggcagcgacagtgagctcaagcttcgaagggaagagagagaccaatcacgagcacatagcatgaccaacatgttagccatcgacagcaagtaccaagaagaactaaatctagccacgacccatgagcacaaagtggcggacgagtatgcccaagtgtacgcagaaaagaaggctagaggaagggtgatcgacgcgttacatcaagaggcaacaatgttgatggaccaatttgctcttaccttgaatgggagtcaagagcttccccgattgctagccaaggccaaagcaatggcggacacctactctgccccgaggagatccacggacttctcagctattgtcagcatatga

SEQ ID NO: 49932 - DNA, 222 bp, Glycine max
  Peptide Sequence Number=SeqID_141617
atgtcacatcctatcagagcattgtgtcccgacgcccttcagcacataggttccttaaagtcactctcactaagtaagatcatagggagaccagtcaaggtcacgatattttgcgagaatgctccaaccatatgggatcagcataggcttaaagtggtggtcgacggcgatgataaccaaggcctacactccgaagagttctccagggcctctccctcctga

SEQ ID NO: 49933 - DNA, 121 bp, Glycine max
  Peptide Sequence Number=SeqID_141618
tcacggaagcgcaggcgactttgacataaggagaaagaagaagaacgatatggttcaagcacaaggagaaagaagaagaatgatagggttcaagcgcaaggagaaagaagaagaacgatag

SEQ ID NO: 49934 - DNA, 954 bp, Glycine max
  Peptide Sequence Number=SeqID_141619
atggctcctcagagtgcaatacatcaactatattacactgccctacccctcctagccgtaggatatgccggacgtgcagcttcataccaaagatcattggagtcacgaattaatagacaaatcacatacgaagagctgtgggagaacatctataagggactaaagattatggctcatctagcttgttccaaaaagtcctatgccctcacaaggaatgctaatgagctttacgatgaaaatgtttatcccactatgcctcgtcatactaatagcctcggggttgccatcatcatagttcccaacttaaccccgaaagaacaaaaacttgacaggtggaaactctgcagtgttattgaagtacaagaagctgagatcttttttctcaagataccattgcggttaaactttgcaatgtgtggcgttgttacttccatggaaggcacttactttgcaatgctcaacaagagcaactatgacaattggagcatcaagatgaagactctccttagcgtgcaaggtgtttgggagatagtagagaaaggattagatgattatgcttttgagagggtttatcaaaagcaaagtcggcgaaagaagtgtgagagaagcttcaaaccttgtataagggagctgattcagtcaagaaagtacatcttaagagtcaccaatcaacttaagagaaatggtgaaaagtttgatgatgtaaaaattatggaggaaatcctcagcaacttttgggctcattacaaggttatgaagaaaagaaaagaagaaggaagggatcatgaagcaactaatcaagacacaaccaacgaggacgaggtcatggtggacatcgcacaagaggatgaggtcatggacaaggacaaggttggaggcctaatgatgacaactacaacttccaaagaggaggaagctcaacaagagactgtgggcaaggcaactcaagattga

SEQ ID NO: 49935 - DNA, 408 bp, Glycine max
  Peptide Sequence Number=SeqID_141620
atggttcagcccactaatccaagatcaagtccaagattctccactaagattgcatcaggaagtctggtgtacctactgcaacaagccacaccacacaagggagaaatgctggaaattacatggaaaacccctaagttgagaataggggcagaaaggagcaaagaggttgttcggctaaattatgaagagatagaaagggtaagatccttccttagtaaactggagaagcctactagtacgtgctccttaacatattctgatacaccatttacccactactggatattagattctggagccatagaccacatgacccctctacccaaatacttctccatatattctccatgtcttagcaacaagaaaatttccatagtagatggaacccttataactgcagcaagataa

SEQ ID NO: 49936 - DNA, 192 bp, Glycine max
  Peptide Sequence Number=SeqID_141621
atggtgatgtcgatagcaccaacgacaacaatggtgatcacggtttcattgttctatgatagtgataatgatggtttcggtaatactattggtggtggttgtaatgccaatgccaatggtaatggctattgtagtggtagcagtgataatgatggttattattgtaatgtcaatttgaacataactcaataa

SEQ ID NO: 49937 - DNA, 585 bp, Glycine max
  Peptide Sequence Number=SeqID_141622
atggctcaaaccaaacatgctttatacgtggatggatgcgatccttttcatgagggcctcgacctctcacatgaaagggatgatgctggagagaggcatcaaaggcttattgcatcaacacacgacagacaacatccaccgacagagaggaggtccaatgatttgttattggttcaatattacaaggaccattgtgtcggtcatgtatggatttggcaactgcgactagagatgaagttggtcagccacggtggccaggtcttaccattccccattgagccaacgaggtggcacaaagagatctcatccttccacttgcctatcgaagagatgaccatcactctgaatgatgtgttatgtctcctgcatctgcctatgacaggcagactcattgatcatgtcccctccaccttcaatagaaacaccgtgaagattttgcttatgactcaccttggcattaattcaaaggaagaggctatagcggcgaccatcgcaagtgtcggggttaggttgctacctgtgcagaagcttagaatcgtaaacattgtatcatgcacccactacgattgcatgcaagtgcaatga

SEQ ID NO: 49938 - DNA, 615 bp, Glycine max
  Peptide Sequence Number=SeqID_141623
atgaatgtagactgtgaactagcacactatgtaccaacgtgtatcacaatggaacaatatcaaaacctattggctttgatatcattgttgggtactagggctaatggtggtgttgaaggtcacgacactttgcccatgcaagggccttctttgtttggtttttgggacaggctaacggcggttctgaaggctaacgacggttctgaaggtgacagtgttttgccatgcaagggccttctttgtttgatttttttcgctttggttttaatattgctttggacgggaaaaaggttaacggcggtgctgaaggctaacagcagtgctgaaggtgacgacgctttgccatggaaggactttctttgttcgatttttttcgccttggttttaatattgctttggacgggaaagagtgacttttgggacaggctaacggcggtgttgaaggctaaccgcggtgctgaaggcgacgacactttgctggatttgttctttatttctaagaatatttgtgatttttttcctaggaaactcctcttttctggaagactaaaggagggtgaagctgcatctgagaaggtgaccaacaattaccatgttctgagacaaatagagtga

SEQ ID NO: 49939 - DNA, 225 bp, Glycine max
  Peptide Sequence Number=SeqID_141624
atgaatttcaggagcttggaggagttctgggccttttacgtgaaccagcattcgaagccttccacgaggagtcatttctttgtggaggggaatgttccagccacttttggacaccccttttggtcactcttgtgtgatctcaagatgtttgggttgatgcttactgggaaaatggatagagagatcaagaggcttggcaaaagacctgtgctgcaagtgttctga

SEQ ID NO: 49940 - DNA, 1002 bp, Glycine max
  Peptide Sequence Number=SeqID_141625
atggctgagaagacccaccacttcacattacttgatggggagatgattatcgatacattgccagattcaaaaaagcaggaaaggagatacctcatatatgatctgatggcagtcaatggagtatcagtaatagagcgaccattttatgaacggtggaagatgcttgagaaagaagtgattgaacccaggaatcaggaacggttccagagcagaaatccttactatagatatgacatggagccattccgggtgaggagaaaagatttttggttgctctctactgtcacaaagcttttaagcgaattcataccaaaactctcacatgatgcagatggtctcatatttcagggttgggacgatccttacatacctcgcactcatgaaggcctcttaaagtggaaatatgctgatctaaattcagttgattttctctttgaggtgattgataacgattgtcagctgctttttctgtatgaacgtggaaaaaagaaactcatggaagggtacagggttgcatttgaagaaggttcgaatcccttgcattattctggaaagatcattgagtgttcttgggattctgatagacaggaatggatattcaagcgaatcagaacagataaatcaactccaaatgactttaatacttatagaaaggtgatgcgaagtataagagacaatatcacagaggatatcctgttgaatgaaataagtgagataattcgccttcccatgtatgcagacaggataagaattgatagcaaagccaatcaccacaccaacatgtcacggcgaagtccctcacctacgaccaatcttcctcgtcctcatccaccggatcgaccggattggataaacgaattaaccgtgttatgggttgctggttttgaaatttgcggcaatgacgctgattttggttgttggttttgggagaattgcgttggtggaaaaatcatggcagtttatgcgacccaacgggaacgtgttcatggggcgaaggcgtaa

SEQ ID NO: 49941 - DNA, 933 bp, Glycine max
  Peptide Sequence Number=SeqID_141626
atgatagttgctgtggatttgaatgcctcacctgtgccagaggacgatcaagatgattttggggaccaggttgaagagtaccatgctccagaagagcgtgtggaatctgcagttgatattgctcgccgggaacgtgaagaaagaaaaagaaagttgaaaagagaacgttcagatgacaaacctgtgcaagtatcacagtcacctggacatgatcagttatttcatactaagatccttaaatcatatgatagaagtaagcttcctccaggttggttggattgcccttcatttggccaggaaatttattgcatgataccatcgaaggttccacttggtgaatcattcaatgactacatcattcctggtaaaagatactcatttaaacaagtgatacatcaacagagagttttagggagaaagcttggtctggtaattgatttgacgaatacttctcgatactatccagtagcagatttaaagaaagagggtatcaagcatgttaagattcaatgcaagggccgcaattctgtacctgataatttatctgttaatcattttgtctatgaggttacacaatttctatttcgtcaaaaacactcgaggaagtatatacttgttcattgtacacatggtcataatcggacaggatacatgatcatccattatctgatgcgcacaatgtcaatgtctgttactcaggcaataaaaatattttctgatgtacgccctccgggaatctataaacctgagtacattgatgcattatatgcattttatcatgaaaaaaagcctgaaatgatagtttgtcctcctacccccaagtggaagagaactcctgagcttgttgatctcaatggtgaagcaatgccagatgatgacgatgatgatggagtgccaggctctcctttgcatgtatggataatattgaagtga

SEQ ID NO: 49942 - DNA, 3228 bp, Glycine max
  Peptide Sequence Number=SeqID_141627
atggctgcttcttctgcatctctttctggtgcttctgcttcggatcttctgaggagttcaaccagcggtttcaatggtgttcctttgagaaccttggggaagggaaagttggttttgaagaggagggactttacagttgctgctaagctgaggaaggtgaagaagcatgaatatccttggcctgctaaccctgatcccaatgtgaaaggtggggtgctgagccacctttccttgttcaagccactcaaggagaagccaaagcctgtcactttggattttgaaaagcctcttgttgatctgcaaaagaagatcattgatgtacagaagatggcgaacgaaactggactggacttcagtgatcagattctctcattggagaacaagtaccagcaggctttaaaggatctgtatacgcatctgactcctattcagcgggtcaacatcgcacggcaccctaacaggccaactttccttgatcatgtctttaacataactgaaaagtttgttgaactccatggtgatcgggcaggttatgatgatcctgctattgttactggtctagggactatagatggtagaagctacatgttcatcggtcaccaaaagggtagaaatactaaagaaaacattcagcgtaactttgggatgccaactcctcatgggaaggcccttcgcttgatggaatatgcagatcatcatgggttccccatagttactttcattgacacgcctggggcatatgctgaccttaaatcagaggaactaggacagggtgaagcgattgctcacaatttgagatccatgtttggtctgaaggtgccagttatatctatagttattggagaaggtggttcgggtggtgccctagccattggatgtgctaataaattactcatgcttgaaaatgctgttttttatgttgccagcgatggttcttatggggtggaaattcagaccaaaggaaaattgcttggtaaaattgggagacaatttgtcttccagatgagaaaggttttggattccaaacacgagagctggagaagtctggatgaatccagatcaaatacctctgattcaatctgggggtgggatttaagacatgtctgtaatgcttctggggaggggagatttttcagaggtgttatagaatggaaaattggctgtggagcaatggttaaactgtgggaagatggttggctaactggtggaaaatcgctagcagacaaatatcctcgtctatatagtatatctcagcagcaacagaattcaattcagcagatggggatagcatcagcaggaggatgggaatggcacctagagtggagaaggctttttagagaagtggaggtggacagagttgcaaaattcatggaggatattcagattgtgacagtgcaggttgatcagcgggataggagggggtggaggctagatccttgtggggattacactgtgggcagtgcttacaaagttccagaggcatgtgcagcaatcttgtggaagaccgccaaagcttctccaaaggctgctgagaaattgaagattactgccactgaattgtgcaaattacaaattgcagacggtgttatacctgagccacttggtggtgcacatgcagatccagagtggacctctcaacagataaaaaaggctatcaaagaaaccatggatgaactcacgaagatgaacacagaagaactgttaaaacatcgcatgcttaagttcagaaagattggtggattccaggaaggtattcctatagatcccaagagaaaagccaacatgaagaagagggatctatctattgctaagattcctgatgctgaactagaagttgaggttgagaaactgaagcaacaggttttggaagctaaggaatcttctcctgttcctccaaaactagatctggatgagatgctaaagcaactggcaagggaggtcggtctagaatactctgaggcagttaaagccacgggcttgacagacagtttgctgaaactaagggaggaagtttcaaaagcaaatgcagatagtcaaattgttgatccattgctgaaggataagatagaaaagctaagggtggagtttgaacagcaattgcgtgcagctcccaattatggtaggctgcagaataagtttaagtatctgagcgaattatgtaaagtaaagcttctttcagatgcaaacaaggacaatcaggctgtcacctttaagcaagagttggagaaaaaagttgataatgccttgagtgatccaaaaataagggaaacatttgaagcattaaaggctgaaattaaaggtgctggtgcatcctcggcaagtgatttggatgacgagttgaagaagaaaatcgttgggtttatgatagaactaaaagaagtaaaagaagtaaaagaagtaatagaaaatcaaattgaaagtttggtaaactcatcggatgatattaagagcaagatactgcaattgaaattggagcttcctaaggctggagagacgcctgattcagaatcaaataatagaattggtcgtttgtttgtgattgaaaattttcaatgtcttgttaagatggacgaagatcaatggatgtatgataatataatgtctgaaaaagtttatatgaataaacaaaatgaagatgaagttggtgtgaatgaagaacatgttgattgttttgatgcgttcaatacttttcaagtgtttgctactcgagatgatgttctacattgggctcgatctgttgcttatgaaattggatttgtggcagtgattatgaggagtggtcagtataggtctacgaaaaaagattttgtaaaaatagatgctgacaataggaaatgtggatgttcctttaagcttcgtgagaaaccagtggttggaggccaagggttatctgaattcgaggttagcataacagaagagatggaaaccatatccaagcggtttgaagaacttgatgccaattccaaatgtgctcagaagaaaccaatgaccaaacatcaaagatcaacaaagcgtgatccgtcttattgggaatatgttgatgctttaaattttgtgcaaaatagtaattctttagtcaaacgtaatacatcatcatctgaccaagcaattccaagaaggactatgccgatattggatttcattcgtgcattcatgattccattgaaaacattatcgatgtcaaagctaacggtaactgtggatatcgtgcaattgttgtcttattag

SEQ ID NO: 49943 - DNA, 738 bp, Glycine max
  Peptide Sequence Number=SeqID_141628
tgctggatttacgagcactttccctcagttgcggagtccaccgctgatcaggactacgacgaggcttctccgcgtgcgtgcagggagcgcctggaccgactccggattttggatgtctgttggatcccatatggggagcatcgggaggtccgagacttccacgtcagatcatgctactccggtctcttgcgttgggggcctgttgctgtgtattaccgaccggagagggtcgtgcgacagtttggttacacgcagaccattcctactcctcctgtcgattcatgggtctcgtatgatgatatacatgacaggtggatgcactacaaggatcatatcgtacctgcaggtgaggtgtgcgtggtgccaggggcgtgttccagtgactacatcgactggttcttccgcatctcccatcctttcatgacaccaggccacgcagtggatcctctacctcatggtcacgccccgcagccccgagttgtccctcaggccccgcagacggatatccctcacgtgtcggagccaggagcatcatcgacatctacggaggagcccagacatgaagtttgtgatgatattgctgagcggttggagcaccatctgagtctaggggtgctcacgcctggctcatcgacacatgaggtgatcgaagaatgcctcagattggccaggagtgtcacacaggaccatctagtatacgttaggtgtagacgcaggcggcgcactgatcaggcttag

SEQ ID NO: 49944 - DNA, 360 bp, Glycine max
  Peptide Sequence Number=SeqID_141629
atgaaggtcacaaagaatggtatcattatcagagatctacgctggggtagtgcttttaacattgtttggctagatttggtgataggtggtgatggtcgaggaattgtgcatggcggtgcggagggcaggttgtcatgcacaggacggtgggtgttggcacgtagtgaggggttggaaggtgtggtggttcgaagagagatggcggttgttggtggctatggtggcggttgttggtggctatggtgtttagggcaaaggagaagattgagggagaagattatgtgttgtgttgttaaaggcaactctaacaatgcgtttgttgtaaataatcaaaaaataattaatgacgtgaaaaagtaa

SEQ ID NO: 49945 - DNA, 519 bp, Glycine max
  Peptide Sequence Number=SeqID_141630
atggtgcaaggccaattgcatagtgcagttgatgaaaggttgaaggctaaagggggatacatcatagaggaagaccctagtattagaccaacaatgaggcaggttgtgaaaattttggaggtggaaattgacagcattgagtctgatgaagataacatggaaatgagtttgcttggaaaaataagatcagctactacgtggtctagagctgaatgtgctttaccatacagtggttacccttcttttgatgaagttaagatgttcagttttaattctaggactactagaagtggctcaaacacaactaaacatgaagacagtaaatctgaagctcaaattaaacatcatgggtttcatcaagttcagtgtactaacttagaccaaacgctcaacgaaactgataatgtggcacaggatgacacaccactgatgaaggatggtagcaggctgttcccgaaagtcattcactcactgcccgcaagtcagcttcatcaacgagccccacataaaccccactga

SEQ ID NO: 49946 - DNA, 609 bp, Glycine max
  Peptide Sequence Number=SeqID_141631
atgacgacaccccctccatctcccacacagtccgagattccttctgatgggacgtctaggaaaactagacaagccactcggctaagaaggttgacagcaagaacattggagcaagcaagggcaacagtcagtgtgaatccagcgactggtagaggatccggacctcacaaggatcagtttcacagttaccttggagttgtggcacgagacaagattccaattgttcacgctagctggaatgatgtacctgaaacactgaagaacatgatatgggatgacatattggcaaaattcgacatccccgagggtgataatgccaaaaagaaggtgatgtcaactgtggcaacgcgttggaggcaatttaagtcggcgttgacaactaaatatgtgtatggtaacactgacggccaagcaaaagatgatcctttggttaaatatggcattaatgaaaaagattggcccgagtttgcaaaaatgaggcaaacccctacctggcagttgacaaatgcttattttttgatttcaaggggatacggaaaaaggcacaagaaattcaaaagtacaatgactctccgcacctgttgtctaggggaggctatgagctgctag

SEQ ID NO: 49947 - DNA, 141 bp, Glycine max
  Peptide Sequence Number=SeqID_141632
agtcatgttaaaacaggaaattacgagtgtggatactatgttatgcaatggatatggtgcatcgtaagtggtggattgaaggatgactggattcacggtggtgctgacaaggactacaaggagtgttatgaatgtggctga

SEQ ID NO: 49948 - DNA, 462 bp, Glycine max
  Peptide Sequence Number=SeqID_141633
atgaaaaagggggcacttggtgctgttgtacccccaatgctctttgaggcctatagaagctcttgtgtcgatgaagaggacgttccaccaaatgccatcgttgaagttggggatgccactccaaatgacatcgttgaagctgaggacgttgcagcaaatggcatcgctgaagcagtagacgctcctttgaacatagtcgtggatgttgttgtggccattgaggaagctacgacaaacaatgtcataggagttgagggcgctgcgccaaacaacgttgtcatggtagagggcgttccaccaaaaggcgacacggcagaggacactactacccaaaacgatgtcgtcattgtggaagaggaagaaacactaaacgacgctactgtaacactgaaaattgaagaaccagtgcgggaaaggaagaagaggccaatgagaaggaaggtgcgaaggaagaagaagtga

SEQ ID NO: 49949 - DNA, 651 bp, Glycine max
  Peptide Sequence Number=SeqID_141634
atgaataagcctgggctaagcgagtttgtattgctaagcccaaggcgcgctaagcgagtctgtctcgctaagcacccaatggcctctaggaaaaggaaatcaaccgcctcccgacctcaggaaccgtacgacactaccagattcatctctgaggtcacttgggaacactacgagcagaatgttcactcccgaaacatccttccggagaggaacgttaatttatttgtgacagagtatgatgagttccaccgggaactcgagaggaggtggtggtataaagccttgaccaggcagcctgatggttgcattgacgtggccctggtgatggtcacctggggaggtcaagtggttctggagccaggggagcactacactgcatacaccaggttttgccacacgcacccagaccctcaggagcttgcttccaagctttgtattccagggcagggctttgttcttaacgttgaaggagcaccttggaagctcctgaggaaggatctcaccatgctggcgccaacctggagtgtcctctcttactttaacctcgcccccacttctcacatgtctgatttgataatggacagggcgaggctagtctacagactcgtcacgaagatggacatggacgtgggctcgttcatctctggatag

SEQ ID NO: 49950 - DNA, 459 bp, Glycine max
  Peptide Sequence Number=SeqID_141635
atgtgtcctggttgccgtacacggagcatcggggggttagggcgtttcaggagatttcatcttccagggtcagctcagatgggtcctatggtcgtcacggttcgaccggagagggtggtatctgcggattacatggagtggtttttccgcatatctcacccattcatgacaccgacccaggcaggtgaccagcatagggatgcaccagctgtagaccctgaggactacatacagccgcccagcccccatgttccagtggcatttgacccccctccatatgatgattacgagggatatgaggcgattgcacagaagttggagtgtgtgctcaaccttaggatagtcactgcaggcacagagttatatgacattatgcaggactgtctgacgatcgcgagagggggacccagtgctgatgggacggtcagggctcgtcagagacgccgcacggaccattga

SEQ ID NO: 49951 - DNA, 300 bp, Glycine max
  Peptide Sequence Number=SeqID_141636
atggttgattccacgcgttctaaatctcatttagatcgtctagaagaggccattgccaagttgactatgaatcatctctcgctaacagctactccaaactccatgactcttaagctcgttgagcttttgcagaaaatggtgactcttgaatctcatccttcatctctgacatcatcaatggatcctccttcgctccaccctcctcagttgaaattggaagttccccttttcgaagacactgacaccttaggctggatcttcaatattacacaattctttgactatcactccacctcatag

SEQ ID NO: 49952 - DNA, 648 bp, Glycine max
  Peptide Sequence Number=SeqID_141637
atgagggaaaataacgcttgccttctagacgatccaagtgtgtggaagactgtaattgctgaagggcttactcggagcatagttattgatgaagtgaaacaaaatgatggagcaataattctcttcattgatgagcttcatactctaataggaacttgtgcttcttcaagaggagctcttgatgtagctaatatattaaaatcagctcttacaagaggagaactcaaggccattgaaatattgaaagggttaatcatgaaatatgaagagtttcatggcgttcggtatgaatatgatgtgttagttgcaacaactagtttgtcaaaacagtacataagtgatgtctttcttcttaataaggcaatagatgtaattgatgaagctagttcaagagttcagctaacccaaatgcagaattcacctaagaaagaatattatggctctaaggaagctatggcgaggtttgacatgagtgagtacatggagaaccacacagtttcaaagcttattggagcactaccaataggctatattggttatgagaatggtggccagctaactgaagttgttctttgtcgcccgccttctttatttctctttgacgaggttgaaaaggctcatgaagatgttttcaaagtgtttctttag

SEQ ID NO: 49953 - DNA, 1239 bp, Glycine max
  Peptide Sequence Number=SeqID_141638
atggctacagatgagcaggtacacaaagtttccctaaaagttttggtggacaaagagaaaaacaaagttatatttgcggaagcagggaaggattttgtggacgctttgttgagtatcttaacattgcctttggggactattgctagactcgtggctaaggagtcaaacattccaccagtgaaatttggcagcctcagctcattgtatgaaagtgtgtctcatcttgaagataagtatctacggacacaaacgtgcaaagaaatgctactgcagccaaggaactctatggaatcttattgcaagcacgtgaaactgaacatcgatgacaccgaacccacaaagtactttctttgtgcaaacctgaattgtagtattgtaagtgggagacaattgtccattttcagatatcaaagatgccgttgtggaaatctaatgaacagagaagtatttccaatagaagtgattccaggaaatggttttgttaatgaaatcgcaacttttataatttgtgacgatctttctgtgttgcccaatgttgttggaacaagtgtaagtcttcttaggaagcttggaatcaaagacatggctaccattgacgaacgaaatgtagatatcagtaagagggaggttgttgatatccttaagttgtctttgctatcaaagacacccttaacagattttatcctagagaagaaagatgataatttcaacccaataaaccaaccccagattgggataggagagaaatcatcttatgaaagtagaaagatggatgtgaaagtactggaactcaaagacaaactagctaatccccagtgtgctccacaattcaacttacacgaccagatattaccaattggcgccgtgtgcttgccattgtattattatgtaaccgttgagtcgtgtgtgtgtcttactacttcacctaacagttggcaatttgcgattgttgatccaaagtcctgtattgggggttcatctagcaatggaggatttgccaaagcacaatcaatgtttttggtgacagatgacttggttatgacaccaatgtcgtccatttcttgtatttcatttctaaatagatcaaaagtctccccgcttgacctggaggaaagggttgttaaaattggtgtgaaggaggcactagctatcttgaaagcttccttgacctcaacatctgctttgacaaacggtctcaagcaattcatcaaaaaagcatcaattaagagggagatttga

SEQ ID NO: 49954 - DNA, 822 bp, Glycine max
  Peptide Sequence Number=SeqID_141639
atggacaacaatcaaggccaccaaactaccccatccaacgtgcctttcctcgatacagcacagctgatcaacgttgcagtgaaggaccaggctactaagcactcaactattcttatgaagatgaaggaaatcatagaggcgtatccagaaaccaccataaggaatgtggttgtccttgtgcctatttacttcaacgacccacaacgtcaaaccaccaaggattttagtgtcaattctgggctcaacgtgatgcaaactatccacctgtctaccacggctgccattgtttatgggctcgaaaagaagggcattagttatgctgagaagaacattttcattttttatatcggtggtgggattcatggtttgacatccctctttgctctgtgtagcagaaatttagatgttggtgtagctgctgggtttgtttctttgctatgtggcataggccacaaccccaccctctcaaccttcacgtgttgcaaaccctcgagctgttgctatttcccttctacctctatgacactggatgatgatgaagaagcaatgttgaaactgtgctgcaagagatcaaatttgaaagatggttatacaatacttgatttgggatgtggttggggatcgctggttttgtacattgccaagaagtacactaactgcaaggttacaggaagcagctactcgactactcaaaagacttatattgaggagaagtgtcaggatcttcagctgcaaaatttgaatattatagttgctgatattggcatatttgaaatggaggcttcactattagaaaatacactttcgacatcggttatttag

SEQ ID NO: 49955 - DNA, 300 bp, Glycine max
  Peptide Sequence Number=SeqID_141640
atgtggaggctagtgaaagagtgtttcatgtttccgaagactacaaaagttgtcctcaaggcacatccacaagaaaagaatttctctgatatcactaatgtttttgaacaactgaaatttttaattgctggggctattgctctgaagggccttggaggggttcttctcatatttggcagctcttttggagctttgcttctgaacatggctcttttcggggctttattgtttttcattggcatgaaaaactctatccctagaagggtacccaagaaggctccaaagacaaaaacctattag

SEQ ID NO: 49956 - DNA, 1836 bp, Glycine max
  Peptide Sequence Number=SeqID_141641
atggaggatttggaagacgaggcaatgatggtccacgcagagttggagggtgacgaggagctaggaatcgacttgggagggggaggaagtgacgagggtttggatggtgacttggtagagtctatagtggcgacgatcatcccacctgctccttgtgatccactgtggcttctcaaccgccacgcccaacacgtggcgggccaacgtcgccagcccggcctggctcacgtcaggcttctcggcgtcggcgcggatcccgacaccgaagaaggtgatgttagggttagccaggaaggaaatgagagcggctgggatggagggcgcgtggatgatctggaagatgaggcagcggtgaccggtgcagagttggagggtggcgacggggttgggctgcgtgttgggctgataattgggccgccactcgacatccaggcccaccatgaggttgttgcggcggcggacgccgtcgttgttggggagccaagaggcgactcgggaggggtcggaggtgaggagggtgtggattattgtgtcgtagtggcagcactggaaggtgacttcgtagaggttgtagttgtgggtgtggaaggggaggttgtggtccaccacgctcatcgtgaccactggattaagcattcggatgctaagaaagaaatcacaaaattacgaaatcaaaatgcgtcgtccaatctcactggagacaaaggcatcaatagtcgcgtactgaacctgttcatgagtgaggaagcgattgtcccagaggctcgtggtgatgtggtggggcttgttaatgtcgacgcccaggaagaagcggcccaatgcggcgagcccggccgagcccagccaaaacaccttgagcttctgctcggcgagggagcgaaggtcgacggcattggccacgtggagattgtagtctctcagaagcttctgggcgtcgtctcggacgccgaccccaacgaatttgacgtggcggttggcgaggaaggaggtgagggcgcgtgggacaagggtcgcgtggaggatctgaaagatgaggcagttgtggtcgatgcagagctggagggtggcgacggggttgggctgctgactgttggactgggtgttgggccgccactcaacgtccaggcccacgatcttgaggttgtcgtgggtgttgcgggtgttggtggagagccagataccgacttggcagggagaagtggttacgagggtttggatggtgtgggtgcccattttcacttcgtagcttttgtagttgttgttgccgatgccgttttctcttatcagtcatggagaaaccgtatttctactgagcctgtggaatttgggattttgatcgagtgtggtgcgaccaaccccacaggagacaaaggcatcaacagcagcatactcaacctgctcctcagtgagggagcgattatcccaacgactcgtggtgatatagcggggcgtgctaacctcaaagcccagggtgcacagacccaacgtgtcgagcccggcccaatacagctcaggcacgttgagctcctccgcggcaagggagcgaaggtcgcgaacattggccacgcggagattgtagtcttgaaaaagcttgtccacgtgaccatggatgccgaccccgacgaatgtgacgttggggctggcgaggaaggagatgagggcgcgtgggacggagggcgcgtggaggatctggaagatgaggcagcggtggtccacgcagaggtggagggtggccacggggttgttcatgttgggcagggtgttgggccgccactgcgcgatgaggcccacgatgaggcccggatggtagcgggtggtgttggtggagagccatga

SEQ ID NO: 49957 - DNA, 450 bp, Glycine max
  Peptide Sequence Number=SeqID_141642
atgtttccccttacaaagattcaaaggtctaaccgcctgagaattctttgtcttaacatattggaggatacatcctttgtggtacaagtagagggtacatctacttgggttgttgtaactgagaacaagaaagggtatatctcttgtggatcagttcaagtggagggtacatccacttggttgttcaaagagaacaagggagggtacatcccttatggatctttgcttgtaaaggattttacaaggttgaaagaaatctcaagaaccggtggttgcttgaggactggatgtaggcacgggttgttgtcgaaccagtcattcacttttaggaaaatcttggatgaagtagagatacgagaattgctcattgatcatgttggtcatcgttgttgttggggtttccatcctgctcaaacatggaggattcatcaagtggaagcctataattga

SEQ ID NO: 49958 - DNA, 273 bp, Glycine max
  Peptide Sequence Number=SeqID_141643
atggcggcaccaccatcgcgccacactccctcttcttttcttcatcgcgacaccaccatggcggcaccaccatcgcgccatgcaccaccatcgcgattcgatttcaccacacagacacgctccagtggacagtttctttacgaaaccgtttcttcaactgaaggaaccaggtgtggcagcattgttggtttggaggtgaaggggattagtgaattgggttttatgattggtaaagataaagataaaacagcaaagagaaaaaaaaggtgttaa

SEQ ID NO: 49959 - DNA, 273 bp, Glycine max
  Peptide Sequence Number=SeqID_141644
atgacgggtgagatccacgacaacaacgatggaggagatccaatcacgacggtgacagtcgtgggtgctcaaagctcaaagttttctacgctgccagttaacaagttgattgtgctttacgtggttttcaagcttgacgagagttacatgccgagcaaagtttccatccttgccgatgatggttttcacaacttgaaggagattaagaccgtggaactcgtgaagccaactgggtgggtttatctatccttgtatggagctgatcctaggtaa

SEQ ID NO: 49960 - DNA, 645 bp, Glycine max
  Peptide Sequence Number=SeqID_141645
atggcaggagctggtgatggtggtggtgattatcatcagctggacggatctcagcgtttattattggacgtaatgattatagagatgcaacgattgttgaaccgtaataatgaagagctctatggaaaaatagaagagatgaagattgagcatgtattctcctgcaatgattatactgaaggacaaaagcagaaccatgcgacaaaaactccagaggctgtcccaaggaagtttaactgtggaggagtactacaaggagatggagatggcactaagtatgtggaattggatgacttactgcataaggcagtccgggttgaacaacatccacatggaaagtcagtagtgtccagtgctgaaactaagcataattctgcctcatcatccaacacagataccagaaacataaaatgcttcaaatgcttaagaagaggacatattgcttttgaatgtccaaccaggaggaccatgatcatcaaggcaaatggagaaatcaccagtgaatctgaaatcagtgaagaagaaaaggtggaagaaaagcttaaggaggaagctatgaagaaagatgattggagacgtcacttcaaggagaagatgagtcaagaacaagttcaccaccataggaagccatggataagagcttga

SEQ ID NO: 49961 - DNA, 264 bp, Glycine max
  Peptide Sequence Number=SeqID_141646
atgaggctaaatcttgaagtgctaaaagttgtagttgcgctcagctcaccatttgggctcagcgcgcatccatcgctaagcgtagcttcagcgcgacagaagaatctggcagagcatcaatatcaaggccgtgcgctaagtccaggctcagcacatgactggagccaaggccaaatccacttactcgcgctaagcgcgagggtggtgctaagcgaaacatcacagattcaaagcctatttaaagcctgtcttgtgcagaattag

SEQ ID NO: 49962 - DNA, 237 bp, Glycine max
  Peptide Sequence Number=SeqID_141647
atgaatagcatcacagaatgccttgcacaaatcccaaggctgctatttaaaaagagtcactcaaagtcactgggccctatgatgcaagctccattggagcttgtaggcctaggatcttcttcatcaatggattcctttgctccttggaagatgaatggcagcggaatggagaaggaagagaaagaggagacgccacttcaaggagaagatgagtctagaagaagctcaccaccatag

SEQ ID NO: 49963 - DNA, 249 bp, Glycine max
  Peptide Sequence Number=SeqID_141648
atggtcataacttttcactcggaggttcgattcaggcgcataatatatcgggcgcacggaattcaaactgagaagctctcgagaaattcaaatggtcataacttttcactcggaggtccgattcaggcgcataatatatcgagacgctcggaattgaacaacggaacctctcaagaaaatccaatggtcataacttttcacacggaggtcagattcgggcgtataatatatccagaggctcgaaattga

SEQ ID NO: 49964 - DNA, 222 bp, Glycine max
  Peptide Sequence Number=SeqID_141649
atgtcaaatgaagaattgaagctgcaggatccacgatgtcggatacaatgtccaggacatcctgcccgaaaatactggagttgctgcacaatgcacaaggcaagacaaaagctgcaggatccacgatgtcggatacaatgtccaggacatctggcccgaaaatactggacacataaatctgttatatctttaacagattattgtgcagttagcaacagataa

SEQ ID NO: 49965 - DNA, 285 bp, Glycine max
  Peptide Sequence Number=SeqID_141650
atggggatcgcacccacaaagacacccagtgaacccggaaaagtccaacagggccctggggtttccagctctggttacgggcctctatcagtcctacagggtgcccggatcgcacctgcaagacacccagtggacccgaagaagtccaacagggtcttggagttgtcaagctctaattacggcaagggcatcaggccccctactgatcgagctctcatcaagaagtactgcgtccctaggcaggcgcagggcgaaacaccacagcagcattgggatggccggtag

SEQ ID NO: 49966 - DNA, 282 bp, Glycine max
  Peptide Sequence Number=SeqID_141651
caaaataggggaggagcttgccacccagctcgcccaggcgagcaaggttacttcctccagaagcaacagccttctggaggaagaatctggaaggcccaactttcgaagaagttacggaaactcacggattgcgcaaaaacacatcttttcgacggaatttcacggatcgcgcaagcctacttccttttgatttctgacacgtctcgggacttcatttattgtgcaacaaaggacgccaagtatctcaaagcggctaaccaaaggttgcatgtcatcaagtaa

SEQ ID NO: 49967 - DNA, 384 bp, Glycine max
  Peptide Sequence Number=SeqID_141652
atgggaacaaatcaaaccggcaagaggttttaccaagtcaaggttaaaggcctagataccaccagcatcaaggaattagggcggttgatggaacctctccaaatgcaagccttccgcaagacttacggaaagatcttagagttgaccatagcagaggtatccatagaagccattgcatcactcacccaatactacgaccagcctttgagatgcttcacgttcggagacttccaattggggaagaaaaccatatcttttctccggttgtctcccctctttgagcagaattgcaacggtggtcaaggattcagcaagaggtttggaccgtgtaaaacagactcgaaacggcatagcgggcctaccacggaagtacctagaagataa

SEQ ID NO: 49968 - DNA, 631 bp, Glycine max
  Peptide Sequence Number=SeqID_141653
gcgtgaacagcaccgagtccggtctgcagttccgcgtgatcaatcagggcgacggcgcaatcccggcgcgtaccgaccacgttcgcgtccactacaccggtaaactgatcgacggtaccgtcttcgacagctccgtcgcgcgcggcgaaccggctgaattcccggtgaacggcgttattgcgggctggatcgaagcgctgaccctgatgccagtcggttccaaatgggaactgactatcccgcataacctggcatacggcgaacgtggcgctggcgcgtccatcccgccattcagcaccctggtcaaagtcgtcgccgacgaagaggcgtcgtctgaacagtcgctacggcgcaatctcacaaaccgtcatattcagcttattgccattgggggtgccatcggtaccgggctgtttatggggtcaggcaaaaccatcagtctggccgggccgtcaatcatatttgtgtatatgattatcggttttatgctgttcttcgtgatgcgtgcaatgggtgaattgctgctctcgaacctcgaatacaaatccttcagcgactttgcttctgacctgctcgggccgtggcaggctatttcacggctggacctactggttctgctgggttgtgacgg

SEQ ID NO: 49969 - DNA, 84 bp, Glycine max
  Peptide Sequence Number=SeqID_141654
atgggtcaggatgatagaaagtgcggaagacgatatgacaacgttagtctctgcatgctaccatactctgagtctgatggatag

SEQ ID NO: 49970 - DNA, 297 bp, Glycine max
  Peptide Sequence Number=SeqID_141655
atggagtggtttttccgcatatctcacccattcatgataccgaccccagcaggtgaccaaccgagagatgcaccagctgcagaccctgaggactacatacaaccgcccagcccccaagatgattacgacggatatgaggcgattgcacagaggttggagcgtgtgctcaaccttcggatagtcactgcaggcacagagttagatgacattatgcaggactgcctgacaatcgcgagaggggaacccagtgttgatggaactgtcagggctcgtcagagacgccgcacggaccattga

SEQ ID NO: 49971 - DNA, 294 bp, Glycine max
  Peptide Sequence Number=SeqID_141656
atgagagaaaaggaaaaaaagcctcaagaggctaacattaatctcccatacttccatggaaaggacaatgtagaggctaacttggattgggaaataagggtagagcaacaactcaaaaagaagtatacttcaaaatcttatggctctcactcttatccaaagaaagaccaagggcaaggcatcttaggggtgacaccttctaaaggtgttgaggaaagaatcccggagtttcaagaacctttatatttgaggtcaaatccttttcaagggggtaaggggaatgatgcattctaa

SEQ ID NO: 49972 - DNA, 309 bp, Glycine max
  Peptide Sequence Number=SeqID_141657
atggaatgccccagggctcctccacgatatgcacatgttgcgttcgagtcgtatcctcaggaaaatggagggatggcctttgtggataaatgggcagtaggtaaggagaagggttgggtaatgacattgttgggttggtgggaaacttggccgtacaggaatggcagtcattgcatgggtttctccctcatcctcaccctcttcatttgccccagttttctcattcgtccaagcaggatgattaaatttgcctcttttcagacccatttcgatctttttgctggtgaaaaccaaatctataaaacttga

SEQ ID NO: 49973 - DNA, 635 bp, Glycine max
  Peptide Sequence Number=SeqID_141658
ggacgaggggttgcattatttataaccctgtgttggccataagacagtttggatatcctatgagaggtgcgtcatcggaggaaaccatcatgcctttcatcacacgagggtttaacaaagcgaatatgaagatacttcagaagatccgtaaggcatggaataaagtgggaaaaaaagataaagagcttagaagaagaagcaatagtgtcataggcgactatcataaatggcttaaatctagaacgcaagggatagcttggcacaaaaagctaaagggtttgaatggagaagaggcaggagtgcccgaggagagtgaagaggtgcaagacttgaaggctgagctcggaaagacaaaagtagagaaggagaagctgaaggtggtagtcactagagttaggaaagaatgtgataagctgaaggatgtcaacatgtccacgactgaagcgctagagcagaaaatgaagaaagccagaaaggaagagtggagtagaaacaagtttcgaggggctttgttaggcagcagtaatgagctcaaagttagtaaggccgagaaagacaaatcaaggatggagaacatgatgttaaaggataagttaaggaattttcaaaggtcaaagggaagtttgaaagaatag

SEQ ID NO: 49974 - DNA, 821 bp, Glycine max
  Peptide Sequence Number=SeqID_141659
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggaacagtcatctatacagcagtctggcagggtttgggcaatgctcggcttcccttttatgcgacaacttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49975 - DNA, 267 bp, Glycine max
  Peptide Sequence Number=SeqID_141660
atggctggtgttgcagccacagggatgctacttgctaccaacaaaatccaaccctcacaacttgctgaggaacaaagaaacgctgcaagactgtttaagcagcttcagacacagatccaaacagaaatcgccattggaaatccaagtgaaggagatgtgagggatgcaatagagaaggttttggctctagacaaggcttatccactccccttgttgggtggtgcaatgctcgaaaagtttccagcaaagtttgaagcagctagatag

SEQ ID NO: 49976 - DNA, 330 bp, Glycine max
  Peptide Sequence Number=SeqID_141661
atgattttaagactaagttggaaaggcgtaatctccataacgctcaccaatttggctgatgggagcatagatgtggctttggtgcaagatttctatgcaaacctatacaactctgagagtccttcaccaaagcaagccagggtcaaaggccatctagtgaagatcgacgctgacagcctcaacacattcctagagacacctatggtgttggcagagggtgagacattgcccatatactccaaatactgcaggctgcctttagatcttagggagattgaggctgccctatgcataccaggccgagggttcatcttgcaactgctgagttag

SEQ ID NO: 49977 - DNA, 447 bp, Glycine max
  Peptide Sequence Number=SeqID_141662
atggaggagagagcacagattcatcctccttccaccactgcccaacaactgaaaaccatgaactgcagaccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 49978 - DNA, 510 bp, Glycine max
  Peptide Sequence Number=SeqID_141663
atgaccggccctctcaatgagtcaatctcatgctttctcataagggtggacccttgggtactagtaccctcaccttcagaggactacacgtcctcaccttcagaagactacacatcctcaccttcagaagactacacgtcctcaccttcagaggacaacacgtcctcaccttcagaggacaacacgtcctcaccttcagaggactacacgtactcaccttcaaagggctacatgccctcaccttcagaggactacatgtcctcacctttaaaggactacacatccttgccatcagaggactacacgtcttcgccttcagagggctacacgtcctcacctttagaggactacacgtcctcacctttagagggttgcacgtccttgccttcagagggctgcaaaccctcgcctttagtgggctggatgccctcaccttcaaagggtgacatgtcaccgactttagaaggctacgtgtcctcactttcagtgggctccatagccacaccttaa

SEQ ID NO: 49979 - DNA, 297 bp, Glycine max
  Peptide Sequence Number=SeqID_141664
atgttgtcatcatcctatgctccatcttcatctccggggatccctgcggggtgtactggtaaaagctctcattcaactgcacctgacccctatgattggccgcctgctggtcggtcacatgctgcatatatgcatgcatctggagctccatcctccgcatctagcacttcgccaggtaatgcaatcctacccccaaggacattggatagaagactccaagaagattgggccaaagatgcaagagaaggccctagggttctcatgagccttagggtagatttcaggctcatgggctaa

SEQ ID NO: 49980 - DNA, 201 bp, Glycine max
  Peptide Sequence Number=SeqID_141665
ggcttcccggtatcaacagggacaccaggatttatttatctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 49981 - DNA, 513 bp, Glycine max
  Peptide Sequence Number=SeqID_141666
atgattgaaagttttcaacaacaacaaatgtcagttctagaattgtacgtaaaaaaggatgttgttggtggttctatgtttcatgctgcaaattctgttacgtcatgtggacataatgtatctcatcatgacttagaactgccaagaaatataagtaatttacatgatgatgaagatgatgatgatgattaccttacgtctaactcatacgttgaagagtctttcgatgaagatgatagtgttgatggaatatccgatacagacgatgaagtcaccgacatcgttgaaccagcttcaattgttcacccaaccgaaggtgtaccagaaattcaaaatccactttggaatgatgctttgcattataataatatcaattggagtcatccggacgaggaggacatttgtggtttggacatgccaacgacttttaatgttggacaagaattatatgttggcatggattttgacaataaagatgcgatcaaaaatccactgaaacaatatgtgatgaag

SEQ ID NO: 49982 - DNA, 636 bp, Glycine max
  Peptide Sequence Number=SeqID_141667
atggtagaaccatcaaagaagagaaagggatcatcctccaccaccgctgctactgcccatcgccgccacagaccatccgaagcacccacagcacctattcatccctctttgtcatctccaagatcatccatgttgttttcatccgatgatcagcgtctacggtaccattctcaattttcttctaggatcatcttagaccctaagtacctagacgtagatttctttaatgatgaaacgtttgattgctatcaagtgtttcaaaattctggcctggttgatttcatgtccttaaaattgccacattatcctgaacttgtaaaggtcttctactgcaatttaaaaattcaggataacattatttcttctgaggtgcatggtattcctatgttcattgatcagtcattgttcttttctttaactcatttacccagtcaaggtgcaccttttgagggcaccattgttgatgactggaaatttgattattctagtcatgatgctcgccgtatggtctgcaatgaccaggctgaaatgaccgtgacttcctatggatactgtaaggatcagaatggtcaatggctgaagaaagacgcactccctcttcaagatgagcgtactccttcacctcctcctcagtga

SEQ ID NO: 49983 - DNA, 396 bp, Glycine max
  Peptide Sequence Number=SeqID_141668
atgagcatgagtgatcccatcgctgacttgctgacccgcatccgcaatgcacaaatggtctccaagaccaccgtgacggctccttcctccaaggtcaaggttgccatcgcccaggtgctgaaggatgaaggctacatcgacggcttccaagtgaagaccgacgctggcaagtccgaactcgaaattaccctgaagtactacgccggccgtccggtgatcgagcgcatcgagcgcgtgagccgtcccggcctgcgcgtgtacaagggccgcgacgcaatcccccaggtcatgaacggtctgggcgtggccatcgtcaccactcccaagggcgtgatgacggatcgcaaggcacgcgccaccggcgtgggcggcgaagtgctgtgctacgtggcctaa

SEQ ID NO: 49984 - DNA, 840 bp, Glycine max
  Peptide Sequence Number=SeqID_141669
atgaggaggctccctgtgcaaggcgtaccggaacagttcattgatgagagagaccacgcgcgctttcgccatctggcgcaggtgccgggcatcgaactctatcacgcgcatatttcccgctatgcctttgagcctcatacccatgaagccttcggaatcggcaccattgaaaccggtgccgagcgttttcgctatcgcggcacccagcatctcgcccctgaaaaatccgttgtgaccatgaacccgaacgagatccataccggtgaatccgccaccgaagacggctggcgctaccggatggtgtacattgaacccgatctgctggaagaggttaccggcctccggcactggtggtttagcgatgtgacccgttatgacccgctgcgctcgcagcaaatcggcagactcatttatggtttgtggcacacggacgacccgctggcacaaaaagggctgctgctggatctgattgagaccttccagccgttagcccaccacgcgccggttattcacgaaggggcacatcggttcgaacgggtgcgtgagtatctgcacgataactatatgcacgccctgacgctggacgagctggccagcgtggtctcgctgagcccgtaccatttccagcgccagttcaaagcccattttcatgtgacgccgcatcagatgctgatggccatccgcctgtggcgcgccaaggcgttcctcacgcacggcatgcccgcagcagaagtcgccgccgcaaccgggctgaccgaccagtcgcatttaacccgcgcgtttacccgccgctacggtattacccccgtgcgctatcagaagcaggtcgcccggcgctaa

SEQ ID NO: 49985 - DNA, 546 bp, Glycine max
  Peptide Sequence Number=SeqID_141670
atgaagcacttcactgacaccctcatcagtgccaacatactggtaccgggccccccctcgaggtcgacggtatcgataagcttgatccgagcttctgagaacaaggctgatgccaaggaaaacctcaaggaagaagaagcagcgtttcgtgaaaaaattgccatgctggcatcgaattcctgcagcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgggaccgctacacttgccagcgctgatgtccggcggtgcttttgccgttacgcaccaccccgtcagtag

SEQ ID NO: 49986 - DNA, 285 bp, Glycine max
  Peptide Sequence Number=SeqID_141671
atggtgaaaggagtggttacggtggtgttccggaaaattttcggaagaacggttcttccagaagtaacgaaaggtcatccggaagaacacttcttccggaaatcttccggaacaccttcttccggaaactttccggaagaagtagttcttccggaaaattttcggaagaagggtactttcggatgccctttgaatattccggaagaactttccggaagagccacttcttccggaaagtttccggaagaactacttcttccgaaagtttgtttgttttttttttaa

SEQ ID NO: 49987 - DNA, 408 bp, Glycine max
  Peptide Sequence Number=SeqID_141672
atgactcaaaagctggtagcccgcggagacaccttacggatatgtaggagcaagagccttgcttttgtcggccgccccataatctttgtcatactgaccctgaggtcatgtgacgtgcaccccttgtatcatccagaggcggcgggcccgatgatacgcggagataccttacggttattcgcacccatttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatga

SEQ ID NO: 49988 - DNA, 329 bp, Glycine max
  Peptide Sequence Number=SeqID_141673
ggcttcccggtatcaacagggacaccaggattaaattcattgatttctttgcgaaggttaatttcgaggctccagtggcgtatcatggtttctatcagctgttcctcctgttcagtactgacggggaattggttatccgctccaattcgcacacaagcataccgaccggaacatcagcgcggcaagtgcgcaactgttcgggaaacgctgatcggtgccgggcctttgctattaagaatcgccaacgcggcgaaagggggatgtgctgcaagtttgcgattaagttggggcaggagaaggaaaagctccaccgcggtggcggccgctag

SEQ ID NO: 49989 - DNA, 444 bp, Glycine max
  Peptide Sequence Number=SeqID_141674
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccgggaactatcgtcttgagtccaacccggaaagacatgcaaaagcaccactggcagcagcccactg

SEQ ID NO: 49990 - DNA, 159 bp, Glycine max
  Peptide Sequence Number=SeqID_141675
atggaggagaaggtaaagcagcaaattaatggagcttcaatgagatccttcaatggtgattttccaccatggagatgcagcggaagacaaaggataagaggtgagaggaggcatcatccacaagggaataagccatggaagaaggagcttcaccactaa

SEQ ID NO: 49991 - DNA, 207 bp, Glycine max
  Peptide Sequence Number=SeqID_141676
atggagaactggcgaacagcgctaggcagtaaattcgcggggctccatactcgatggtggaagacccatgattcagcgctaggcaataattcatgggtctccgaaaaaaagtggagaatggagacttggcgaacaactgctaggcaggaaattcgcggggcttccatactcgatggtgcaggacaacttaacagcgctagcaattaa

SEQ ID NO: 49992 - DNA, 249 bp, Glycine max
  Peptide Sequence Number=SeqID_141677
aagacacctattcatggattcacagaacctattcagttgaatatcttcattgatggtttgagaccgcagtccaagcaattgttagacgcttctcttgggggaaagattaagttgaagattccagaagaagcaatggaactcattgacaatatggctgctagtgatcatgttattttgcatgatagaactcgtattcccaccaagagaagcttgttggaactctcttcacaagatgcactattggcatag

SEQ ID NO: 49993 - DNA, 441 bp, Glycine max
  Peptide Sequence Number=SeqID_141678
atgttgagtcagcatcccaatatgttaaactacactgactctgtgatgaaaagagaatctcctctatccctgcattacaaattgtttgaagggacacatgtcccagacattgtctcgacatcagggaaagctgctgcttcaggtgctgtgtccaaggatgctctgattgctgaactcaaggacacatgcaaggtgctggaagcaaccatcaaagccaccacagagaagaagatggagctagaacggatgatcacaaggctctcagaaagtggcattgatgatgaagaagcagctgaagaagaggaagaggcagctgaggaagacaaagaagcagctgaagaagaagaagaagctgctgaggaagaagaagaagctgctgaggaagaggaagatgcagcagaagagacagaatcagatgatgattctgaagccaccccatga

SEQ ID NO: 49994 - DNA, 462 bp, Glycine max
  Peptide Sequence Number=SeqID_141679
atggagagaagtatgatagatgctgccagtggtggagcccttggagacatgaccactgctgaagccagaaatttaattgagaagatggcttcaactcccagcaatttagtgccagaagtgatgctattgtcattagaggagtgcatgaacttatgctgcaaacatcaacaacagacctcctcaactcagcagcaaaatcagccacaacaaaataattatgacctctccagcaacagatacaatcccgggtggaggaatcatcccaacgttagatggtcgaatccttcaaaacagcagcaacaacaacaaccttattttcaaaatgttgctagcctaagcagaccatacgttcctccaccaatcgagcaacagccccagaaacaacaaacagttgaggctcctccacaaccttcccttgaagaacttgtgaggcaaatgactatgcaaaacatgcagttttaa

SEQ ID NO: 49995 - DNA, 346 bp, Glycine max
  Peptide Sequence Number=SeqID_141680
atgactaggggcaatccaggtgatttacaaccctttgatcctgaaatagatagaacctttcatatattagttacgtatagtatgcatcctgatcattctgttcattttgagcattctgagtattatgttgctggtgattctgaatattctgattttgagcattcaactactaattttcatactaagaacatggctcaacctccacctcatgagaggactcttagggagatggctgcacctgatttcacttatgaaagcttgtgcattcaatatcctgatgagggtgttccttatgttctcaagactggactaatacatttgctgcccaagtttcatggtcttgcag

SEQ ID NO: 49996 - DNA, 612 bp, Glycine max
  Peptide Sequence Number=SeqID_141681
atgaccaccctgactcagatctggatgactttgctgctcagcaacatccagcccagcgatcataattccaacctccccctgccgaagtgtcagctagtgtacgccatcctgacacggatgagcattcacgtggctcagctaatcattgatgccatctatatatttgcagtccttgtcgcacctagcaaggtgattcggccgcccatcacccgagcttttattgagaagtattgcacgcagagacaggtccagggggatgctccgcaggccgcagacgcgccgccacctaatcaggccggtccagccgaattgtttgatacgaagcagtatttgcggcatttggttcgccagcaggtggccaaccaccgggcacatgtacagacccatgattgtctttaccagatgagcctcagcctgcagagcaagggttttacttcttttccgtgccctactccggaccagttcagggcagaggtcgcatggcctggagattggcctgaggcccgggcaggagaggcatcaacagaggctcccgacgaggcagatgaggcccgcgaggacgaggagatgaccgatttacttgatttcttaggaggaagcggggccacatga

SEQ ID NO: 49997 - DNA, 396 bp, Glycine max
  Peptide Sequence Number=SeqID_141682
atggacgaagatcaatggaggtatgactttgcgatgtcacaagaagttgatatggattatgattatgataatcaagaagaatgtggagtgaatgaacgacatgtcgattgttcaaatgcttttaatacatctcaggtattcgctactcgagatgatgttttgcaatgggctcgaacagttgcccatgaaaatggatttgttgcagtgattatgagatctgacacagagaccggtagcagaggaagaagttcatttgtgttaattgggtgtgaaaggagtggtacgtacaagtgtagaaataaagaattcgttagaaaagacaccgggagtagaaaatgtggttgtcccttcaggcttcgtgggaaaccagtgcgtggaggggaaggtggatggtga

SEQ ID NO: 49998 - DNA, 267 bp, Glycine max
  Peptide Sequence Number=SeqID_141683
atggctttcgaatcgttcaaaagcaaaaatatgattcaatatcattcctatgttcattccgcagcacctgatgtgtggaattacaatacttcttcatcagattcagttttgataaagaaaatcattcaaataagggactttattatctccaaagagctaagtacggaagaggccaacaagaggattcaatcttggagcaccaatgaacaattgcttgttggcaaagcctatgaatacattagagatatcaagcctactgttagttag

SEQ ID NO: 49999 - DNA, 288 bp, Glycine max
  Peptide Sequence Number=SeqID_141684
atggcgaatcaagaggagtgggtcccgtttatggacgtattagtattgctaaactttggggttgtcctctttccaaacatggacggtttggtggacctagccacaattgatgctttccttgcatatcaccatagcaaagagagcccgatggtagctatcttggcagacttatttgttacgtttgaccgaaggtgcaagaagagtagcgcacggatcatctgctgcttgcccgctctttgtgtatggttggtttcacacctattccaacaagacaaaaggcatccatga

SEQ ID NO: 50000 - DNA, 149 bp, Glycine max
  Peptide Sequence Number=SeqID_141685
ctgaggaagatggtgaagcagctgaagtagaagaagaagctgccgaagaagaggaagaagcagccgaggaagaagaagaagctgctgaggaagaggaagatgcagcagaagagacagaatcagatgatgattctgaagccaccccatga

SEQ ID NO: 50001 - DNA, 274 bp, Glycine max
  Peptide Sequence Number=SeqID_141686
atggaggccataaaagagcaaatggccataatgatggaggccatgatgagcatgaagaagataatggaagccaatgcggttatagttgccgctactagcgctgtcgctaaggatgtcaataactccactcccatactcattaagagccaacaacctcaatctgatcatgcacatgtctctcgacccatggaggagacacatgaaattccccaccacgatctagccaacttcgagccttgcctcggatatgctgctgaagggcaagcagttggtg

SEQ ID NO: 50002 - DNA, 105 bp, Glycine max
  Peptide Sequence Number=SeqID_141687
gcaggggaggcgcccgcaaaggctcccggcgatacagatgaggcccgcatggacgaggagatgacaaatttactcgatttcttgggagggagcgaagccacatga

SEQ ID NO: 50003 - DNA, 231 bp, Glycine max
  Peptide Sequence Number=SeqID_141688
atgagtcttcattcttcatctagtgttaatggtgagggttctactcctaaggaccccttcctaagtgaagaacttcgtgactattacgaaggaaggcataggtcacatcttaggcctcactcccatagaagagaaaaggaaagaaagcctcaagaggctaacattaaactctcatacttccatgggaaggacaatgtagaggctaacttagattgggaaataagggtatag

SEQ ID NO: 50004 - DNA, 228 bp, Glycine max
  Peptide Sequence Number=SeqID_141689
atgggttcgtcgggatttgatcccattccgttcagaagcgttctgctcattgagttttgtaaaaggttccggtctttcttcggtgaatctcgaggtctttctgatggctgcgctcagcctaatgttatctacgttgacccttctcagactagtttacaactaagaggacggttttcaaagcaagaagcaagtggaaaaacggcttgttacagtgaattcgaaaagtag

SEQ ID NO: 50005 - DNA, 366 bp, Glycine max
  Peptide Sequence Number=SeqID_141690
atgtcaaagaattgggtgttgaaaaagcataacaagactttctgtgattggtttaaagatacaatcttggcagatgagaatgcttcagaaacattaagaaagctagcagatgggcctaaaagaaatgttataacctggcaaggatacgacataaacagcaacaccagtgtgcgcactgatgatataggatttatgctgggcaaaacagttggtgttaatgtagaagatgatgattcatacatggacacctatgttagtcctttgaccactcaaatcactcgtaacgttgtcggagaagaagaagctgacgacgttcatgctaatcgaaatgatcatgatgaaggagaattgattaacatcgtttaa

SEQ ID NO: 50006 - DNA, 420 bp, Glycine max
  Peptide Sequence Number=SeqID_141691
atggcagaagatcggccacaggggatcaccttggaggactactcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 50007 - DNA, 429 bp, Glycine max
  Peptide Sequence Number=SeqID_141692
atgatggaggagaagaaaaagaaaaaattggaggaagttgctcaatctagaagcacttacactatgattgatcatccatcttccatcagacaacacgtgaaatggaagatggcccgcaccaagaaaactagccaaatgatgtctgaggcaacaaaggaaattgctgacatgattggaaaggattcattggaggagcagaccttacaaggttcctttgtcgcccatggacgtcaggatttactgactgctgccattgggcgaccagaacaccttggtcatgtgcgtgctgctggagtcggtgtcaggatcaagcaatactttggaccgacgctaagaacctcccgcatgtcttcctccatggctcctgaagacctagagcagctgacacaaaaaataagggaccaactggaggagtcgatcaccgaaaaa

SEQ ID NO: 50008 - DNA, 180 bp, Glycine max
  Peptide Sequence Number=SeqID_141693
atgtggcggaagtcgaaaggaggtgtttttgcacaatccgtaagtttccgtgacttcttcgaaaggcccacttgggccttccagaagattcctctagaaggctgttgcttctggaggaagcaacctggctcgcctgggcgagctgggcggcaagcatctcccctattttgctataaatag

SEQ ID NO: 50009 - DNA, 462 bp, Glycine max
  Peptide Sequence Number=SeqID_141694
atgccacctaccaggcaccctctacacccagataagtctaacaaggccctggggtttccagcgttcatcacgggtttctaccaatcgttcggggtgcccgtcacacctaataaggctgcagacgcaccgccaccacctcatcaggctgatccagctgggtcatttggcatggagcggtatttacaacacttggttcgccatcagatggccaaccacagggggcaggtgcagatccatgagtgtctctaccagctcaacctcagtcagcagagccaaggttttactccttttgcgtgccctactccagatcagttcagggctgaggttgcatggcccggagattggcctgaggcccaggtaggggaggcgcccgcggaggctcccggcgatccagaggaggcccgcatggatgaggagatgacatatttactcggcttattgggaggaagcggagccacgtga

SEQ ID NO: 50010 - DNA, 529 bp, Glycine max
  Peptide Sequence Number=SeqID_141695
cggttgttacgcttggggcactgctgcatttgtgcatatgtatgataatttaaatgatgcatccaagagcatggcgaggaagcttgcaggatatatcactctattacagcattttccgtccgttggttttgttgttcctgccgaggattatgatgagaggagaccgtgtgcatgtcgatggacctctggcaaggcactacttgtttccatgtatcgcaggtgtctagatagactgacccctgacgtggtgtgctggattccgtacggtgaccaccgttcatttaaagaatttgagtttggctacatccagactattccgccacatcctgcagtgtcttcgctctctgttgaagaaattgatgatagatggatgcagtttgatatgtatcagcaaccgatggctgcagcgacacctaataaggcaaacgttgatgtgcatcatgttcaacatgcggtggatggctttgtagcaattggtgataagttggagaggctactgaacctgaggatcctgactgaaggaacataa

SEQ ID NO: 50011 - DNA, 573 bp, Glycine max
  Peptide Sequence Number=SeqID_141696
atgacaatgatagtagacacattaccagtattctactatggaaaaaggtgggctacacaccttcaaagctttgaggatttggtctttgccagcgaaaggatcgatgtgggtctgaaaaaaggcaaatttgatcatcctactaggacgactgagaaaactggggcaaataaagagggtgaggatgagggagaaacccatgctgtgactgccattcctgtacggccaagtttcccaccaacccaaccatatctttactcagccaataacaaactttctccttacccaccacccagttatccacaaaggccatccctaaatctaccacaaagtctgtctaccgcacttccaatgacgaacaccacctttagcacaaaccaaaaacaccaaccaagaaccataaccctagccaaggttcatcaacctccatttctccgagaatacgactcgaacgcaacgtgtgcttgtcacggagaagccccggggcgttccattgagcatggtagggctctgaagcgtaaggtgcaaggtctaattgatgcgggctggctgaaatttgaggagaattgcgtgtaa

SEQ ID NO: 50012 - DNA, 450 bp, Glycine max
  Peptide Sequence Number=SeqID_141697
atgggtcacacccaagataattgttattcgttgcatgggtttcccgacaaggtcgcacaggtctctagatcagagaagacagagtctagattttctgatgaggagtatcaggagtatttgaagcttaaatccgagaaacccagcaaccaagctcaatcctcatctgtaccatgtttttcaacagcctgtatctctcaatccattgaagtaaccttcactgctaattcgtttgttattcaggaacatgggacggggagactgattggagaaggacatgaatcacgagggctttcctacttggaatctagtccacctggggcttgttttgcaatatcaaagcccaaacttttgcatgatcgtctaggccacccaagcttaccaaaattgaagatgatggttcatagtctcaagaatcttcgagtcttagattatgtacttgggtttatttaa

SEQ ID NO: 50013 - DNA, 177 bp, Glycine max
  Peptide Sequence Number=SeqID_141698
atggtgaaagttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctaa

SEQ ID NO: 50014 - DNA, 238 bp, Glycine max
  Peptide Sequence Number=SeqID_141699
tgatcttccgtcacaaggtatttattcggcgcaaagtgcgtcgggtgatgctgcccaacttactgatttagtgtatgatggtgtttttgaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 50015 - DNA, 291 bp, Glycine max
  Peptide Sequence Number=SeqID_141700
atgtcaaatgaagaattgaagctgcaggatccacgatgtcggatacaatgtccaggacatcctgcccgaaaatactggacacataaatctgttatatctttaacagattgtgcaggatccacaatgtcggatacaatatctttaagtgcagattgtcaggaagatgatagatctcatccagcgcaagttgttgcagcccagatacgcacactgctatataaacatgaaggctgcacgagttccttaccaagtccgagattgaagagttattttgtgagttttgggacttga

SEQ ID NO: 50016 - DNA, 381 bp, Glycine max
  Peptide Sequence Number=SeqID_141701
atgtcaggatttacacacgattctccccaaatttcagccagcatgcatcaattagaccttgcaccttacgcttcagagccctacaatgctcaatggaatgccctggggcttctccatgacaagcacacgttgcgttcgagtcgtattctcggagaaatggaggttgatgaaccttggttggggttatggctaccattgaattatcaagcagatatgggaacaatgcggaagacagactttgtggttgttttagggatggcctttgtggataactgggcggtgggtaatgagaaggaatggcagtcacagcacgggcttctccttcatcctcaccctcctcatttgccccagttttctcattcgtccaagcaggatgactaa

SEQ ID NO: 50017 - DNA, 899 bp, Glycine max
  Peptide Sequence Number=SeqID_141702
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatctctcacacttttaccaagattattgtgacagcacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50018 - DNA, 129 bp, Glycine max
  Peptide Sequence Number=SeqID_141703
atggataagagcttgaaggtaggagaagatgaattgagggagaaggagagaaggagcacggaattttatgcctcaaatgagcccactaatccgagatcaagtccaagattctccactaagtgggcttag

SEQ ID NO: 50019 - DNA, 1089 bp, Glycine max
  Peptide Sequence Number=SeqID_141704
gaaatggctctgaagaaactctccatgaagaggtctagaagagacgccacaggagaagaatccagtgccgacccagagtttgatagtcatcgtttccggagtgccgagcaccagcagcgcttcgaggccatcaggggatggtcgttccacagggagaggcgtgtccagctcagggaggatgagtatacggactttcaggaggagatagctcgcaaacgttggacaccgctagtgactcccatggctaagtttgaccctgagatagtcctagagttctatgctagtgcttggcccacggaggagggagttcgggacatgcgttcgtgggtaaggggtcagtggattccctttgatgtagattccctcagccagttccagggtgacccgctagttttggaggaaggccacaagtgtgagttcagccagaagaggaaccgggccaacgatttcgataaggaagccatcgcccagctggaggcgggtgcggatcatgcacaccagcatgaccaccttgacccagacatggatgatagtgctgctcagcaatgtatggcgcctaccaggcaccctctggacccagataagtccaacagggccctgggatttccagcattgatcacaggactctgccagtcgttcggagtccccgttgcacctagtaaggtgattcggccacccatcacccgggcttttattgagaagtattgcacgcagacacaggcccagggtgatgcaccacaggccgcaggcgcgccaccaccacctcatcaggctgacccagctgggtcatttgacacagagcggtatttgcggcactcgatgcgccagcacgtggccaaccataagggactggggcaggtccatgagtgtctttaccagctaagcctcagcatgcagagccagggcttcgctcattttccgtgccttactccagaccagttcagggcagaggttgcatggcccggggattggcccgaggcccaggcaggggaggcacccgcagaggctcccgacgatggagaggaggccggcatggatgaggagatgtcagatttgctcggcttcttgggagggagtggagccacatga

SEQ ID NO: 50020 - DNA, 700 bp, Glycine max
  Peptide Sequence Number=SeqID_141705
gtgttacaagtgcaatcaacctggacatataaagacaaattgtccagcaaatgagcaatggactgagaaaactgaaaagaaaaattatggagaaaggaaggctaagaaagcctacattgcgtgggacaataatgattcatctgaaggctctaagaaagaagagatcaacctcttaaccaataactatgaaaaccctaagtttcttgacttgaagttcaatgatgatgaaatgtttgactgttttcaagcatttcagaacttcgggttaacccaattcatgtctatgaaacttcctttctatccggaattagttagagctttttattcaaatttagaaattcaagagggtactctagttttcgagggcaccattgatgaggagtggaagtttgatttctccagtcatgatgcatgcaggttggtttgcaccaatcaagcgaatataaccagtagattacttgccggatcattggcatttgaatgccgcatcatgcactatctgattatgcatatccttcttcctcgatcatctaaccttgctcaggcattgcgatcaaatgcacccattccttatcctcatctaattactctaatcttgcgtcatttcgatgtccctcttgactctgagacatttgttcaagtgaagaaggacattcctgcacaagtagcagaggaccgctctccatcaccacctccttag

SEQ ID NO: 50021 - DNA, 137 bp, Glycine max
  Peptide Sequence Number=SeqID_141706
atggctccgagaaagctttccacaaagagatccaggaaggatgtcgcggctgaagggaccagtgccactcccgagtttgacaaccatcgtttcaggagcgttgagcaccagcagcgtttcgaggccatcaaaggatg

SEQ ID NO: 50022 - DNA, 831 bp, Glycine max
  Peptide Sequence Number=SeqID_141707
atggggacagggggttgcatcaattacaatctcgtcctcgctataagacaacttggctatcctatgagaggggcaccacaagaggaaaacctcgcacctattattgcacgaggtagtagcaacgggcccatcggcggctaccataggtggttgaaagcccacatgcaaggtctgggttggctcccgagtttaagaaccactgagggggtggaagttgaagctccgaaggaggacaaagaggtgcaggccctcaggacagaactcgagaagacccaaacagtcaaagaaaagttcaaatcagcagctcttaagatccgaaaggcccgtagggaagaacatggccggaacaaattccgaggggctttgtggggcagtaacagcgagcttaagctccagagagaggaaatggaccaatcacgagtagacagtttgatcttgaaggatgaattgaggatttgcctaaggtccaagagaagtttgtctcagcggttatgcgagaccgagaccaacatgttagccatcatcagcaagtaccaagaagaattaaatctagccacaacctacgagcacaaagtggcggacgaatatgcccgagtgtacgtggacaaggaggctagaggaagggtgatcgactcgttacatcaagaggcaacgatgtggatggaccgatttgctcttactttgaacgggagtcaagaacttccccgattgctggccaaggccaaagcaatggcggatgcctactccacccccgaggagatccacggactcctcagctattgccagcatatgatagacttaatggcccatataattaggaaccactacaaa

SEQ ID NO: 50023 - DNA, 861 bp, Glycine max
  Peptide Sequence Number=SeqID_141708
atggcttccatctcggaggtcatgttaaaactccagaaaaccatagaggataaagccacgacaactgcctccagtacagttagggaagcggagccagtgctgcaacccgccttgaatccgggcctagacagaaacacggccgtgttcggtcgaaggtatagtccgcaagcttatccttatggcctgcctccgaacttcaccccccgtgccaccccggaagatttaagccaagcccctactttcgaggggcaactcccaccttatgaagactatcccgggcaagacgatggggaaggagatacccatcttggccccctgctccacctcaaagatccatccccacatgaactaccccagccgaacatagtccgccatatcccggcctcacccatacccgtaaaagaatatgttcccttcgcggaagataagggaaagattgaggcgcttgaagagatattaagagcagtcgagggccttggcaattacccattctcggacttagcggatttatgtctcgtacccaatatcgtcattcctcccaagttcaaagtaccatactttgataagtacggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 50024 - DNA, 288 bp, Glycine max
  Peptide Sequence Number=SeqID_141709
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 50025 - DNA, 269 bp, Glycine max
  Peptide Sequence Number=SeqID_141710
atgtcacgtaatatcagcactgaactcgccccggcagccattggtccttacgtgcagggcgttgatctgggcagcatgatcatcacttccggccagatcccggtcgatccgaaaaccggcgccgtcgccgacgacgtggccgctcaggcgcgccagtcgctggaaaacgtcaaagcgatcgtcgaagccgccggcctgatcgttgccgacatcgtgaaaaccaccgtgttcgtgaaagatctgaacgacttcgccaccgttaacgccgc

SEQ ID NO: 50026 - DNA, 213 bp, Glycine max
  Peptide Sequence Number=SeqID_141711
atgagtcttcattcttcatctagtgttattggtgagggttctactcgtaaggaccccttgtataagatattagatgagttgagatcccttaagttctggaaagaaaaacaagagagaaaagtgaggaaccatgttccctcatgggaagatgcccaggaaaggggtgttgagggaaaaagcccagaatttcaagaacctctggatttgaggtaa

SEQ ID NO: 50027 - DNA, 133 bp, Glycine max
  Peptide Sequence Number=SeqID_141712
gagtaccaaaaatgaaagcaaaatgcaaccaaaggtggcttggggaagcaaaaaccgtgagtcccggggaaacataaccatggccctctacagattggcattcgctttttcgaacccactcaaggtagattag

SEQ ID NO: 50028 - DNA, 132 bp, Glycine max
  Peptide Sequence Number=SeqID_141713
atgacggtttccaaactcagaaatgatgcaaagagaacaatggcggtttgtggtggctactggtggctgtgggtgatggagaaagatcttggaatgttggaaatggttttggaagaaagaatgagaaaaatg

SEQ ID NO: 50029 - DNA, 216 bp, Glycine max
  Peptide Sequence Number=SeqID_141714
atgttgctgagtagcaaggtcatctatatctgtgtaagagtggtcatgttggcgcgcatgatccacacttgtctctttgcagcgatatgggtgaaatcttgccccgagacatattcagcgccctttatcattcaggaacaacaggctgagtgggtaaacgcgcagagacagattctacgccctttatcattcaggaacaacaggccgagtgggtaa

SEQ ID NO: 50030 - DNA, 447 bp, Glycine max
  Peptide Sequence Number=SeqID_141715
atggcgcctaccaggcaccctctggacccggataagtccaacagggccctgggatttcccgccttgatcacaggactctgccagtcgttcggcgtccccgtcacacctagcaaggtgattcggtcgcccatcacccgagcttttattaagaagtactgcacgcagagacaggtccagggtgatgcaccacaggccgcggacgcgccgccaccacatcaggctggtccagccggattgtttgatacggagcagtatttgcggcatttgatgagtctcagcctgcagagccagggctttacttctttttcgtgccctactccggaccagttcagggcagaggtcgcatggcctggagattggcctaaggcccaggcaggagaggcaccagcaggggcacagcagaggctcccgacgaggcagatgaggtccgcgaggacgaagagatga

SEQ ID NO: 50031 - DNA, 351 bp, Glycine max
  Peptide Sequence Number=SeqID_141716
atggcttcccatgaagagaaaagccacaactttagtgtctcaggccgtggttatggagcaaggggagagctagcctcttactccaggtttcctaaactgaggcctgatcctcaggagcttgcagcccggctatgtatccctgggacgggatttgtacttaatgttgagggtttgtcgtggaagttcttgaggaaagatcttaccactctggcccaaacctggagtgttttatcttattctaacttagccccgacatcccatacttctgatcttaatctggatagggccaagttagtctacgggcttgtaatgaagatgaacatgaactcaggatcacttatttctggatag

SEQ ID NO: 50032 - DNA, 444 bp, Glycine max
  Peptide Sequence Number=SeqID_141717
atgggtcaacttcaacggcaagccttccacaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttatatccctccacgacaagagttgccaaggtggtgaaaatctcagcacaagagttggaccggaaggaaggaagaatcaggattctatcttcatgcgaaggatgtcccatgagaggagtgccatcagacgaaagcatcacgcctttcatcgcacgaggtttcagtgaccacaacgcgagggtactccaaggagttcgcaaggcatgggatgcggcgtga

SEQ ID NO: 50033 - DNA, 135 bp, Glycine max
  Peptide Sequence Number=SeqID_141718
atgatagaaaactctcccaagttcccttttgccctaagacacacgcccttaaaaggtcctccaatgactgaatggtccgttcagtttagccatcagcctaaggatgggaggtcaacttctccaaggaaaatctga

SEQ ID NO: 50034 - DNA, 276 bp, Glycine max
  Peptide Sequence Number=SeqID_141719
atgtgcaacaaaagggggtgccaagtaatctcgaaaagcggccaatcaaagttgtatatcatcgaaactaataatccaccgaatctgaagaaagcaagttccaaagaatcaggagtcaacgatgaagcttcaagaacggtcaagttaaagaatcattcgcagataatcaatctcacggattcaatcagtttcaacggaagctcgagattcttcacggaacaatcagatcagttcagactcagcaatttcgagagaatgagaagagccaagaagtaa

SEQ ID NO: 50035 - DNA, 150 bp, Glycine max
  Peptide Sequence Number=SeqID_141720
atgaaagaagttgaccttataacaaaaaagggatgggttcctataagcaggtcactagcacttgctattatcaaagtttccaacactagtggagttgataggaaggtcctcgtctgggacttggaagatggttactgcactcattcctag

SEQ ID NO: 50036 - DNA, 336 bp, Glycine max
  Peptide Sequence Number=SeqID_141721
atgcaagtgggatcagcaactttcattattagagtaatcaagcacagcggtatctgtagtggcgacagcaaaattctgcaagttgcaagtcgtttccaggatgtcacgacatctcacgtgacatcagctttctgctccccctgtctccatgctcttactgttgtgaagcagttcactgcggcattctgcaagttgcaaatctacaagtcttttccaggatgtcaagacatctcatgtgacatcagctttttgctccccctgtctccatgctcttactgcatcttctatcagctactagtttcagtagcagcagcagtctccccctcaaaatcataa

SEQ ID NO: 50037 - DNA, 800 bp, Glycine max
  Peptide Sequence Number=SeqID_141722
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctttgtgtatctgccgttgccacacggccaacccctgacatgctgatggatgcgattgtaaacttctacaaggcactggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50038 - DNA, 630 bp, Glycine max
  Peptide Sequence Number=SeqID_141723
atgcagctggcacgacaggtttcccgactggaaagcgggcaggaacaaaagctggtaccgggccccccctcgaggtcgacggtatcgataagcttgatctgtggctatgccgtgtcccgtacgtgcggggacctcgactggcacgtgctgagcaccattcagagcgtgtccgtcggtgccggggtcatccctctcctggaggacggaaaggcggcctccgccgccgccggcggtgggtcggagggtgagttgatgtacatgagggcgagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 50039 - DNA, 69 bp, Glycine max
  Peptide Sequence Number=SeqID_141724
atggaggagaagatgcagtggaagataaaggagaagaggtcagaggaggcgccatccactagggaataa

SEQ ID NO: 50040 - DNA, 156 bp, Glycine max
  Peptide Sequence Number=SeqID_141725
atgaccggagacaagaatcggtcatgtatgaataccttgaagagggaactcaatttgaaaggaaccagtcttatgcaggctatcactgggagtcatgctggcaaccagattatgatgataaagcagaaggagttattaatctggatgacctgctaa

SEQ ID NO: 50041 - DNA, 420 bp, Glycine max
  Peptide Sequence Number=SeqID_141726
atgtctatcccccacaaggaaaaaggccaagggggcggacatgacattcagaggatgtggcggaacattgacattgtccgcgaacgcttgacatttatggcatttccttacagtttggggcagcaatcactttccatggtgagccagttaaccgctctccccctcgtggaacttgcctcgatcatgtggttcaccttcttgtcgatgatcgcgggttcatgtcaggttctcttgttgatacaggcgcccatggctaatgacgccgtcaagggacgtactcgtcttccttccactaaccaaggaataatgggggtctgcccgacacatagaagttcagtaccgaagtcccgtgcgggtatccatgacagggcaaaaggcaacatcatgccaatctttgtacgggacactgtcatcttctga

SEQ ID NO: 50042 - DNA, 996 bp, Glycine max
  Peptide Sequence Number=SeqID_141727
atgaaagttatgcgtaccactgtcgcaactgttgtcgccgcgaccttatctctgagcgcgttctctgtatttgcagaagcaagcctgactggcgctggtgcaaccttccctgcgccggtgtatgccaaatgggcggatacctaccataaagaaaccggtaataaggttaactatcagggtatcggctcctccggtggcgtgaaacaaattaccgctaacacggttgatttcggcgcatcagatgctccgctgtctgatgacaaactggctcaggaaggcctgttccagttccctaccgtgatcggtggtgtggttctggctatcaacctgccgggcgtgaagtcaggtgagctggtgctggacggcaaaacgctgggtgacatctatctgggcaaaatcaaaaaatgggatgacgaaacgatcgctaaactcaaccctggcctgaagctgccttctcagaacatcgctgtgctacctggaaaagtgaacgaagagtggaaatctaaagtcggttccggctctaccgttaactggccaaccggtctgggcggtaaagggaacgacggcatcgctgcgttcgtacagcgcctgccaggttcaattggctacgtagagtatgcgtacgcgaagcagaacaacctgtcctacaccaaactggtttctgccgacggcaaaccggttagcccgaccgaagagaactttgccaacgccgcgaaaggcgctgactggagcaaatctttcgctcaggacctgactaaccagaaaggcgaaggtgcgtggccaatcacctctaccaccttcattctggtccacaaagagcagaagaaacctgagcagggcgctgaagtgctgaagttcttcgactgggcgtacaaaaacggtggcaaacaggctaacgctctggactacgctaccctgccggacaacgtggttgagcagatccgtgctgcatggaagaccaacgtcaaagacagcagcggtaaagcgctgtactaa

SEQ ID NO: 50043 - DNA, 364 bp, Glycine max
  Peptide Sequence Number=SeqID_141728
atggtgggctacacaccttcaagctttgatgatatggtcttcaccgacgaaaggaacaaagtgggtctaaaaagaggcaaatctgatcatcatgctttgataaatgccaaaaaaaaactagggcaaatgaagaggttatccacaaaggcaatccctaaatcaaccacaaagtctgtctaccgcacttccaatgtgtcgcaacgtgccctttgcgggcgagcgagggtgaggctcacgggtgcgctttccaaaggaggaaagatgcgcggagtcgccaccaacgaaggtattagcacctctcacgtcgacaaaagcggggcttttgctcctacgtacactcctttggagaggaaatcagaccaac

SEQ ID NO: 50044 - DNA, 264 bp, Glycine max
  Peptide Sequence Number=SeqID_141729
atggcagcggaatggagaaggaagagagagaggagacgccacttcaaggagcagatgagtctagaagaagctcaccaccatagaaggctatggataagagcttggaggaagaaggagatgaatgaatggggaggaagagaagatgatcaaggggttcccgtgaaccttaagagaataaaggtcattcctgagtggcctactccaccaaatataaggaaaatttggggcttccatgacttaacaaacttttacaaaagctgttaa

SEQ ID NO: 50045 - DNA, 375 bp, Glycine max
  Peptide Sequence Number=SeqID_141730
atgccgatgttggatcaatttcatccgtttatacatgatttcattgacaatattgtggatgtcaaagctgacggtatgggtgaagattcttggtccttggtgcgaaaccatttgcttatagaacttggcaagtggtcagatgattatatcaagctctttggtggcacaaacagattcgaggaattaaggaggtccctacttgttgatggattatccatggttactatggataagtggatggatataaccgagatgggatatgtcattgcatcaaggttaattaggcaagctttggaaagtgttgtttttcaccttctcgctaagccaatctgttggcttagcgagcatccgctaagcgcaaaactccttggctaa

SEQ ID NO: 50046 - DNA, 503 bp, Glycine max
  Peptide Sequence Number=SeqID_141731
gtatgccgcctaccaggcaccctctagacccagataagtctaacagggcactgggttttccagcattcatcacgggtctctaccagtcgttcggggttcctgtcacacctaaaaagtattgcacgcctagacaggcgcatggtggcgacccgcaggccccagatgcaccgccaccacctcatcaggctgatccagctgggtcatttgacacggagtggtatttatggcatttggttcgcccgcaggcggccaaccacagggcgcacatgcagacccatgactgtctctaccagctcagcctcagtctgcagagccagggtttcgctccttttccgtgccttactctggatcagttcagggcagaggtcgcatggcccggagattggcctgaggcccaggcaagggaggcgcccgcagaggctcccgacgatgcagatgaggcccgcatggacgaggagatgacagatttactcgatttcttgggacggagcggagccacatga

SEQ ID NO: 50047 - DNA, 759 bp, Glycine max
  Peptide Sequence Number=SeqID_141732
atgggaacaaatcaaaccggcaagaggttctaccaagtcaaggttaaaagcctagataccaccagcatcaaggaattagggcggctgatgaaacctctccaaatgcaagccttccgcaagacttacggaaagatcttagagttgaccatagcagaggtgtccatagaagccattgcatcactcacccaatactacgaccagcctttaaggtgcttcacattcggagacttccaattagtaccaaccattgaagaatttgaggaaattctaggatgtcctctcgggggaagaaaaccatatctttcatcctggtgtctcccctctttgagcagaattgcaactgtggtcaaggattcagcaagaggtttggaccgcgtaaaacagactcggaatggcatagcgggcctaccacggaagtacctagaagataaggcgaaggatatggtaagtcaaggggattgggtcccgtttatggatgtgttagcattgctaattttcggggtcgtcctctttccaaacgtggatggtttggtggacctagcagcaatcgacgctttccttgcataccaccatagcaaggaaagtccggtggtagctgtcttggcagctctatttgacacatttgaccgaaggtgcgaaaagagtagcgcacggatcatcttgagctaccttctggggtggggacaaaatgtggacagtagaaaccaatcaaggtacttaggaacggatgcaagtggggatggggtcacgaccgactga

SEQ ID NO: 50048 - DNA, 147 bp, Glycine max
  Peptide Sequence Number=SeqID_141733
atggagaacaacgatgggtgttacacagtggacccagagaagtacaatagggccctggggtttccagctctggttatgggcctctgtcagttctaccgggtgcccatcccccccagcaagggatcgcgcccgcaagacacccagtga

SEQ ID NO: 50049 - DNA, 466 bp, Glycine max
  Peptide Sequence Number=SeqID_141734
gcttttctgtcttacagacagcaaaaagtttataacggataaccaactcgggtatttccgcccggcgcagaagacgacgttagtctctgcgtgctatcaggcttttcgtcttacagacagcaaaaactttattacggataaccaatcgggtatttccgcccgtcagcgtgtctcaaaatttagtatgacaaatcttgtgagcgcggaagatgataaatctccccgtgttaacgggcttgtcgccgcgattgacgaaggcttttcgtcttacagacagcaaaaagtttatacggataaccactcgggtatttccgcccgtcagcgtgactcaaaagtcagtatgacatatcttgtgagcgcggaagaaatacagcaaaaagtttatacggataaccactcgggtatttccgcccgtcagcgtgactctaaagtcagtatgacagatcttgtgagcgcggaagatgac

SEQ ID NO: 50050 - DNA, 896 bp, Glycine max
  Peptide Sequence Number=SeqID_141735
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcaacggcttcgcagaacagcgcgatcacgccgggttgcgggtttttcatcgcaaagcgtaggcggttttcgttctgccagctggctttgacggcaggcagctctttgcctttgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50051 - DNA, 513 bp, Glycine max
  Peptide Sequence Number=SeqID_141736
atgtcctgcagctcttcctccctgcctcctgaagaatttgcaacagctgacccagcaaatcagggaccagctagaggagtcgatcacagaaaaagtgactcggtagctcatggcatcattcagccagatgcagtcccagtttcagtcccagatgcaatctcagggacttgcactgcctccggagcctttggttggtccctcagcaaatcttacccgcctggttgccctgggagagtttatgagggatccactattgttcataacactcctttgttgcctggccaagtaaaggtgggtgtggaggaggttaaagatccagatgctccagttcctatacccattgatgaggtttccttagtggggcagacaattcacactttccttgcttggccgacacatctggtcaagtctttatcacagcagcatctgactgaaacaagtatgcgagcggggaattctgatatctatggattcctcgagccacagcccattcagaggtctgggcaatcgtag

SEQ ID NO: 50052 - DNA, 144 bp, Glycine max
  Peptide Sequence Number=SeqID_141737
gagtttttcgaagaggagaatagttctagagctttagaattccagtttttactgttcttgcacactgttcacgctaagtctccagcgttgttttcatttgaggatcaagcacaactctctttgaggttttgttattactattga

SEQ ID NO: 50053 - DNA, 808 bp, Glycine max
  Peptide Sequence Number=SeqID_141738
caccaaagcgaaagcgacgttcaacgttgcagctgcgaccagcgatcagaccatggtattccgcctgacggttaccgacgctaaaggcctgagcaacgcgattgacgtgcaggttgttaacaaggcgccgaaggctaaccaggcaccggttgtgaacccaatggaagcggtgacgctgcaggcgggtgaaacctatgttgtgcatgcgcaggctgcggatccagacggtgataacctgacctatacctggagcgttccggcagatatgcacgcgaccggtactgacaccgcgaacgtgaccatcactgcgccagaagtggcttctacctcttcctacaccctgagtgtggtggtaggcgatggtaaaaccagcgtgcagtctaacgtccaggtaacggttaatccgaaaccagccgacgtgacgccgccagctgatgatgtgactccgccgtctgacgacgttacaccacctgctgatgacgtgactccgccatctgacgaaggcactgcaaccggcagctgcgacgcaccggttgacgccaacgccggcaactacgccgcgtgggattccagcaaaatctacaacactggcgataccgtaagcttcgaccatctggtgtggaaagcgaagtactggactcagggcaaccagcctggcttcggcgtggacgcatgggaacttgcgagcaacgtgaagatgaactggcgttctgatctggtgtacaacggcggcgaaaccactacttaccagggcaacgtttaccgtgccaaatggtggacccgtggtgacaacccagcgaacagcgat

SEQ ID NO: 50054 - DNA, 757 bp, Glycine max
  Peptide Sequence Number=SeqID_141739
aggactacacgtcctcgcctcaaagggctacacgccctcgccttcagaagactactcgtcctcgccttcagaggactacacgtcttccccttcagagggctacatgtccccaccttcataggactacacgccctcaccttcagagggctacacgtcctcgccattagagggctacacatcctcaccttcaaagggctacacatcctcaccttcagaggactacacgctctcaccttcagaggacaacacatcctcgccttcagagggctacacgtcctccccttcagaggactacacgtcctcgcctttagagggatacacatcctaaccttcagaggactacacgtcctccccttaagagggctacacgccctcgccttcaaaggactacacgtcctcgccttaagagggctacacgccgtcacctttagaggactacacgtcctcgccttcagagggctacatcgccctcgccttcagaggactacatcgtcctcgccttcagagggctacacgccctcgccttcagaggactacacatccaacctttcaaagggctacatcgtcctcaccttcatagggctacacaccctcaccttcagagggactacacgtcttccccttcagaggactacacgttgttgccatcagagggctacactgtccccacctttagagggctacacgtcctcaccttcagaggactacacgccctccactttagaggctacatgtcctcaccttcagagggctacac

SEQ ID NO: 50055 - DNA, 225 bp, Glycine max
  Peptide Sequence Number=SeqID_141740
atgaagggaaaccaacaaaggatggagtcgccaactgtcgcaacctacccttcggcgggagggcgacgcgagactcgcgggatgcgtgttccacgaaaggaatacgcgcggagtcgccaccaacgtttatttgaggaaaacgtcggaaaaactggaaaagacgcgatctacgaacttttaagtgaaaggttcaggagttgtatttacgcacagggaaggtattag

SEQ ID NO: 50056 - DNA, 213 bp, Glycine max
  Peptide Sequence Number=SeqID_141741
atggggatacaaaagaattctcaggcgggagaagagagaccaaaagaattcaggcagttagtccttggcgaattctttttggcaaagggagaagggaatgaaaagatgaatagcacaagttttcaaggtttggaaaaccataaaacttcagaaagcttttggtacaaagaagaagaagaagttcaaagagattcaaggcttgcaaatgattga

SEQ ID NO: 50057 - DNA, 216 bp, Glycine max
  Peptide Sequence Number=SeqID_141742
atggcaaagagtagaatcgtcttaggccacggtcagaagtcaagacaaatcaatggcagaaatcaaccaaggtacataggtacggatgcaagtggggatggggtcacgaccgaccaatcgttgccccttcccggcgctaaacaagcagagaacgtcgctgcaaggcaacccagtatcctttatggttgcagtttcttttactattgtttgttttaa

SEQ ID NO: 50058 - DNA, 609 bp, Glycine max
  Peptide Sequence Number=SeqID_141743
atgaatggaaacatagatgcacaaacggagtataatatcatgaatacactccaacatatgaccatggtggctacagcttaccaaacctcccacgaatgttcagaagagaccattatagacatcttagtgtgtagaaccttagcagattttaggtggtacagagatactttcctaactagggtttacaccagagaggatagtcaacaaccattctggaaagaaaattttctagctggtcttcccagatcattaggagacaaggttagggataaaattcgtaatcaatctgccaatggagacatttcatatgaaaacttaagctatggtccattaattttctatgtccaaaaagtagccttaaaaatctgccaagatgacaaaattcagaggcaattagccaaagaaaaggctcaaacaaagagggatttaggttccttctgtgaacaatttggcttaccagcctacccaaaacaaaagaagaaacaaacctctaggaaagaaatccaggatcataaaccagccaataaaagaagattttcaaaaagaagatactctcaaaaaccctcgactagtaaggaaatagaaaatcctaggcaaaaaacaaaataa

SEQ ID NO: 50059 - DNA, 378 bp, Glycine max
  Peptide Sequence Number=SeqID_141744
atgagaactctaacagattcaaacctaaagcaaggttgtggtccccaagacaccaaatcagaaattgtattatcttctccccatctgacgagaaacctaagatcccaaaaggaaaatgctgatttggttaaggaagaacacaaaaccaacacagttcctcaggttcatcaatttcgctgcttatcatggatccagatccctaaaatgtcaaacagaaattacaaccactccttgggttgcactctcagcaacaatgaagaatttctcccaatgggagaaagtccgtgcaacatcaacatctcagcatcaactccaaacaaacaacatgaacacatcttaggcacctccacgacaaagcttgttgaagtacaattttga

SEQ ID NO: 50060 - DNA, 153 bp, Glycine max
  Peptide Sequence Number=SeqID_141745
atggtccatgacatctttgtcaaggtgaaactggaagtaacaaggacatcaatagtccaaaatgtgtttggcagtagacgaagcagcgatgtttatgatcccaacatggttggctcatggtacctaacacatgcaactaagaatgccgtgtga

SEQ ID NO: 50061 - DNA, 294 bp, Glycine max
  Peptide Sequence Number=SeqID_141746
atgactttggatttacatagacatccaaagaaatcagttgttgaacctattgataagtcgatgttagttgatgatcctttacatggtttggttaagattctctactatgtgtgcttaggtgtcatgaggcatcggaatggagaaagcaagagagagaggagacgccacttcaaggagaagatgagtctagaagaagctcaccaccataggaggccatggataagagcttggaggaagaaggagatgaatgaagggagagggagagatgagcacaaaattttgtgctctaaatga

SEQ ID NO: 50062 - DNA, 769 bp, Glycine max
  Peptide Sequence Number=SeqID_141747
tccgacgactcagcagcagtgcggaatggagtttctcgtctggtggatctgatctttagggggcaatacataccaaaaggtgctttagtgatctttgatggtctgaacaaggaactctgtgtggggatccatcttgttgttattcgcattgttcaccttggtcggaaatcagggtggttgttctgcgctttctattttaagcaagcagcttcatccttgatgatggcctatggtggtgatgaattcgttcatcctgacaatgcggtaccagtttctctcactcggtccggttaccctcggatcattccgtctcatcataggcgtatgattctgaagaaggatgagaaagcggacatgctgggtacccaatggtcacatggctgcttgtggcctccccgtattcgttacgcctttgatggccctttctaccatcctgcgacgatatgggccgcaatcacaggcaaactaggttgcacgtgtgagggtgctggcaagcgtcgtatattcgcaataggaaactatgtcctccgccgcatcccaatggatgatcaaacagcacctctcattcgtttagttcctagtaaaacatgtttaagctatgacctcaagagtgctaccgattggtggcctcttgtgtttctgtttgaaaggcttgcgctattgtttgacaggtcatttgcttcaagtgttgtgaatacaacattagggacgaatgtatttgaggtacccttcgttaagagggctctgtctcaagtgtcctttgtgaccg

SEQ ID NO: 50063 - DNA, 286 bp, Glycine max
  Peptide Sequence Number=SeqID_141748
atggcgcctccaacattcaacaccccgcagtgggcgcgatcggaagatttaaggccaaggagacgcccacgcggaaactcaccacctgaagactatcccggacaagcatgggagaaagatacccatctgccccctgctcacctcaaaaatccaaagctaacataccagcccatagcccgccaattatcccggacccacccacacgtaaaagaatctgttccctttgcggaagataagggaaagattgaggcgcttgaagagaggttaagagcagtcgagggcctcg

SEQ ID NO: 50064 - DNA, 617 bp, Glycine max
  Peptide Sequence Number=SeqID_141749
ggacacactggggcacgatggcagccctcacctgggatacaaccgagcggcttacccttatggactgccgcccaactattcaccacccatcttgcaagaagatgcgggccacattgcttctcccgtccatgaaaaagagcctcctcagcagcccgacgaagtccataaagaccctcaagattatgctcggagggatgtcgagttttatcccccgatccccgaagggccggcaccgggcacgttgcctcaacccaacctcgcagcatcgccaatagttttgtctatggaagggccgcccccggcaactgaagaaaggaggaagctcgatctccttgaggaaagattgagggctgtggaaggatttggggactatccgtttgcagacatgacggatctttgcttagtacccgatgttgttattcccccgaagttcaaagtgccggacttcgacaagtataaagggacgacttgtcccaaaaaccactctcaaaatgtactgcccttcccgtatccgtacttggaaggatctgattaccgccttcctaaggcagtatcagtacaatttctgatatgggctcctgaccgtactcaactgcagaatatgttcaagaaagagg

SEQ ID NO: 50065 - DNA, 174 bp, Glycine max
  Peptide Sequence Number=SeqID_141750
atggggggtgcaaatagcacccaggccacttgggccctccagaatattcctccagaaggctccgaggcgcttccgaaacgtttccgtaacgttttccgtgaagaatttcgcaaaggtttcaaccgttcttcgacgttcttcattcgttcttcatcgttcttcgatcttcaacgg

SEQ ID NO: 50066 - DNA, 277 bp, Glycine max
  Peptide Sequence Number=SeqID_141751
tcaaggtgttccttttgagagcactctagttaatgactggaaatatgtttattcaagtcatgatactcgtaaaatggtctgcattgaccatgctgatatgatcggtagattgcttgctaggtgcactaatcttgctcaggcctctgaggaggatttactcttgttatgggctcttcaaaccgatcatgaaccttttgttaaggttaaacgatctttcgctattggtgctggtgctgttacttctttcggatatcgaaaaaatatggatggccaatgg

SEQ ID NO: 50067 - DNA, 425 bp, Glycine max
  Peptide Sequence Number=SeqID_141752
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctcctcgtgcgctctcctgttctgctttcgtttacggtgtcattccgctgtatggccgc

SEQ ID NO: 50068 - DNA, 177 bp, Glycine max
  Peptide Sequence Number=SeqID_141753
atggccaccacaccccccgttttgttgaaaaatgggattccggggcttccgggacacccaatgatttttgaagctggattgcttctggaggaagcaacccaggtctcctggaggaagcaacccagctcgcctgggcgagctgggcggcaacctcctccccctttttcctataaatag

SEQ ID NO: 50069 - DNA, 933 bp, Glycine max
  Peptide Sequence Number=SeqID_141754
gtgcgcggtgacgtggccacccgctacagcttccgtgaccgcaagatcgacgtgctggtgcgtgcacaggaaggtgatcgtgccagtgtggaaagcatccgccgcctgatcgtcaatcccggcagtacccgtccggtgacgctggacgcggttgccgacgtggttgccaccactggccccagcgagatccatcgtgccgaccagacccgcgttgcggtggtctcggccaacctgcgcgacatcgatctgggtgcggccatgcgtgaagtgcagcagatggtcgccgagcaaccgctgggcgcgggtgtcggcctgcacatcggcggccagggtgaagagctggcgcaggcggcgaagtcgctgatcttcgccttcggcctggcgatcttcctggtctacccgctgatggcgtcgcagttcgagtcgctgctgcatccgttcgtgatcctgttcaccatcccgctggcgctggtcggcgcgatcctggcactgatgctgaccggcaagcccatctcggtggtggtgttcatcggcctgatcctgctggtgggcctggtcaccaagaacgcgatcatcctgatcgacaaggtcaaccagctgcgcgaggccggcgtggccaagcatgaggctctggtggaaggtgcacgttcgcgcctgcggccgatcatcatgaccaccctgtgcacgctgttcggcttcctgccgctggcggtggcgatgggcgagggtgctgaagtgcgtgcgccgatggcgatcaccgtgatcggtggcctgctggtgtcgaccctgctcaccctgctggtgatcccggtggtgtacgacctgatggatcgccgcggtgatgcctactaccgcgagcgtggccgcaagcacgccggtgagatcgagccgggtgcagcaggcagcgcggcgggtgtggaggagccggcatga

SEQ ID NO: 50070 - DNA, 1248 bp, Glycine max
  Peptide Sequence Number=SeqID_141755
atgaccagccgtttgagatgcttcacgtttggggacttccaaatagtaccgactgttgaagaatttgaggagatcctaggatgccctcttgggggaagaaaactgtatcttttctctgggtttcttccctccttgagcaagattgcaactgtggtcggagattcggctagagagttggatcgtatgaagcaaactcgaaacggcgtagtgggcctaccacggaaatacttggaaggcagggcaagggatatggcgagtcaagaagagtgggtcccatttgcggatatactagctttgctaatctttggggttgtcctctttccgaacatggacggtttggtggacctagccgcaattgatgctttccttgcatatcaccatagcaaggagagcccggtggtagctatcttggcggacttatttgatacatttgaccgaaggtgcaagaagaatagcgcacggattgtctgctgtttacccgctctttgtgtgtgggttgtttcgcacctattccaacaagacataaggcacccgtgtccgcttcaaataccaacggaagagagcctcgcgcctttccttgtgagagatttcagcgcgcaaagtctcaagattgtacaaagagtccacaaggcgtgggaatgcccgttaaggaaagataatgaacttaggggcatccgtaatggcatcatcggtggttatcatgaatggctaagagttcatacacgagggttagattgcctctccaagttgaaaattatcaacgaggagaacttcgaagctccggaagaggatgaagaagtccaagctctaaaatcagagctaggaaaggcaagactcgccaaagaaaaattcaagttagttgctacagacatccagaaagagtgtgccgaattacaagaggaaaatgcggctactgcaagagccctcgaacgagaaaccaagaaggctcgcaaggaagagcatggtcgagataaatttcgaggagctttgtggggcagcaacaatgagctcaagctccggagagaggaaaaagaccagtcacgagtacatggcatggtcttaaagaaggagttagctgcttgctcaagatccaagaggagtttggcccaacacttggaagccactgagcaaagcatgctagctataatagggcagtacaaagaagtgttaaaccagtctttgacccatgaacaaaaactagtagaggacttcgcacaagtgtacgccgagaaggaagcaagagggagg

SEQ ID NO: 50071 - DNA, 726 bp, Glycine max
  Peptide Sequence Number=SeqID_141756
atgaagatgctgggtgcagaagtagttccggcaacttcgggatcaaaaacattaaaagacgcagtaaatgaagccttaagagattggatcaataatccagtgacaactcattatgttataggcagcgttgtgggacctcatccctttcccgatttggttgcaagatttcaaagcgtcatatcaaaagagatcagggaacagcttcatgaacaaacaggaagagagaatcctgactatgtgattgcctgcgtaggaggaggcagtaacgcagcaggaactttttaccattttgtggaagaagaaaatgtaaaaattattgcggcagaagcaggaggcttcggtgtggaatccggaaaatctgcggccaccacttttcttggaactttaggcgttttacacggaagcaaaagccttgtcatgcagacccgtgacggtcaggtaatcgaaccccattcaatttctgctggtttggattatcccgggatcgggcctttccatgctcatttatttaaggaaaagcgtgcggaatttttcagcatcaacgatgatgaagccctgaaatcagcttttgagctcacaaaactggaaggaattattcctgcccttgaaagctcacatgccctggccgtcctggataaaaagaaattcgacgaaaatgacatcgtggtgatctgcctgagcgggcgtggtgataaggatatggaaacttatttagccaatctttaa

SEQ ID NO: 50072 - DNA, 285 bp, Glycine max
  Peptide Sequence Number=SeqID_141757
atggttcgatattctggtgtcctaggcgtagaggaaccacaccaatccatcccgaacttggtggttaaactctactgcggtgacgatactgtaggggagatatccagtggagatgacggggtggggcctgtagctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatggaacttgtga

SEQ ID NO: 50073 - DNA, 267 bp, Glycine max
  Peptide Sequence Number=SeqID_141758
atggaggattgggggaactttctccaccgaatccttgagaaggattttgaggattccgctccgattaaagtgttcctcttggtgcgggggttcaacggcggctcgcggcggccaccggtggtcgtgggtggtggaggaggagtttgggagtgttggggagggttttgggggaagggaggaggaagaaatggatgttttccactgctggttcataatttgaagtctgcaacactcgcctgggcgagctggtgcacagctccaatttaa

SEQ ID NO: 50074 - DNA, 639 bp, Glycine max
  Peptide Sequence Number=SeqID_141759
gaccgtccaccaaagcagtctagagtcagaggtcatttggtgaagattgatgctaacagtctcaacgcattcctggagacaccagtggtattagctgagggagagactttacccgcatactccagatactacaggttgcctacggacttcagagagatagaggctgccttatgcatacctggtcgagggttcatcttgaactctaagggccatcctgggaagattcttaggaaggatttgactagactggctcaggtgtggagtgtcctctcatactccaacttggcccttacatcacagacctctaatttgacaatggatagagctaggttgatctttggcctagtctctcacttggaaatgaacataggagcggccaaaggggttgactctaacagccttacctttgagcgcctgagcccgattatgaacctagcctacatcaagaagaatttttggaaccccgaggatctaacagtctctatccgaggggctaggagggagagggcaagggcagctgaccttccttccacttctgcagctcctactccagcatccacttcaacaaccccttctgtcccagctcagacaaattgtcaatgcttggaagccatgctccaaagcattcatcagggatag

SEQ ID NO: 50075 - DNA, 291 bp, Glycine max
  Peptide Sequence Number=SeqID_141760
atgcagcagcagcaacagcaacaacaaagacaacgagcaactgaggccccttctcaaccttccttagaggagttaaatccgaaaaatgtgagtgccatcaccttgaggtctggcaagcaaattgaagtgcctccacaagtagcaacacctgcgcctgaacctgtcaagcttcattctacacctgaaaaagaggatgagctagctgcacaaaagagaaagcttcctaatcatgagggagctaacaaaatttttcatgcaggtggacctttttctaggagttttgacttgtag

SEQ ID NO: 50076 - DNA, 405 bp, Glycine max
  Peptide Sequence Number=SeqID_141761
atggaggccatgaaagagaaaatggccacaatgatggaggccatgatgagcatgaagaagataatggaagccaatgcggttacaattgccgctaccagcactgttgctaaggtgaacctgatgcccccatctggcctcaaccaaatgaatcatccaacctcagctatggtaggcaagatttgggaagtaccggcagcccccatgatgtgcaaattcaaaacgagcacgccttctcgccatatggcttgcctctcaactatacaccacccaatgtggcgtacactcccaacaagaatgtcaataattccactcctataccctttgagagccaacaatcctaaactgatcatgcacatgtctcttaaactgtgggggagacacatgaaattccccaccacaatctag

SEQ ID NO: 50077 - DNA, 345 bp, Glycine max
  Peptide Sequence Number=SeqID_141762
atggtgttaatttcgaggtgctccagtggcgtatctggtttctatcagctgttccctcctgttcagctactgaaacggggtggtgttaccgtcaattcggcaacaagcataccagccggacatcagcgctggcaagtggcgatcggtgcggaggccggtcttgcgctattacgccagctggcgctaaaggcggatgtgctgcatactggcgattactatgttgggtacactgatgccagggtgtccagtcacgaagtgcgttcgtggcaggagaaaaaaggctgcaccggtgcgtcagtcagaatatgtgaatacggactcactatggccgcgaattccgtctga

SEQ ID NO: 50078 - DNA, 510 bp, Glycine max
  Peptide Sequence Number=SeqID_141763
atgactactcttgcacagatatggatgacgttgctacttagcaacattctgcccagtgaccataatgccgatctccccctacggaaggatcgctcccacaagacacctagtggacccggaggagcccaacagggccctggggtttccagctctggttacgggcctctgtcattcctacagggtgcccgtcccccccagcaagagatcgcgcccgcaagacacctagtggacccggagaagtccaatagggtcctagggattccaactctgattacgagcctttgtcagttttacagagtgcctgtcacctccagtaaggggcagggttccgcctcttttgtatgccctaccctggagcagtttggggctgaggtcgcatgccctggagactggcccgatgcccaggcaagggaggagtctgcaggatcccccgatgaggcggatgaattccatatggatgaagatatgactgacctactcggtttcttgggagggagcggagccacgtga

SEQ ID NO: 50079 - DNA, 264 bp, Glycine max
  Peptide Sequence Number=SeqID_141764
atgtccgattcaggcgcttcacatatcgagacgcctgaaattgaacaccagaagatcgtgagaaattcaaattttcataacttttcacacggaggtccgattcaagcgcataatatatcgggaggcatcaaattgaacaacgaaagctctcgagaaattcaaattgtcataaattttcacacggatgtccaattcgggcgcataatatatctagacgctcgaaatttatcaccggaagctctcgagaaattcaaatggtcataa

SEQ ID NO: 50080 - DNA, 270 bp, Glycine max
  Peptide Sequence Number=SeqID_141765
atgtcggcgagctatctcctcctgaaaatctgtgtactcatcgtccctgagctagacacgtctctctctgtggaacgaccatcctttgatgtcctcgaagcgctgctggtgctcggcgctcctgaaacggtggctatcaaactcgggggcggcactggtccctttagtcgcggcgtccctcctagatctctttgcggaaagctttttcagagccaattcctgcgaggacaaacatttggaaagttaatttacaaggaaatgctattttaa

SEQ ID NO: 50081 - DNA, 216 bp, Glycine max
  Peptide Sequence Number=SeqID_141766
atggcttctaggaaacgcaagagtatcggttcaagacccacaacacaatatgatacaaggagatttcactccttagatgcttggaaccggtacacggataatgtcctagggagaaacatcttgcctgagaggaagttggagctctaccacatcgagttggatgatattaagactgagttggagaggcgtaatttccataaatgcctcaccaattga

SEQ ID NO: 50082 - DNA, 326 bp, Glycine max
  Peptide Sequence Number=SeqID_141767
tccaaactcaggagcacaggtcgcttgagcaaacagaccaatggcttgcacccacttccggatttacacgtgattctcctcaaatttcagccagcccatatcaattagaccttgcaccttacgcttcagagccctacaatgctcaatggaacgccccggggcttctccgtgacaagcacgcgttgcgttcgagtcgtattctcggaaaaatggaggttgatgaaccttggttggggttatggctaccattgaattatcaagtagacatgggagcaagtgatgttcgtcattggaagtgcggtagacagactttgtggttgatttag

SEQ ID NO: 50083 - DNA, 966 bp, Glycine max
  Peptide Sequence Number=SeqID_141768
atggcaggtcattggacagttgcggctcgcgcttatcttcttcatcttctgggttgcactctgtttgctaacaagagtgcaaccaatgttcatgttgtgtatttggaggcccttcatgacctcagtcagactgggaggtactcctggggagtagctgcattgtgctggatatacgagcactttccctcagtcacggagtccactgctgatcaggactacgacgaggattcattgcgtgcctgtaggtggattgccacgaagaagaccgtgaagagcatacatacaccggcgtacagggagtgcctggaccgactccggattctggatgtctgttgcatcccatatggggagcaccgaccggtccaggacttccatatgatttcatgttattccggtctcctacgctgggggcctgttgttgtgtattatcgaccagagaaggtcatgcggcagtttggatacacccagaccattcctactccgcctgccgactcatgggtgtcgtatgatgatatacacgacaggtggatacactattcggatcatatggttctagtaggtgaggtgtgcgatgtgccaagtcagtgtgccaacgactacatagactggttcttccgcatttcccattttttcatggcaccaggccaggcatcagatcctctgctagatggtcatgctccgcaaccccgagtcgtccctcaggccccagagacagatatccctcacgtgccggagccaggagcaccatcgacatctgcgaggcccgttgtggaggagcctagacatgcagtgataaaagtttgctatgggattgctgagaggttggagcgccatctgagcctaggggtggtcacgccaggctcatcgacacttgagctgatcgaagaatgcctcaagatggtcaggagtgtcacacaggaccagctagtatatgttaggtctcgatgcaggtggcgcacgaattag

SEQ ID NO: 50084 - DNA, 699 bp, Glycine max
  Peptide Sequence Number=SeqID_141769
gctgccgatgatcttgcgggctatctgaatcgatctgcgaagaagcgcccggaagtgattctgaaacttgcactttctgccgatggcatgatcggccgtcggggcgagggacagcttgcaataacggggtcggttgcgcgcgcccagtcgcatatcctgcgggcccagaccgatattatcctgattggcatcgaaaccgccctggccgacgatccggtgttgaactgccgcctgccggggctggaacagcgttcgcctgttcgggtggtgctcgatagcggattgcgtttgccgctttcctcgaaacttgtacagaccgctgatgcccagcccttatggatcgcctgtggtgaagaagcgttgccggagcggcgctacgagttgcaggcggccggttgccggattctcgcgaccgaagcttatgattgccgcatcgctctgcccgaactgatggacgatctcgctgcgcaaggcatttcctcggttctcgttgaaggcggagcaggtgttgcgaagagctttctgggcgaggggctggtggaccggcttgccatcttccgttcgccggttgaaatcggctcagaacttggggttgccgtggacgggcttgaaacccatatcgcagacaagttcaaaatcttaaggcaggctcgctacggcgacgatgcctatgcggaatatgtaagtgccagaatgtaa

SEQ ID NO: 50085 - DNA, 429 bp, Glycine max
  Peptide Sequence Number=SeqID_141770
atgaggctactatttcaccttcctctagtgaacgtgaagaaagcaaaaggggaagaatctagtgaagaaatctaccctcaagaagaaggacaaccattaatggttaaggaggagtgtaaggaagtaagtgtctcctccaagaggttagctaagaaggaaattcattttacaataaagacaaacattaaagaaacttctcttcttagacaacctccacattttctcatttgtaaaaagacacttgttagcattgccacacctcttgggcttgagtttattcctcaagtaaaggagttgttggatgagggtttggttcgcaagagcttaaatccttgtgctttgttggtgcctaaaataggtattattaggcaccaaatccctatgataggtggtatgatgaatgtgttgagtggtgcaacactcttttga

SEQ ID NO: 50086 - DNA, 318 bp, Glycine max
  Peptide Sequence Number=SeqID_141771
atggcatcattggtgggtacccacgaatggctgaaagttcatatacgaggtttaggttggctcgccaagttaaaagtcgtcagcgaagagagttttgaagcaccggaagaggacgaagaagtccaaactctcaaaagcgagttaggaaaagcaaaacttgccaaggagaagttcaagttggcccatacacacgctttcggaaggaacctagcagcaatcgagcttaggtctgcctaccccatagcaaggaaagtcgcggtggtagctgtcttgcaagactatttgacacatttgaccgaaggtgcggaaaaagagtag

SEQ ID NO: 50087 - DNA, 231 bp, Glycine max
  Peptide Sequence Number=SeqID_141772
atgcagagccagggcttcgctcctttttcatgccctactccagaccagttcagggcagaggttgcatggcccggagattggcccgaggcccaagcaggagaggcatccccagaagctcccggcgatggagaagaagcccacgaggatgaggagatggctgatttgcttgacttcttgggagggagtggagacacagttcttcgtttaggaacatcgtccaaaagtatatag

SEQ ID NO: 50088 - DNA, 168 bp, Glycine max
  Peptide Sequence Number=SeqID_141773
atggtggcccgtgtgatgttggggtatggctacgagcgcagaatgggtttaggcaagaacaactacggcagaaccagactggaaaagtatcgcggaaaggaagagcagaggccaagcttcgggattgggatgacaagtcgaaggggccccaccctgccacatcagtag

SEQ ID NO: 50089 - DNA, 414 bp, Glycine max
  Peptide Sequence Number=SeqID_141774
atggagagaagtatgatagatgccgccagtggtggagcccttggagacatgactcctaccgaagccagaaatttaattgagaagatggcttccaactcctatcagtttagtaccagaaatgatgctatagtcattagaggagtgcatgaggtagctacaaactcagctgcatcattcgaaactaagaagctagaaggaaaactagatgcattggttaacttggtaacccaactggccttgaatcagaaatctatacctgtcgcaagagtatgtggtttgtgctcctctgctgaccaccatacagacctttgcccttccatgcaacaacctggaacaattgagcagctcaaagcttatgctgcaaatatttacaatagacctcctcaacctcagcagcaaaatcaaccactgtag

SEQ ID NO: 50090 - DNA, 675 bp, Glycine max
  Peptide Sequence Number=SeqID_141775
atggccccgaggaaacttgcctcaaagagatacaggaaggataaagcggccgaaggaactagttctgctcccaagtatgataatcaccattttaggagcgctgaacaccagcagcgctttgaggccatcaagggatggtcatttctccgggagcgacgcgtccagctcagggacgatgagtataccgatttccaggaagaaataggtcgccggcggtgggcatcattggttacccccatggccaagtttgatccaaacatagtcctcgaattttatgccaatgcttggccaacagaggagggcgtgcgtgatatgaggtcctgggtgaggggtcagtggatcccgtttgatgcagatgctattggccagctcctggggtatcctttagtgctagaagagggccaggagtgcgagtatggccagaggaggaaccagtctgatgggttcgatgaggaggtcatcgcccagttactatgtataccggggcaagattttgcccggactgctgccaggagacgggtgcggatcatgcgcaccaacatgaccaccctgactcagatatggatgactttgctgctcagtaacatcctgcccagtgaccataattccgacctccccctgccgaagtgtcagctggtgtatgacgcctaccaggcaccctctggacccagataa

SEQ ID NO: 50091 - DNA, 279 bp, Glycine max
  Peptide Sequence Number=SeqID_141776
atgatggtcaaaggttggagctttgttggagcttcaatggtggaggaagaagaagagaatagcaactcacaaagagggaaaaatctgacctttgcaacgctaaaaccctgcctcggtttgcatgccgtttctctggttccagttcctcgcgtttctctgcgcccgtcggggccagttttcgaaagtaaccaatatatatatcaaaacgctcagaataaaaccccgagcatggttcagaggttggttttgctaaattttaagtcgcacgcaaaacgatga

SEQ ID NO: 50092 - DNA, 749 bp, Glycine max
  Peptide Sequence Number=SeqID_141777
ggggattcgcttggggagcggctgcattggtccacatgtacgagcatctgaacgacgcgtcgcaagcctctacacggcagatgggcgattacattacacttcttcagtgctggatatatgagcactttcctacagtgcatacatgcgtcgttcatgatgcttatgatgaggggagcccacgggcctgcaggtggcttatgggtaaggctcatatgacgaggatcaagggagccccatatcagagacgtatggatgccctgactgtgactgacgtgtgctggatgccctatgctaagcatcgaggagtcaggggctttgacttgatatcgtcgtacaccggccagctcagatggggtcagattgtcgtgtacgttccacctgagcgggtggcaccagactacatggactggtttttttggattttgcacccgttcgtcacgccgatcgaggagactgctgagccgagacatccgcctccctctcatgatgaggagttcgtcgagccacctatccccgaggtttcagttgcgtccgatctccctacgcattcaatggttgattgtgaaggatgtcaagggatggttgaggatttaggagtgattgctgaggatttggagcgggtcatcaaccttaggatggtcactgaaggcactgacttatatgacatcatgactcgttgtctgaggagagctagaggtgacgctgctgatggaagtcttaggccgcgacagagacgccgcatagattag

SEQ ID NO: 50093 - DNA, 827 bp, Glycine max
  Peptide Sequence Number=SeqID_141778
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatccgatagtttgctagaagagactgcttttgtgtcagtgattgaagctgaaatcgcagaagacacctgctttcctttagctgtcttgcgatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50094 - DNA, 195 bp, Glycine max
  Peptide Sequence Number=SeqID_141779
atgactaaagcacgtcaaaagggcatacagaaaggaaaagaaggagaagcttgccacctagctcgcccaggcgagctaggttgcttcctccagaaggcaccgccttctggggaacttcctggaaggcccaagtgggcctggttgctatttgcacccccttatttactaaatacaactcctgcctttttttgctaa

SEQ ID NO: 50095 - DNA, 582 bp, Glycine max
  Peptide Sequence Number=SeqID_141780
gatggcgtacaccagctggcacttcggcatggggaggtcggaattatgatcggtgggcaggatgttgctgagcagcagagtcatccatatctgagtcagggtggtcatgttggtgcgcatgatccgcacccgtcttccggcagcagtccgggcaaaatcctgccccgaccggttcctcctctggccatactcgcattcctgaccctcttccaataccatcggatatcccaggagctggctgatagcgtcggcatcgaacgggatccactgacccctaacccaggatctcatgtcacgcacgccctcctctgttggccaagcattggcataaaactcaaggactatttctggatcaaacttggccatgggagtaaccagtggtgcccaccgccggcgccctatttcctcctggaaatcagtatactcgtcgtccctgagctggacgcgtcgctcccggagaaacgaccatcccttgatggcttcgaagcgctgctggtgtacaacgctcctaaagcggtgactgtcgtactccggggcggaactagttccttcggccgccttgtccttcctggacctctttga

SEQ ID NO: 50096 - DNA, 303 bp, Glycine max
  Peptide Sequence Number=SeqID_141781
atgcatagatctcccacaggcaatttagttcctctggacttggagattgaagctacgttaagaagaaggaatagagccaagaggagaagaaaattactccaagacaggacagtagcgtccattcttgaggaagaaacttatttttctgattcttcatcatccgactcaccatcatcaagggaatccgcgacttatttaccaaaagccgtttccatggctgatgagcaccagcaaagggttacccttgaggactattcaagcagttcagtgccgcaattctttaccagcattgcacgtccagaa

SEQ ID NO: 50097 - DNA, 501 bp, Glycine max
  Peptide Sequence Number=SeqID_141782
atggttgtttataccatagagtttgatgaattcttagatgagatagcgagacgccactgggatgaggaattgactgatttcattgatggtagcatcgatgttgccattgtgaaggagttctacgccaacctctatgaccctgaggacaaaacacctaagcaagtgcaggtgttagctgctaagctttgtatcccagggaggggatttgagattaaagctgatggatacctagtgaagattctgcggaagaacatgactacactagctcaaacatggagtgttctttccttctcgaacttgattcccacctcccacacttctgatatcactcttgatagggccagactcatctatggcattattatgaagatggacatgaatatggggtacctcatctcccaccagatctccctcattgctcagcatgacacatccagacatggattctcggccttgattatagctttatgtaaggctaggggagttcaatctaactcgtga

SEQ ID NO: 50098 - DNA, 515 bp, Glycine max
  Peptide Sequence Number=SeqID_141783
atggctacctcaccaaaagaaacttcagctcctggttcacccgctgtaccatcatctccgcaccaggaacaacctgaattcaacatccaacccatacaaataattcctggtcaagcctctgctcctgagaaactggctcctagaagacaacagggagtgaagattgctgaaaaccctagccttgcaacaagtcctagggaagtagacacggagatggacaagaaaatccgcagtattgtgagtagcattctgaaagatgcgtctgtgcctgatgctgatgaagatgttccaacatcctccaccccgaatggttctgtgcctgatgttgataaagatgttccaacatcttccgctccaaatgctgaagccctcccttcacccagtgaagaggagtcaacagaagaagaggatcaagcctcagaggagacccctgcaccaagggcaccagaacctgctccaggtgacctcattgacctagaagaagtcgaatctgatgaggaacccattgccaacag

SEQ ID NO: 50099 - DNA, 186 bp, Glycine max
  Peptide Sequence Number=SeqID_141784
aagttgttgccttttaaggagtgcaaccatctttttgcctctcctactagggaaaaggagaagaggttaaggcgtattgcatcttctggaactccggtgattttaacggtgttgcatatctctatttatgaggctagatgcgcatatggatctttacttggaagaccatggaagaggttcccttga

SEQ ID NO: 50100 - DNA, 171 bp, Glycine max
  Peptide Sequence Number=SeqID_141785
atggtcccggtcaagtacatatttgagaagcctgcctctgacagggcggatcgcccggtggcaggcgataaagggaagctcttggtggattatttggctcagcagcctctcaacgactatcaacccatgcatcccgagttcccggatgaggacatcatggcccttgtttga

SEQ ID NO: 50101 - DNA, 809 bp, Glycine max
  Peptide Sequence Number=SeqID_141786
ttggaactctacgtgccgatcaacgtttcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtccttggcacttggctacttgattttggtgcctctgatcatatgactagtaaccaatcccttactcaattgtcttttccggattcattgccttctattaccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50102 - DNA, 321 bp, Glycine max
  Peptide Sequence Number=SeqID_141787
atgtcatctactatttgtagggatcgcgcccacaagacacccagtggacccggaggagcccaacagggccctggggtttccagctctggttatgggcctctgtcagtcctatccgggtgctcgtccccccaacaagggatcacgcctgcaggacacccactgtttccagctctgattacgggcctctgtcagttctatagagttcccgtcgcccctagcaaggtcatcgggccccctactaaccgagttttcatcatgaagtattgtgcccccaagcaggcgcagggcgagacaccacaacagcctggggatggctggtag

SEQ ID NO: 50103 - DNA, 333 bp, Glycine max
  Peptide Sequence Number=SeqID_141788
atggatatctctgaagatactgacatccctgtaatattgggaaggccattcatgttgaccacaagctgcatagttgatatggggaaaagaaagctggagctaggttttgaagatcagaaaattgattttgatttgtttgttgaagacaaacctgctccagaacacaatgtcttcttacaggtaatggaaggatgtcaagaggttctaaagatcattgggaacttgctgtttaatatgtacgttggagtatatcagcttatccttgaatgtagatataagggtgtctatttcttggaaaaaggactaaaaaataacttagaaaacattttctga

SEQ ID NO: 50104 - DNA, 562 bp, Glycine max
  Peptide Sequence Number=SeqID_141789
atggttatgggagatttcatcagcagactctccttccccgaaaacaccgagactttttccagtctcacaagttatccagaactacgtaggtctgagttcctcattggaggatacgtaggagcaagagcctcgcttttgtcgaccacaccgtcttttgtttgcacattgaccctttcaagaggcgtgatagcccgcggagatcaccttacggttatccgcacccttttgtcattccagagcggcgggcccgatgacacgagcagagaccaagtttggtcattctgcacccttgtatcatccagaggcggcgggcccgatgatacgcggagataccttacggttattcgcacccttttgtcatccagaggcggcgggcccgatgacaagcagagaccaaaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgatacgcggaaatacccgagtg

SEQ ID NO: 50105 - DNA, 483 bp, Glycine max
  Peptide Sequence Number=SeqID_141790
atggccaccgctgatgccttggaacgagaaaccaagaaggcccaaaaggaagaacacgtgccagctttatatggcagaaatagcatgatcttgaaggacgagctaaaggtttgccttaggtcgaaaagaaatttgtcccaacagttaagcgagattgaagggaatacgtgggccatcatcgataagtgcaaagagaagctaaatctagcggcgactcacgagcaaaggctagaggatgagtacgccaagatatcagcaaaaagggaagcaagggaaagggtaattgattcattgcaccaagaggcaacaatgtggacggaccgatttgctcttactttgaacaggagtcaagaacttccccgattgctagccaaggccaaagcagtggcggacacctactccgcccccgaggagatccacggacttctcagctattgtcagcatatgatagacttaatggaccatatgattggaaaccgctag

SEQ ID NO: 50106 - DNA, 219 bp, Glycine max
  Peptide Sequence Number=SeqID_141791
atggcaattctgatcgccaatacttcaacaacatttcatagggatgaaagactcgggaatacacatgctatgcatggaaaatttaagaagacgatatggatcttccgacttcccacgacaaaagatgagacccacatacaacgcatgtgtgatggcatgatgcagatgcgcaaaagcgcaacagggggatttacacagcatgacaatatcctcaaataa

SEQ ID NO: 50107 - DNA, 273 bp, Glycine max
  Peptide Sequence Number=SeqID_141792
atggggaaccagccaagacaaaatttcaatgtaggtggatatttcggatttcagcacggccagccatataattcagagcagggacaatggaggaatcaccctgaaaaccagttcaacaaagaccagggtggtccatctaacatgccacaacaacaagggcataatctctatgatcgaacaatgaagctggaagagactcttgctcagttcatgcaagtatctatgtcaaaccataagagcacagagtccgccataaagaatctggaagtctag

SEQ ID NO: 50108 - DNA, 207 bp, Glycine max
  Peptide Sequence Number=SeqID_141793
atgacttcaattttaggttctgtcgcaacctacacttcggcgggagggcgacgcgtgactcgcgggatgcgtgttccacgaaaggaatacgcgcggagtcgccaccaacgtttatttgaggaaaacgtcggaaaaaccggaaaaggtgcgatctacgaacttttaagtgaaaggttcgggagttgtatttacgcacggggaaggtga

SEQ ID NO: 50109 - DNA, 504 bp, Glycine max
  Peptide Sequence Number=SeqID_141794
atgaccactcttacatggatatggatgacgttgctatttagcaacattctgcccagcgaccacaatgccaatctccctctgcagatgtatcagttgggatcgcgcccacaagacgcccagtggacccgaagaagtccaacagggccttggggtttccagctctggttacaggcctctgtcagtcctacagggtgcccgtcccccccagtgaggtcatgccatcgtgacatagggatcacgcccacaagacgcccagtggacccgaagaagtccaacagggccctggggtttccagctctagttacgggcctctgtagtcatacaaggtgcccgttccccccggcaaggtcatgtcatcatgatattgggatcgtgcccgcaagacacccagtggacccgaagaagtccaacagggttttggagttgccaagctctaattacggatctctgtcagttctacaaagtgcctgtcacctccagcaagggcatcaggccccctactaa

SEQ ID NO: 50110 - DNA, 492 bp, Glycine max
  Peptide Sequence Number=SeqID_141795
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctttcgctccaagctggactgtatgcacgaaccccccgttcagtccgaccgctgcgccttatccggtaactatcgtcttgagtccaacccggaaagacatgcaaaagcaccactggcagcagccactg

SEQ ID NO: 50111 - DNA, 309 bp, Glycine max
  Peptide Sequence Number=SeqID_141796
atggcacgcagcgtgtttgctctgtgcccctatttaagggacctatatgggagggagctaacaaggcttttagtgataacccccaaggtagtcatatctctcttgatggtttctagagggaaaaccaacaaaggagtaagtcatggtaaaacattgcgcaagattaaatggcctaactctctaaaaacagtccccagtggagtcgccaactgtcgcaacctacccttcggcgggagggcgatgcgtgactcgcgggatgcgtgttccacgaaaggaatacgcgcggagtcgccaccaacgtttatttga

SEQ ID NO: 50112 - DNA, 834 bp, Glycine max
  Peptide Sequence Number=SeqID_141797
gccgataacgatcagcaggatgtcacatccgaaattcaggtgcgtatggggctgtcgaacagctcaaaccatctgcgaaccgcgcgtatcaatctgatccacgccggtgcggcaagccgtatcgcagagatggatgcgatgaagcagaacatcagcgaggcggaaacgcgcattaagcagtctcaggagagctttaccgcctacatgaatcgcgccgtgcgcaccgccgagggcgcagcactggatgcggatctcaaggcgcgttacgacgcctatatcgctggcatgcagccgatggtcaaattcgccaaaaacggcatgttcgaagcgatcatcaaccacgaaaacgaaacggcgcgtccgctggatgacgcttataacgccgtactgctgaaggcgattaagatccgtaccgaccgtgccaatgcgttgacggcgcaggcgcacagccgcacacagctgggcctgatgtttatggtgggcgcgtttgcgctggcgctggtgctgacggcgatgacctttgtcgtgctgcgccgcacggtaatcaatccgctgcagcgggcagcgaaacgtatcgagaatatcgctaagggcgacctgacgatgccggacgacgtggcggggcgcagcgaaattggacgcctgacgcgcgatctgcaaaccatgcagcactcgcttgaaaacaccgtgggcaccgtgcgtcagggggcggaggagatttaccgtggcaccagcgaaatttctgccggtaacaccgatctctcgtcccgcaccgagcagcaggctgccgccatcgagcaaaccgccgcgagcatggaacagctgaccgcgacg

SEQ ID NO: 50113 - DNA, 276 bp, Glycine max
  Peptide Sequence Number=SeqID_141798
atggtgaaaagttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 50114 - DNA, 216 bp, Glycine max
  Peptide Sequence Number=SeqID_141799
atggaggttgaggaaccttggttggggctttttcgttgcgaaattccttccttcgttggtgttttggttcgtgctaaaggtggtgttcatgattggaagtgtggtagacaggctttagggatggcctttgtggatagttgggtggtgggtaaggagaagggttgttattggctgagtaatgacattgttgggttggtgggaaacttggtcgtatag

SEQ ID NO: 50115 - DNA, 183 bp, Glycine max
  Peptide Sequence Number=SeqID_141800
atggtagccataaccccagccaaggttcctcaacctccatttctccgaggatacgactcgaacgcaacgtgtgcttgtcatggaggagccccggggcattccattgagcattgtagggccctgaagcgtaaggattttcaagtttatgccattattgtaaaccacagttacaatgctaaataa

SEQ ID NO: 50116 - DNA, 289 bp, Glycine max
  Peptide Sequence Number=SeqID_141801
gtggctgcgacgaggaaatcagcatattggcaatgatgatcttagagttttccgtcgcaaattggatctgatgaaacaacatgagtttgtctgggagccatacacagcaactgtgatggctgcgttgcctccaatttgtgtggttggaagtgtagcctggtttgcggtggtgccactgatttgttttcatgttttaagtggcaccaacccgatagagttttacgacaatttagattgcaacaacctattcccgggtttccttcgcaaccgcagaatctccatggcataa

SEQ ID NO: 50117 - DNA, 390 bp, Glycine max
  Peptide Sequence Number=SeqID_141802
atgaacgaaaacgcaattcatggggctccgaaaagattcagaatggagaattgcactaagcatcgaattcctgcagcccgggggatccactatgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 50118 - DNA, 312 bp, Glycine max
  Peptide Sequence Number=SeqID_141803
atgtctcctccacctctaggacctcacaatcactcacaaactcatctcaagctcttaggacgacttcctcttcaaactcgattctctgcaggtggctttgttcgtgcttgcacgcttagcgcaactctggaccgcttagtgctcattagtggattttggcttaacacatgcttttctcgcttagcggatggactgaagcggtgcgcttcgctagatgacccttcgcttagtgcaaatgcacaactcatccttcttccagattcttcctcgcgcttagtcgaggagtgttgcgctcagcggatggctcgctaa

SEQ ID NO: 50119 - DNA, 390 bp, Glycine max
  Peptide Sequence Number=SeqID_141804
atgctggcaaagtttgatatcgcagaagctccaaaggtgaagatgaaggatgttgttacaaaatatggactagatcatgaagcttggaaacaatttgaagcaacccgactcacacctaactgggagggtattaggaaacgagcacaatcaattcaaaaacacaacgactgccctcacgtactttcacgtgggggatatgatttgcttgagaagaaattgttagacgagaaaagaaaaaggctacaagaggaagcattgttgagtgaaaatccagcaagtgttgatgaccccccatctccaattaaaagacatgttaagtggaaggttgctcggaccagggcttttggcaatatgacatctgagtcggcacaggaaatagcagataaaata

SEQ ID NO: 50120 - DNA, 628 bp, Glycine max
  Peptide Sequence Number=SeqID_141805
atggataatgaagagggcgtgcaggaacagatgaaggccgatttatcggccttaaaagatcaaatggcttccatctcggaggtcatgttaaaactccagaaaactatagaggataaagccacggcaaccgcctccagtacagttagggaagtggagccggtgctgcaacccgccttaaatccgggccgagacagaaacacggcagtgtttggtcgaaggtatagcccgcaagcttatccttatggcttgccttcggacttcactccccgtgccaccccggaagatttaagccaagcctctacttttgaggggcaactcccgccttatgacgactatcccgagcaagacgatgaggaaggagatacccatcttggccccctgctccacctcaaagatccgtccccacatgaactaccccaaccgaacatagtccgccatatcccggcctcacccacacccgtaaaagaatctgttcccttcgcggaagataagggaaagattgaggcgcttgaagagaggttaagagcagtcgagggccttggcaattacccattctcggatttagcggattatgtctcgtgcccaatatcgtcattcctcccaagttcaaagtaccagactttgataa

SEQ ID NO: 50121 - DNA, 648 bp, Glycine max
  Peptide Sequence Number=SeqID_141806
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatcaggtaggcggccgtttcgccggccgcgcggttatccatgcccacatagctgcgccgcgccgagcctggcaagtccgtcaccagggtcaccatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 50122 - DNA, 770 bp, Glycine max
  Peptide Sequence Number=SeqID_141807
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagtcacgacgttgaattcgatgggtgatcagtgcagagatatgtcacaatgcccccataggcagatccaagacaagagtccgtcacctgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50123 - DNA, 510 bp, Glycine max
  Peptide Sequence Number=SeqID_141808
atggtctctggtaatcgattaccaggcttgaaaacgaggcttagaaatgggactggacggctatggaggcctctgagggataggccactggtaatcgattaccagatcgtgatggcggcgcagctaatccatgatcgagtggagatggagtgcctagagggagcttgggagaccctcgaaggcaacacgaggtgccgatttcggggcacgattcgatttacggctacttcattggtgcatccagatgaacccgcgcgcatgcttcagcgtactgtggagtggatactacccacgcctacaccataccgtctagtggagccagtccaagtgattgaggtgacgtcatccgaggaggaccctgaggaggatctcgaggagctacctcctaagcctgctgtggatgctcttgactttctagagggtgatgaggacccactccctgaggtggattctcccgaggacatcatgtcagcatccgaggcagactctaccgaggatagtggcccttga

SEQ ID NO: 50124 - DNA, 234 bp, Glycine max
  Peptide Sequence Number=SeqID_141809
atgttgtgtcgtgacgactcccgcgggacaccgtctccgggcccccgggagtcgcacttaacagatttgagttccttggcgcacgaagcgccggggtttgtgtttgtcgcgaggacgaggaggccgggcgcacggggcgccgtgtcatcccctccctcccgacggaagatgaataaacaagttcgcgggttcacctacggaaaccttgttacgacttctccttcctctaaatga

SEQ ID NO: 50125 - DNA, 275 bp, Glycine max
  Peptide Sequence Number=SeqID_141810
accttgcaccttacgcttcagagccctacaatgctcaatggaacgccccggggcttctccgtgacaagcacacgttgcgttcaagtcgtattctcggagaaatggaggttgatgaaccttggatagggctttctcgctgcaaaattcatttcttggttggtgttcttgactttgtggttgatttagggatggcctttgtggataactgggcggtgggtaaggagaagacccactttgatcctttcgtcggtgaagaccatatcatcaaagcttga

SEQ ID NO: 50126 - DNA, 96 bp, Glycine max
  Peptide Sequence Number=SeqID_141811
gatgatgttggtcgttcggtgttgatcattttcaaaatttttgcaagttccgctagcggggatattgactggccgaatgatgttccgctcgaatga

SEQ ID NO: 50127 - DNA, 1005 bp, Glycine max
  Peptide Sequence Number=SeqID_141812
atgccggctgactgggaaaacaaaaccagccagttcattcgcgatctgcaggctaacccgcagaaaatcgccagccgcaaagcctcacagaacacgctggaagccttcggtaaactgctgccggagttcctcggcggttccgccgacctcgcgcccagcaacctcaccatctggtccggttcgaagccgatcaaagaggatcacgccggtaactacattcattacggcgtacgcgaatttggcatgacggccattgccaacggtatcgcgcatcacggtggctttgtgccttataccgccaccttcctgatgttcgtggaatacgcgcgtaacgcagcgcgcatggccgccctgatgaaagcgcgccagattatggtctacacccacgactcaattggtctgggcgaagatggcccgacgcaccagccggttgaacagctggccagcctgcgcgtgacgccaaacttcagcacctggcgaccgtgcgatcaggtcgagaccgccgtggcgtggaaagcggcgattgagcgccatcacggtccgaccgcgctgattctgtcgcgtcagaacctgctgcagccggagcgcagcgcgcaacaggtagagaacatcgcgcgcggtggctacatcctcaaggattgtgacggcacgccggacgtcatcctgattgccaccggttccgaagtggagatcacgctgggcgccgaagcgaaactcagcgccgacggccacaaggtgcgagtggtttcgctgccgagcactgacgtgtttgataaacaggacgtggcctatcgtgaatcggtgctgccttccaacgtgcgcgcgcgcgtggcggttgaagccggtattgccgactactggtacaaatacgtcggcatcgacggcaaaattgtcggcatgaccaccttcggcgaatcggcgccagccggcaagctgttcccggcctttggctttaccgtcgagaacgtggtgagccacgccgaatcgctgcttaaacctgcctga

SEQ ID NO: 50128 - DNA, 405 bp, Glycine max
  Peptide Sequence Number=SeqID_141813
atgttgtccttcagccagatgcagtccttgtttcagtcacggatgcaatcacaggaactagcactgcctcctgagcctgaggttggtccttcagctgctcgtgtcggtacaaataagagttgtgttgattccttagggaatgatccagacatgggtgacttagacaaatgcgggttgtacatcgaagaaaatcctccccgcctggtagccctaagaagagtttatgagggatccacaactgttcacaacattcctttgttgcatgatcaagtgaaggttggtgttgaggaggttaaagatgcagatgcttccattcctgtacccattgaagatgttaaggagctgtgggaccagcaaaacctgcagataggccggatcatgaggtcgatgatcccctatatctga

SEQ ID NO: 50129 - DNA, 309 bp, Glycine max
  Peptide Sequence Number=SeqID_141814
atgggggacagggggaatagaagccaagagctaaacatatgcatgggtctaccctccaactcctacgttggcgtgagtggtgggatgataaatggactggtcatctgtgaagcttttagttgctttctttcttctgaccgactcttcctttcggtaaactcactcctcgagggctataggaaaagcgaccttgataatgccggaagtggcgaacaagtaataggaggaggcgtggcacaagaagtcaatctaatctttaataaagcaaggacttcttcttctatacccggtcatccttatataggatga

SEQ ID NO: 50130 - DNA, 1042 bp, Glycine max
  Peptide Sequence Number=SeqID_141815
atggataagaagatccgcagtattgtgagtaacattctgaaaaatgcctcggttcctgatgctgatgaagatgttccaacatcttccaccccaaatgcttctgtgcctgatgttgagaaagatgttccaacatcttccgctcctaatgctgaagccctcccttcacccagtgaagaggaatcaacagaagaagatgatcaagccgcagaggagactcctgcaccacgggcaccagaacctgctccaggtgacctcattgacctagaagaggtagaatctgatgaggaacccattgccaacaagttggcacctggcattgcagaacgattacaaagccgaaaaggaaaaacccccattaagaggtctggacgaatcaagactatggcccagaagaaaagcactccaatcactcctacctcatccagacgaagcaaagtcgcaattccttccaagaagaggaaagaaatttcctcatctgattctgatgatgatgtcgaactagatgtctcgacatcaaagagggccaagaaatctgggaaaaaggtgcctgaaaatgtccctgatgcaccattggacaacatctcattccactccattggcaatgctgaaaggtggaaattcgtgtatcaacgcagacttgccttggaaagagaactgggaagagctgccttggattgcaaggagactgtcaccaagttgggagattgctatgagagtctagtcagggaattcattgtcaacattccctctgacataacaaacagaaagagtgatgagtatcaaagagtgtttgtcagaggaaaatgtgttaaattctcccctgctgtgatcaacaaatacctgggcagaccaacagatggagtggtggacattactgtttctgagcatcaaattgccaaggaaatcactgccaaacagatccagcattggccaaagaaagggaagctgtctgcagggaagctaagtgtgaaatatgcaatcctacacatgattggagctgcaaactgggtacccaccaatcatacttccactgttgccacag

SEQ ID NO: 50131 - DNA, 108 bp, Glycine max
  Peptide Sequence Number=SeqID_141816
atggttttcggggcttccgtggcttccgtaaaatttctgaaaaccttggctatttggggcaaaaaacacgttttcgtgaagaaaaatcgagtcgaagtgcttccgtaa

SEQ ID NO: 50132 - DNA, 753 bp, Glycine max
  Peptide Sequence Number=SeqID_141817
atggcccagtctaactcctcaagactcgggtttcctgctcttatcacagctttatgcaagactagaggagttgcctccgacactcttgtctttgaatgtctacacccggtcattaatttggcctacataaggaagaattgttggaaccctgatgatccaacaattattattaggggggccaaaagaccaagggcaaggccagttgaggctccttctacatcaacaactcctcatctagcttctacatcagaagctcctcctccagctcgtattgcagcagctccttctaccccacctcttgggcagattattttgctgcaaagtctccagctggtagcacctccagactccatccctacagtagagaaatttaatgaatgggtagcctggccagggactcagcctcctcctcacagggacgacgcaaatcccgctgctcaggtaccacatcagccatcgaatgagtcatcagagtcttccactcctaagcccttgatcaggaaaaggagggtagttgtaactcaggaagccgtagccactcctgaaaagtctcctgaggccactccagagcctccgacaccaatggcagataccacttctccacagcaggcagcaaacccttccacacctgaggttcaaaccaccccagtcctgtctttgaacacctctcctgtagctactcctgtactgcatttgattgacgacgaggaggttcaaacacaggatactcaggaccaatcacaagatttttaa

SEQ ID NO: 50133 - DNA, 306 bp, Glycine max
  Peptide Sequence Number=SeqID_141818
atgggggagacacatgaaattccccaccacaatctagccgacttcgagccttgcctcggatatgccactgaagggcaagcagttggtgaaatgggaaagttggatcatatagaggaaaggctaaaggtcgttgaagaaagtggaggttatgcctttgctaacctagaagagttgttcctggtacccaatgtcgtcacccctcccaagttcaaggtgtcggactttgacaagtacaaggagactacttgccccaagaaccgtctaaaagatgtattgtcggaagatgggggcatacgcaaaagatga

SEQ ID NO: 50134 - DNA, 114 bp, Glycine max
  Peptide Sequence Number=SeqID_141819
atgaagatgctcttgataccatatgatatgaatggcagcaaaatggagaaggaagagagagaggagacgccacttcaaggagaagatgagtctagaagatgctcaccaccatag

SEQ ID NO: 50135 - DNA, 103 bp, Glycine max
  Peptide Sequence Number=SeqID_141820
atgtggaatcgccacaggcttaaaggagaattcaaactggatgtatttacccccaaggcctacactccgaagagtccgtcaaggcctctccctcctgattcag

SEQ ID NO: 50136 - DNA, 213 bp, Glycine max
  Peptide Sequence Number=SeqID_141821
atgatagctaagaaatacttcgtggttgggcagaaggttttattgtataactctaggctcggactcatgagtgttgagatcaaaagtgaatccacaaataagagcttcaaggtcaatggacaccggctgaaaccattcctcacaaatccttctttagcggatgtcgtagtggaagagacctccttactccacccgacttctcttccgccatga

SEQ ID NO: 50137 - DNA, 292 bp, Glycine max
  misc_feature (257)..(257): n is a, c, g, or t
  Peptide Sequence Number=SeqID_141822
atggcagaagagcatgaccagaggattacccttgaggattactcaagtagttcagcaccacaatgtttcaccagcattgcacgtcctgaagtgcaagctaacaacttcaactacccacattccttaattcatttaatacaggggaacttatttcagggattacctatgaagacccctatgcacacttggaaacattcattgaaatatgcaacactgttaagattgccggtgtaccagatgaagccattaggctcagncttttctcattctcgttggcaggagaagccaagag

SEQ ID NO: 50138 - DNA, 96 bp, Glycine max
  Peptide Sequence Number=SeqID_141823
atggccccctacagcgacgttttccgcttgtccagcgccgggaaggacgacgatctgtcggtcgtgaccctatcctccatttgcatccgtccctaa

SEQ ID NO: 50139 - DNA, 439 bp, Glycine max
  Peptide Sequence Number=SeqID_141824
atgttggtgcgcatggtccgcactcttctctttgcagcggcacgggtgaaatcttgccccagtatgcatagtagctgtgtgatagcctccctctctggttgtgctcgcacagttggccatcctccaatatcaggggggcgtgcaaccctctgttggcaaggacgtgtagtcctcttcaaggtgagggcgtgcagccctctgttggcgaggatgtgtagtcctctcaaggtgagggcgtgcatccctctgttggcgaggacgtgtagtcctcttcaaggtgagggcgtacagccctacgaagggcgtgcagccctctgttggcgaggacgtgtagtcctcttcaaggtgagggcgtgcagccctctgttggcgaggacgtgtagtcctctcaaggtgaggacgtgtagtcctctgacgatgagggtaactagtacccaag

SEQ ID NO: 50140 - DNA, 273 bp, Glycine max
  Peptide Sequence Number=SeqID_141825
atgtggggttaccgtatggttacccgcactttcgtcaacccaggggcaaacgagcctattgatgcgcagagactaacatcgtcttctacgcctttgccattcagggacagcgagtcaggtggcaggcggagataccttatggtcatccgcacctttcatcaaccgaggggaacgaattcgacggttttactctcgtcgtccggaaacattcaagcccgacgatgcgcgagattcttctttgctgggcgggggcaatcaagtgcgatggcgtaa

SEQ ID NO: 50141 - DNA, 279 bp, Glycine max
  Peptide Sequence Number=SeqID_141826
atgtcatcggactcacagtctctaccggaagatgctgacatctccggaaagggtgcagatgaccacattggcctctgtttgtcaatcgaacatgggtctatgaatgccgaggtgcagataaccgtaaggtgtctccgcatgctactggagtcttgggccatgatagcaaaaggtagggtggtcgacaaaagcgaggcttttgctcctaagtatcctcaatttgtgatgaggaactcagacctatgtagttcttgcgaaagcggtgtgagactaaaatag

SEQ ID NO: 50142 - DNA, 81 bp, Glycine max
  misc_feature (45)..(45): n is a, c, g, or t
  Peptide Sequence Number=SeqID_141827
atggtctttgttattttcccgattgattccttcgccaaacataanaaagaaggagtagagacgagagtcatcatagactaa

SEQ ID NO: 50143 - DNA, 468 bp, Glycine max
  Peptide Sequence Number=SeqID_141828
atggtgaaagttggaacctcttacgtgccgatcaacgtctcattttcgccaaaagttggccccagggcttcccggtatcaacagggacaccaggatttatttatttgcctgaggagtaacgacctgcgcttccgtcacagcttattcggcgcaaaccgtgcgtcgagggctgtcctcctgttcgtgaattgttatccgcgtcacaattccacacaagcataccagccggacatcagcgctggcaagtgtaaagccggggaacgggcgatcgaggcggcctttgcgtattgggcgctagcggagtgtcatactggcttaatgttggcactgatgagggatggatccaccgcggttggcggccgctctagaactagtggactcctacgccgggctgcaggaattcgagtcggaggcctcgaacggggcggagatttcctggaagatgccaggaagatacttaacagggaa

SEQ ID NO: 50144 - DNA, 153 bp, Glycine max
  Peptide Sequence Number=SeqID_141829
atggttacttccatacttcaacttgactcgatgaaccttttcgtaaaagcacgagcttggttcaaccccataacccagggaatgaaatgggtttatgatcccaacatggttggctcatggtacctaacacatgcaactaagaatgcatcatga

SEQ ID NO: 50145 - DNA, 615 bp, Glycine max
  Peptide Sequence Number=SeqID_141830
atggctttgctgaccccggaagagtgcatcgtccattgccgggcagagccggacgatgcgccgttgctcgcatcgcttctggcctccgctgaaagcgcggtcgccgggcatctcaaccgggcggtattcgccagcgcggcggaacttgatgccgctctcgatgggctgcccgatgccgctggcgccgcgcaggacgcgtatgaaggtgctatcgcccgcgcggcgtcgttggatagtcccgcggcgcgagatatggctatcgaagtagcccggcagcggcttgccgaggccgtccagtccttcaatcgcacactgcatgggatggtggcgacgccgaggatcgaagcggcggttaggctgaccctcggcagcctgtatgcgaaccgtgagcaggttgtggtgggggcgactgcggtggagttgccccagggggtagcaggggcgttcaatcggcttgtaacggtatttggtccaccaggtgcccaagacagttgggggcaccccgatggggcccggcagaatctcggcacactgtgggcgaatgtggggcggctctccggtaaggctctcatccgcgccggagggcttcaggcagaagtcaccacgagcattcgc

SEQ ID NO: 50146 - DNA, 357 bp, Glycine max
  Peptide Sequence Number=SeqID_141831
atggtccatgacatctttctaaacgtgaagttgggagtaacaaggatatcaacaatcctaaacgtgtttggcagtagtcgaagcaatgatgtaacacgatccatcttttgccccaatctttgcaagatggttacttccatgcttcaacttgactcgatgaaccttttcgtaaacgcacgagcttggttcaaccccataactcagagaatgacaattttgatcgccaatacttcaacaacatttcatagggatgaaagactcgagaatacgcatgctcgcatggaaaataaatgggtttatgatcccaacatggttggctcatggtacctaacacatgcaactaagaatgcatcatga

SEQ ID NO: 50147 - DNA, 482 bp, Glycine max
  Peptide Sequence Number=SeqID_141832
agctcttttatcgcggaattagacctgctattaacgtcggcttatctgtcagtcgcgtcgggtctgccgctcagttgaaagctatgaaacaagtctgcggtagtttaaaacttgaattggcacaatatcgcgaagtcgccgcctttgctcaatttggctcagaccttgatgctgcgactcaggcattactcaatagagtgaagtattcgttttcatcattttttgatattgatacgctccttgcttttttcacgcccgccttttgtatggacgacgtgggcgccagctcacagtcgtccttgcccactgtgaacccaacccctgacccagccgccccagcagagcctcaagcccctgaccctgacctttcccttcctttactggatgacaacgctcgtcgcgccgaactaaatgagcgcggggggtttcttcattttggggacttgtcggatcagcagaaagacaaagtgctaaacgcacaa

SEQ ID NO: 50148 - DNA, 84 bp, Glycine max
  Peptide Sequence Number=SeqID_141833
atgaaatggagcatgaaacattccttgcaacttgataatcagctttgcaaccaatattttaagccaacatataaattgatttag

SEQ ID NO: 50149 - DNA, 597 bp, Glycine max
  Peptide Sequence Number=SeqID_141834
atgccatatgtggaagccgcggaggagtcattagaaatagccttccaatcttttgaggtagtaagcattgcctccgtagattccttctttgggcaaccttgcatgttcgatacggcaatgatggtggcccgggtgatgttggggaatggttatgaacccggattgggtttaggcaggaacaacagtggcagaaccagcctgataagcaccaaaggaaaccgtgggaagtttgggttaggctataaacccacgcaagtgaacataaggaaaagtgtcgcgggatggaagagcggaagccaaggttcgcaattgggacaaaaagtcgaagggggccctccctgccacatcagtaggagctttataagcgcaggtctaggacactgtcgcaacctacccttttgcgggcgagcgaggcgaggctcacgggtgcgtcttccaaaggaggacaaatgcgcggagtcaccaccaacatttatttgtggaaaacatcagaaaaaccgaaggaaactggtcatgaagaatattccagattcgggagttgtatttacgtttgaggaaggtattagcacctctcatgtttgtcccaaaggacaatag

SEQ ID NO: 50150 - DNA, 515 bp, Glycine max
  Peptide Sequence Number=SeqID_141835
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 50151 - DNA, 372 bp, Glycine max
  Peptide Sequence Number=SeqID_141836
atggcacccaccaggcactctctggacccggataagtccaacagggccctgaggtttccggcgctgatcacgggcctctgccaatccttcggagttcccgtcacccccagtaaagcggccaaccaccgtgggcaggtgcagatacatgagtgtctctaccggttcagcctcagtcagcaggggcagggttccgctccttttgcatgccctactccggagcagtttggggctgaggtcgcatggcctggagactggcctgaggcccaggcaggggaagagtctgcaggatccctcggtgaggcagatgaatcccatatggatgaagagatgattgacctgctcggtttcttgggagggagcggagccacgtga

SEQ ID NO: 50152 - DNA, 360 bp, Glycine max
  Peptide Sequence Number=SeqID_141837
atgccctatagatctattacaattcctgcccttacagaagcacttcgactgggaacaccctggcgttacagtgccaacttaacgccttgcacacatccccctttcgccagctggcgtaatagcgaagaggcccgcccgatcgcccttcccaacagttgcgattcacttgaatgcagcgaatggcagacagcgttccgactggaaagcggcgcattaagcgcggaacgggatgtaggtggttacgcgtcacgtcatggcaccccggctttacacttgccagcgctatgttccggcgtgtatgcttttgccgaattgacggataacaccattcccgtcatactgaacaggaggaacagctga

SEQ ID NO: 50153 - DNA, 210 bp, Glycine max
  Peptide Sequence Number=SeqID_141838
atggtgcatccgggaggattcgaacctccgaccgctcggttcgtagccgagtactctatccagctgagctacggatgcatcggaaaagctagtttactacagaataaatccgaatcaggtatgaaggtgcatccgggaggattactcggctgcgcctcgcccttcgggccgttgcttacgcaacgttatcctccctggtgcttgcgataa

SEQ ID NO: 50154 - DNA, 411 bp, Glycine max
  Peptide Sequence Number=SeqID_141839
atgttgagtcagcatcccaatatgttaaactacactgactctgtgatgaagagagaatctcctctatccctgcattacaaactggttgaagggacacatgtcccagacattgtctcgacatctgtctcgacatcagggaaagctgctgcttcaggtgctgtgtccaaggatgctctgattgctgaactcaaggacacatgcaaggtactggaagcaaccatcaaagccaccacagagaagaagatggagctagaactgctgatcaaaaggctctcagagagtggcattgatgatgaagaagcagctgaggaagaaggagaagcagctgaagaagaagaagaagctgctgaggaagaggaagatgcagcagaagagacagaatccgatgatgattctgaagccaccccatga

SEQ ID NO: 50155 - DNA, 204 bp, Glycine max
  Peptide Sequence Number=SeqID_141840
atggtggatgcagcaacaattaattattttgcactcttccatgatattgctcctccgactaagagaaatacaaagccaagagtgaattttcttgtatccacacatccagcaaagtctgagtctggatatccaatcacctcaagttgcaaagcttatgtctggtcaagtacagatctgggcatacataatactcccaacaactga

SEQ ID NO: 50156 - DNA, 192 bp, Glycine max
  Peptide Sequence Number=SeqID_141841
atgcatctacttttcgataactcattacttagaaacttcatagttaagcatgctcgacttgaagcgattatgggatggtggccttttgggaatttttttggcaagcatcatgagctgataatcgaggtctcaaaaagggctacttacaaagggttcaaattggtgaaggattctgaccaacaaggatattaa

SEQ ID NO: 50157 - DNA, 288 bp, Glycine max
  Peptide Sequence Number=SeqID_141842
atgggtagaaagaagctggagattggttttgaagatcagaaaattgattttgatttgtttgttgaaaacaagcctactccagaacaaaatgtatgcttacagagtcctttcgctaagcgcaagcctcacgctaagcgcatctttggtcatgcactaagccgcaagtctcaagcgcttagcgctcaacccttgcatcttaggctgatttggtctactgagctggccgcggctgagctaagccaatttcaattcgatttgaattcgactatgcgacggtctgacctctaa

SEQ ID NO: 50158 - DNA, 240 bp, Glycine max
  Peptide Sequence Number=SeqID_141843
atgcctatgcaaccagctcgcttgggcgagcttcaaccgccccaaaatggatttttccctctaaatagtcatgttggggggtttaaagggttggaaggtttagaagttgagagaattgagagaaaagaaggagaaagagagaaagaagaagaaacgaagctgaggcactaccgaatcacgaccgtgatcactccctacatcgttctcttgttccatgttcctcatgcaacagtcaattag

SEQ ID NO: 50159 - DNA, 435 bp, Glycine max
  Peptide Sequence Number=SeqID_141844
atggcattaggggtcatggcagctcgcccaggcgtgctattgcttcaatctgatgtaaccttgctcgcccagacgagctgggaagtaaagataaggacacgaatttcgtttgagcgatcttgctattcgatcgtgtcgcaacctaccctttggcgggagggcaacgcgagggctcacgagtgcgtcttccaagggaggaaggcgcgtggagtcgccaccaacgtttatttgaggaaaacgtcagaaaaatcggaaaggtgtgatctacaaactttaatcgtgaaaggttcgggagtcgtttttacgcacggggaagggtgtttccctcactcctacgtatcctcaattgcgatgaagaagtcagacctacgtagttctttcataactagatgtttgttaagttgttttgatctttttccgcaagatcaattttaa

SEQ ID NO: 50160 - DNA, 768 bp, Glycine max
  Peptide Sequence Number=SeqID_141845
atggtcattgaccaatccctattctatgacttgacccaattatctagtgagggtgtaccatttgaaggtgcactaaatgatgattggaaatttgatttctctgtgcatgatgcccgctggttggtttgtaccaaccaagcggatatgactggaaggctacttgctggatcattggcttttgaaagccgtatccttcactatctcattgtgcatattttacttccaagatcttcaaaccttgcacaggtttctgaagaagatcttattgtcatgtgggcttttcatactggccgacaaattgattgggcacacttagtccgatatcgcatgcataaggcattgcgattaaatgctccattgccatatccacatctagtcactctcttccttcaacactttaacattcctcttgattctgaaccttatgttccaatcaagagatcctttttgattggtgctgctgtgattgcatcttttggttaccgcaaagagcatgatggctcttgggtaaaaaagggtgctcaacccattgatgatgaaggaaacttaccagttggagaggattcctctctccttcagaaaattttggacaggttcgatggtcttcaaacctatgttggtgaaagggttgtcatcatcaaaaagggggagattgtagaagcaagcttcatgatgatgaatcaggttgattcaagtagttttgatgatgacaaaaagcccaagagaatgatttcaagattgagtcaacaagttcaagatcaatattaa

SEQ ID NO: 50161 - DNA, 553 bp, Glycine max
  Peptide Sequence Number=SeqID_141846
ccaacaaggacagtgtggatgacactgtttgcgaaaaatatggcattagcaaggaggacgtgtggaaaaaggcacaggccatccaaaagcaaaacactgtcccccacgtgttgtctcgtaggggttatgaatatttaaaacagaagctgatggctaagaagacaaagaaaaaactggaggaagttgctcaatccagaagcactgaggccatgattgaccctccatctcccatcagacgacacgtgaagtggaaaatggtctgcaccaagaaaactggccaaatgacgtctaaggcagcaaaggaaattgttgagaagattgattcgttggaggagcaggcaccacagggttcctttgtcccccatggacgtcaggatgtcttgactgttgccattgggcgaccagaacaccctggtcgtgtgcgtgctgctggagccggtgtgaccatcaagcaacactatggatcagctccacgaaccgcccgcacttcttcctccatgactcccaaagaactagagcagttgactcaacaaatcagggaccaactggagga

SEQ ID NO: 50162 - DNA, 917 bp, Glycine max
  Peptide Sequence Number=SeqID_141847
ggtacatctacttgggtttgactgagaacaagagaggatacatctcttgtggatcagttctagtggagggtacatccactaggttcaaagagaacaagggagggtacatcccttgtggatctttgcttgtaaaaggatttttacaaggccactcgatccaacatcttgaagagctcgttaggattcttaaagtccatgagcaagagtttgcacaagatgaaggaacaaagaaagggaagttgctagcccttacaactcaaagaccaaaacgtagcactacgtccaaagagtcattgtccaagtcccttgtcgtaagtgacaccttagaagaagaatctgatgatgactctgatgaagaagattatgagctgagtctgatcacaagaaaagaaaagaagaagaaattcttcaagtccaaaaagaagagcctcatgagcacttgggaggacctaaatgattacttttctaacaaagacagtgaagaagaagccaatctatgtttgattgatgatgcttccaccagtaaagcaaaaccagcattggatgcaagttcagatgatgaggactctcagtctgatgacattgtcaactctaattgtgaagaggatctcaaggaagctcatcaagttcacttagttgattttgtcctggaaaccacttcgcctgatagtgcacaagatgcctctatttgtgagaaagtcaaagcactactagatgaaaaggtatccaatggacacaaaactcttcttaaggattttcaagacttggaggaaaaggtaaaatccttagccataactcttgaagattcagaagaaggacccaaggaaatgtttaaacaaaaactcttacttaaaaaagaatgcatccttgctaatgatgaacttcataaactgaaaaagaaggactcagatctctga

SEQ ID NO: 50163 - DNA, 558 bp, Glycine max
  Peptide Sequence Number=SeqID_141848
atggcagtatgtactttgtactatggggtgtctcacctggttgggaactcccttgtggcccaagctgatcaccgaagggtgggggggagttacggtgcacgactaggtggcctcgacaaatactgcatggctattcccttggtattggatacagtatgtatcgcatttcatctgagagttaaggtcagtattggttctttttataatgaaatcacccttgcaattttgtatcatgtggttgatacttgtgatgatcgcgagccttgttcgtgggagcaggatgacatcagtagggtgcaggaaagtggtgatatcgtagcgacgaggcgggtcgttacaatgcctataggttggacttcccagaacagtgaagctgatattcaggaggaggaaccaatagatttgaagtcaaatcctcttcaagggggaggggatgatgcaatcctccctaggaagggaccagtcgcaagagccatgagcaagaggctccaagaggattgggctagagctgctaaagaagaccctagggttctcatgaatctcggggtagatttctga

SEQ ID NO: 50164 - DNA, 429 bp, Glycine max
  Peptide Sequence Number=SeqID_141849
atgaaatttgtagattatccttccaattacctgggcagtggcgtgctcgatatcctgaaccgtgataggatactccgatatcacgaaatccccgctgcggcagctcggggtggtcgctcacgcgccgccgcatctcctccggcagcagcgccaacagccgccccagctccacgtccagctcatcctcggaaaaaaccggaccggacccggctggaaaactcgcgcgcaggctggggccggttcggagccggggaagggagggaacgaggggcgggtagaagggtttgggcgaaatcgggttgggaagtggcggttgttgcgggaggtggcagcagcgaagctggagcgggagagaggaagcggaatggaatcaggaatggggtagcagatgtggaggaattcgaatattcgattggaaccggaatatga

SEQ ID NO: 50165 - DNA, 240 bp, Glycine max
  Peptide Sequence Number=SeqID_141850
atgtcagtgaaaaaccttgtcgagcgcctaggattacatgacaagatagatcacacattacacgggcatgctcatgcaactcagcacgatcatgctcagggagcacgaccatgctcacacggtcaaggtcaaatcatcaatgtgcctaagcataggcatgctgctcatcaagcacaagcgtccttgatgaacatgatgataagcacgggcgtgctctcatcatcacaacttcagaaatag

SEQ ID NO: 50166 - DNA, 465 bp, Glycine max
  Peptide Sequence Number=SeqID_141851
atgtggaggtcaaaatcaaaggtgtcgaagaggtgcttcatcgcagagatttttgagctgaaagaggacgaggaagaagagaagttgtcgttggagttcgagaagatgctaaaaattttgtcattcgacaacaaggatttctcccttcaccagtatcccaaattcgtgaatattaatcagtgcacgcttcgtgttcgattaattgcctctgagcctaacttgcgttcatgcttaatggacgaagggctaactggtgcaagtgacattgccatgacattggaggtgaacgctgagagctgcttacacacgaagctccattctagagtcttgaagaatcagtacattgctactgagttgttcaccgaaatcgcaaagccatcaaacctagaatcacaaaggcatcaaagaatgcaacaacaagccacatctacaatcaacgttaacgaaaacgaagataacttgacg

SEQ ID NO: 50167 - DNA, 219 bp, Glycine max
  Peptide Sequence Number=SeqID_141852
atgaggccgaggcgctaccaaattgtgaccgtaatcaacttctacatcgttcttcgtttgtcattcggtgcatggggtgctaataccttccctatgcataaacaactcccgaaccctcactttcaaaattcccagaccttcgttggtggcgactccacgtgttttcttcatgaaaagatgcacctttgtatttcgccttgccctcccaccgaaaggtag

SEQ ID NO: 50168 - DNA, 456 bp, Glycine max
  Peptide Sequence Number=SeqID_141853
atggaaattagactgagaacaaagatccaattttggaggttggcgaagaaggaggaggagatggacgttgctagagaggctaggagaaagtttggtgatgagagttctggtgacggtgaatccaaccatgaaggtcccaaaagccaagtccccaaaaagaagcgacgtcttggctccatgtaccacggtgcgacagtggacgagcatctcctcgagcgtgatggggagcgtagtgtcatcatcgtggaccaccattgccgtggagttgccaacgagacagaagtagatgttgacggcgcggtgcttctgccgcaattggctcatcttcacacgcttaagtcatccatcacacacacgaggtggaagatgaaggttaaggagaagaaggagcgaaggggaatcaaaatcaggcatttcattgcgaccaaggtggaagatgcagaaaccctaccatag

SEQ ID NO: 50169 - DNA, 492 bp, Glycine max
  Peptide Sequence Number=SeqID_141854
atggctacttcaatgaagctaaggcagtttgttctcttgctaattgttttcacattgcttgtagtgagttcagaagcaaggctagtccctgagttctcaacattgatcagcaaaaagattaataggaaacttggtttacgtgaattgatcaacaatgtacgaaatggtgatgagtggcaccaaaagaggtcaatgctaggtggaagtgacttgattgttgataacgagggatcagattgcactgtcataatcaagggttctaccttgttgattgagtatgatgtgaatgtgggtgatcttttggttatgggatatgtggattattttgactatgttgatggtttggatgataggagatttacaatatacaagatcatggagttaatggcatctggtcaaatattaattatgaagattcacacttttgataatgcatatgatgtgttaatcgagctagttactacgggcaatctcaagaattgcttggactag

SEQ ID NO: 50170 - DNA, 438 bp, Glycine max
  Peptide Sequence Number=SeqID_141855
atgaatacgaaaagaattaatttacaagcatatggagatatggacagaatgcaaactcagatgtatcaacatttgaaattatatccagaagatgaatatggcccccagtctatgaagaaacccgtggttgttgaatcttataacgagattgttttccctgaaccctcagaggtttttcttgcacgtgtacaaaatcatcctgccgttaatgtgcctaggcttcctgctggtttgaatttatcatgttctgtaccaagcgatgttgtgaatgatatggagagaggtgacaccaaagatcatcctctaactcaatggttcttaaacttctctgaggatgatgagatcttaaaacttgcagcagctcgccagcagctatggggattaccatctaaaagtaaatataatcaattcactgatccattcctgatgtgcaactaa

SEQ ID NO: 50171 - DNA, 330 bp, Glycine max
  Peptide Sequence Number=SeqID_141856
atggcagagtttgattatagaatggagttttaccaatggataacgggcagagatcatagctttactaacttctacagtccatacatatgtccgtttggttgctggaggtcttccacatgtttgagaatcaaggggtggcatgaagtgtacattgaagatccagtttttgtcaaaagcaatatcaataaacttcaccgacaccaacaattctcgcctgcacttggcagaagtgctgcaattactgggacttacagtgttggaaccgatggaggattgttaactcatggcggtaatggtgacgcctgttggagtggtttgatgagtctttag

SEQ ID NO: 50172 - DNA, 819 bp, Glycine max
  Peptide Sequence Number=SeqID_141857
atgttgaaagagaattgcacttatatgatgcacaattttaaagttgtcaagaatgatggtcaatgcagagtttatgtacaccagtataaattagtatttactggagtgactattgttagacaaactgatttgggtgatgcgcctttaagaatgcacaacttcattcaatttaacgatatcatttctggtgactttcagcatggcctatcggtaggcattgaggcccactcagttatgacacctcgcaatcaaacaagttcacaacttttaggttctagccaattgtcagcaaaggatgcatttttttataaagttgaggcaaagagcctttctaagattaacaacatgttagagggaccattaccagaattgtcatggaaaatcattcatggtgttatgcagcttgcatccattgttacaagaaaactgatgtatagacttgaggtcatggttaaccacaaggaggaatgcacgaaattcctgctttgggaccgtgaatgcactgagctaattagtcaatcagctgatgaagttaataggttaaagatagcattaaagttcagccaaaagttcaggaattctgttgtgctaaaatactcatctgactcatatttgattaagaccatagcagacttactacctaatgctgaggcatcttgcaagacccatattccactccctgattccaatgattctccctgctatgagattcaatccctatttgcaacagcagatcatgatccgcttctcagagcccccattacaccaactaagcgacagacacctcagggatgtgacgatgaaccattgagttcctag

SEQ ID NO: 50173 - DNA, 354 bp, Glycine max
  Peptide Sequence Number=SeqID_141858
atggatttggtttcacataatttggacttttggaaatctacatatagaacaattaaaaaaagatacaatgtgtcgcaacgtgcccttcgagggcgagcgagggcgaggctcacgggtgcgctttccaaaggaggaaagatgcgcggagtcgccaccaacgtttatttgtgggaaacgtcggaaaaaccgaaggaaaccggtcaaaatgaaaattctaaagttcgggagttgtatttacgcttgaggaaggtcgacaaaagcggggcttttgctcctacgtaccctcctttagagaggaaatcagacctacgtagttctttcttatgcgtgaatcaagtgattctttttacttga

SEQ ID NO: 50174 - DNA, 681 bp, Glycine max
  Peptide Sequence Number=SeqID_141859
atgaaaggaactttttatccaaagctagtcaaggttttctacacctatgagcatgctgatcttgaaggtaacctcttctgtactataaatggagtagaaatggtcattgatgttgttgtgtggaaggaagtagctggtctacatatggttggagtccacaagtttgatgaaacgactgatgggtataacaagatgcgaacctataggagaatgcttcttgaccctactaggaacttaaggaattgcttaggagttggtggactgactgcaaaggatagaatgttaggttacctctttaccaacattctcactccgaggtatcaagatgaattgatactgctgattgaacacattatgctgaagagtagtcatctggtggattatgaatttccttatgttgtacttccatcaagattcattgactactttaatgttgatgtctctaatgagattatggactttaccaaagcatctagtaatattaccgaaaggcatctcaagaagcttggaatgaggtttgttgttcatgaatggataatggttggagagccaacagctggaaacattgaacaaatggaagaaaatgataaagttgaagctccacaagagcctggatatcaatggagtccttttgagtcactcatgattcagaagatggacactatgttccacctccattaa

SEQ ID NO: 50175 - DNA, 234 bp, Glycine max
  Peptide Sequence Number=SeqID_141860
atgcctagggttggctcaagagactatgtcaatgataaagatcgtttctgcatctataagatcatggtgttcaaggataggttcaaccccaaggtgaataagaaccatattccttatggaattttcttcacccatatcctaacgcttgttggagtggaggtttctttgatggagccatcatttggagcccctcagctaaaggggactacctttgtgaagatgggagttgcttaa

SEQ ID NO: 50176 - DNA, 231 bp, Glycine max
  Peptide Sequence Number=SeqID_141861
atggcagcggaatggagaaggaagagagagaggagatgcaacttcaaggagaagatgagtctagaagaagctcactaccataggaggtcatggataagagcttggaggaagaaggagatgaataaagggagaggaagagaagagcatgaaattttgttctctaaaagagctctaaaatctgaacccactaatccaagatcaattccaagattctccactaagtgtgattag

SEQ ID NO: 50177 - DNA, 432 bp, Glycine max
  Peptide Sequence Number=SeqID_141862
atggctggtcggtgggtccgtaagcaagatttgccaccacctattcccaacgagcgtacaccatctcctccaccacaacgggacacttcctcttctctgctgactaaagtcctcacagagttttgcgatcttcaagcatttgtggttgttttctccggacgtttttggctttttgatgttgccaaagggggagagaacttaagggtagaatttatcatcaatttaggcagaaactccaatcttaagggggacgagcatctgctaagcacgaggaagaatctagaagaagatgagttgtacaggttcgctaagcgcaccgcttcagttcatccgctaagcgagaaaggcatgctaagccaaaaatcactaacgtgcgctaagcggtccatatgtgcgctaagcacacaggcacaaacaagaccacctatttaa

SEQ ID NO: 50178 - DNA, 333 bp, Glycine max
  Peptide Sequence Number=SeqID_141863
atggggacgttggttattaacctacagttcaaatttaaagatgatccaacgattaacgaattcgggattgcggttttacctgaacagcacccaggcccacttgggccctccagaagattcctccagaaggcggttgcttctggaggaagcaaccctgctcgcctgggcgagctgggcggcaaccacctcccctattttgctataaataggggaggaaatgaagaaggaagggatcccaaccccttaggcacttctctctctttcgaatttgcttggaaaaatcgtttccgtgaagaaaatctaagccgaggcgcttccgaaacgtttccgtaa

SEQ ID NO: 50179 - DNA, 1317 bp, Glycine max
  Peptide Sequence Number=SeqID_141864
atgttagcaacaaaagttaaaacactagcaattttcagttccttcaaccaccccatgtcaatccaatctttgattgatcatcgccggatccaatccctcttcccaattgtgttgtactcaattctagtcttgggagctgcaaggttagtcctagatagtttgaagataagccataataatagctatgttttcaggctctatggcatgccaaatggtggaagaaacagtagattattacctgttgtggttttgccagaggaccgcattgaggaagattgcaatgtgtttgaagggacatggatgtgggacaatgtgtcctatcctctttatgaagaggagagttgcccttatttggttaagcaaaccacttgccacaagaatgggagacctgattctttctacaagaattggagatggcagcctagcggatgcaacctcccaagatttgacgctttgaagttgttgcacatgttgagggacaagagaatgatgtttatcggagactcattacaaagaggccaatttgagtctatgatctgtttgatacaatctgtaattcctgaaggaaagaaatccctcgagagaattccacctatgaagatcttcaaaattgaggagttcaatgtatcgattgagtactattgggctccattcattgtggaatccatttcagatcatgcaacaaaccatacggtacataaacgaatggtgaggcttgactccatagctaaccatggcaaacattggaaaggagtggacattttggtgttcgagagttatgtttggtggatgcacaaacctttgatcaatgctacatatgaatcgccacaccatgtcaaagaatataatgtcaccacagcatataagttggctttggaaacatgggcaaattggttagaatcaaacatcaaaccgctaactcaaaaggtctttttcatgagtatgtctccaacacatctgtggagctgggaatggaaacctggaagtaatgaaaactgcttcaatgagtcatacccaatccaaggtccatactggggcactggctcaaatcttgagattatgcagataatacatgatgcactacgtttactgaaaatagatgtcacccttttgaacatcacccaattatcagaatacagaaaagatgctcacacatcagtttacggggagagaaagggaaagctcttgacaaaaaaacagagagccaacccaaaagattttgcagattgtattcactggtgcctacctggagtccctgatgcatggaatgaaatcctatatgcatatctgttaaagggttatcaaaacttctcttga

SEQ ID NO: 50180 - DNA, 357 bp, Glycine max
  Peptide Sequence Number=SeqID_141865
atggaatcaagcaatgtgaagaacaagtcaagtggaaaaataaagatgtctagtgaggacacaagaagttacttcacatggaatttggaaatagagcgtgtgttagctgatgtgcttagagatcaaagaaatttaggcaataaaggtgatggaaattggaaaccaaaagcatacagtactgcaactcaaattttgtccaagcattttggagttcacttcatggcagataatgttaagaaccgttttaagctttggagaacatggtatggaattgtgagtgacattcttagtcaaagtgtatttgactgggatagcacaaatcacatgaagagaccaaatgatttcgattcaaagtaa

SEQ ID NO: 50181 - DNA, 167 bp, Glycine max
  Peptide Sequence Number=SeqID_141866
atggtgtttgtatctccttccactagtgaatggcaatatttccagcctgggtctgccttatttttcctcgttgcacttgcagtagcagcatcggatgatggcaggggaggttttgaatgcaagctgttggagggacggctagctgttctgaacgcaagctgtggagg

SEQ ID NO: 50182 - DNA, 243 bp, Glycine max
  Peptide Sequence Number=SeqID_141867
atggtgtttcctttaacaaagctctatgcaatcaatagtggttgtggcactcactatcgtgccagtgcagagcggcccttggccgcaatgagtacacttgttgtggagaagtctaaaggaggtggttgcgactacaatcgcgatggtgctatcacgcctcaacaagtgataaaaggtatggaaggggatagtggaagattactccaaatggacatgagtgatgttcctagcccacaagaatga

SEQ ID NO: 50183 - DNA, 220 bp, Glycine max
  Peptide Sequence Number=SeqID_141868
atgtctcttggtcagttttctttgacccttaagatgcttcaaggattcatgggttatgaaaatcctcaagaagcaatcggtcgtattgtctgtgccaatttccatttagctaataagcccgtggatattgaggttccacaagtggtacttcctaatactatatttgaagcagttgttcgaattccttatgatatgcaagtgaaacaagttcttgctaatg

SEQ ID NO: 50184 - DNA, 201 bp, Glycine max
  Peptide Sequence Number=SeqID_141869
atggataagagcttgaaggtaggagaagatgagtggagggagagggagagaaggagcatgaaattttgtgcctcaaatgaggttggtcaatggcgtgtccaggttccaagtactaaggttcttggatgcctattcaagatacaatcagatttggatgcacgccctagacctagacgaagagaaaatgacattcatcactaa

SEQ ID NO: 50185 - DNA, 270 bp, Glycine max
  Peptide Sequence Number=SeqID_141870
atggagaggagtatgattgatgctgccagttatgtagctcttgtcaatgagcaacctgaagcttatgttgcaaacatttataatagacctcctcagcagcaaaaccaacaacaacagaataattatgacctttcaagcaatagatacaatccaggttggaggaatcatccaaatctgagatggacaagtcctccacaacaacaacagcctatccctcctttccagaatgctactggtccaagcaagccatatgttcctcctccaatatag

SEQ ID NO: 50186 - DNA, 234 bp, Glycine max
  Peptide Sequence Number=SeqID_141871
atggcgggtgatatctccccacaaagattcaagtggttgatgcaatcctatcccgcaagggcattaggtagaagactccaagtagattgggctagagatccaagggaaggtcctagggttctcatgagccttaaggaggtgagcttagctattagagagcttctcaaggaagttttctcaaagaagcttctcaaggaagttttctcaagaaagcttctcaaggaagctacctag

SEQ ID NO: 50187 - DNA, 327 bp, Glycine max
  Peptide Sequence Number=SeqID_141872
atgcttcaatatcttaaaggtcttaagggtatatctggtattcggctaggccgagtactcaaatttactgtctcctatggtgttccacgaccatgcaaggtggagcaccgttgctccctctttgatggaggtgcaaccagctcgtctaatgatcctttacatgggattggaggtcctatgacaaggtccaagactaagaggatgaatcaagcattgcaaggcctgattttaaagatcaaagagaaagaagaccaatgtgaattaagggttgcacctaattgggtcactctcctacaaattgatgaagatgctttgaggccaacttga

SEQ ID NO: 50188 - DNA, 159 bp, Glycine max
  Peptide Sequence Number=SeqID_141873
atgaaggagatacgtggagaagacgatgaagaacaaggaataaaactttacgtcttggatcttcttcatcaatggagtcctttgcttcttgaagatcaatggcaatggaatggagaaggaggaaaggtgattggagactccacttcaaggagaagatga

SEQ ID NO: 50189 - DNA, 177 bp, Glycine max
  Peptide Sequence Number=SeqID_141874
atgagagttagggttcgagtgggtgttcgtgctgcccttaagaaggagaaaaaggtgaagaagtcaagtagtgattggatggttgttaagttcaacaagaatgagggggctgatttgaggacaaagaacaggaggggttggggaactggtggttcacaatggctaagggacggttag

SEQ ID NO: 50190 - DNA, 525 bp, Glycine max
  Peptide Sequence Number=SeqID_141875
atgtcctcgacttcagagagctgcatgtcctcgcctttagaggacttcacgtcctcgcctttaaagggcatgcacatccttgcctttagaggacagcacgtcctcgcctttagagggcttcacgtcctcgcctttggagggctacaggtcctcgcctttagagggctgcacgtcctcgacttcagaggactgcacatcctcgccttcagagggatacacaccctcgccttcagagggttgcatgccctcaacttcagaggactacacatcctcgacattagagggctacacgtcctcgccttcaaagggctacacgccctcggcttcaacggactgcacgtccttgccttcagaggattgcacgtcctcgccttcagagggctttacatcctcactttcagagggctacacgtcctcaccttcagaggactacatgtccttaccttgagagggctccaggtcctcgccctcagagggctacacgtcctcgcttttagagggctccacatatgtgccttcagataa

SEQ ID NO: 50191 - DNA, 202 bp, Glycine max
  Peptide Sequence Number=SeqID_141876
atggaggttgacctacctctaggttggaaattgcttagcctagagcattatgatgggaccaccaacctagatgagcacatagatgtgttcttcatgcaggccaacatctacactatgactgtcataacctacccttcggcgggagggcgaaggccaaatagatgggccaaagcattagtctccaagggagaaaacaagcaaa

SEQ ID NO: 50192 - DNA, 357 bp, Glycine max
  Peptide Sequence Number=SeqID_141877
atgtacaaagataagtggacccaaccttggcccatgggttcaaaaatctaccctgaggttcatgagaaccctagggccttcttcagcagctctagcccaatcctcttggagcctcttgctcatggctctagtgattgcttggagttgttggagtggatcgttgttcatcatggtggccgtcaaagtggccacaaatggagttttaccgtggccccacggtgggcgccaaatgtacttgccaaaatttggagtcagtttgacattagagttggccaccgtcggtgtgactccgatgatctttgtggtggtgaatgtagaagcaagcttcattgcttcatgatgatgaatcaagattga

SEQ ID NO: 50193 - DNA, 792 bp, Glycine max
  Peptide Sequence Number=SeqID_141878
atggcctccatgatggaggccatgttaagtatgaagcagctcatagagaagaacgcggccaccgctgccgctgtcagttcggctgccgaagcagacccgactctcttggcaactgcgcaccatcctccctcaaacatagtaggacggggaagggacacactggggcacgatggcagccctcacctgggatacaaccgagcggcttacccttatggattgccgcccaactactcaccacccgtcttgcaagaagatgcaggccacattgcttctcccgtctttgaaagagagcctcctcaacagcccgaagaaggccacaaagaccctcaagactatgctcgaagggatgtcgagttctatcccacgatccccgaagggctggcaccaggcacgttgcctcaactcaacatcgcagcaccaccaatagttttgtccacggaaggaccgcccccagcaactgaagaaaggaggaaagaaggagatgcccatgccgtctcttcaacacccgcgtgggtcaaaacccagcaaacgcctcatggtacccatcagtacgcgcaacatcacccgagcttctcggctcataccggaaacgcctctagttcaacacccgtgcagcctaaggcacccacccagagggaagctccccaagttccaactccgaacacgactcgcccggccggtaattccaacacgacaagtaatttccctccgaggccatttccggaattcaccccactcccaatgacgtacgaagaccttttgccatccctcatcgccaatcatttggccgtg

SEQ ID NO: 50194 - DNA, 213 bp, Glycine max
  Peptide Sequence Number=SeqID_141879
atggctaggttaggttttgactgcacaaacaacatagctaagtatgaggcgtgcacccttgggatccaagcggcaattgactccaaggtcaagttgctcaaggcctacatggtgttgcttcaatgtgtggatgccagggaggctgagcaaatgctggtagaggtgcatgagggatcctttggaacgcatgctaatggacatgccatggcctga

SEQ ID NO: 50195 - DNA, 367 bp, Glycine max
  Peptide Sequence Number=SeqID_141880
atggtggctgccaaactcgaggctgctacgggaccccgacatggtcagtcagttcaagcaacccctaccgcatgtgctctccttccccttatactcaactccggaccgaccactcactataaccaaccctacttacgggctggagctggagttgaagctagtacggggaatgggtgcggtcagttggggttgagtcgagtctgttccgtatatgagttggtcaaggtcggattggagcaagagggcatggtggtgtatatgctggctttattcgagtcgcatgggagttgggagtctcagctagtagtccggatcggagctgccggttcatctacactggctttcagttcatgggatgctagtagcg

SEQ ID NO: 50196 - DNA, 120 bp, Glycine max
  Peptide Sequence Number=SeqID_141881
atgcaagctgaggaagaagaagaagcagctgaggaagaagaagaagcagctgaggcagaggaagatgcagcagaggatacggatactgaatcagatgatgattctgaagccaccccatga

SEQ ID NO: 50197 - DNA, 519 bp, Glycine max
  Peptide Sequence Number=SeqID_141882
atgacccaaaagctggtagcccgtggagacgtcttacggttatccgcgcctcttcattcgatgaccccaagtgtgattgatgagcagaggccaatgtggccatctgcgcccttttcggagatgtcagcatcttccggtggagactttttcaagtctcacaagttatctagaactacacacagtcgtgtccgatggcacgcagagacaaattgtggtcattctgcacccttttgtcatccagaggcggcgggcccgatgacatgcggagacaaattatggtcattccgcaccccttttgccattcagacacagtcgtgtccgatggcacgcagagacaaattatggtcattctgcacccttttgtcatccagaggcggcgggtccgatgacatgcggagacaaattatggtcattccacacccctttttccattcagacacagtcgtgtccgatggcacgcaaagacaaattatggtcattctacgcccttttgtcatccagaggcggcaggcccgatga

SEQ ID NO: 50198 - DNA, 521 bp, Glycine max
  Peptide Sequence Number=SeqID_141883
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagggtacatctacttgggttgttatactgagaacaagaaagggtacatctcttgtggatcagttcaagtggagggtacatccacttggttgttcaaagagaacaagggagcgtacatcccttgtggatctttgcttgtaaaggattttacaag

SEQ ID NO: 50199 - DNA, 279 bp, Glycine max
  Peptide Sequence Number=SeqID_141884
atgtgtgttcgagaagaggaaaggttaattatgcaagagggcgaaagggtgaacttaaccgttcatggaaagaagaaaggggatcaacccaaaaacaagggcaagattcctgctcaaccagtcataaagaaagagtccaagtgtttcttatgcaagaagaaaggacacatgaagaaaaactgcttaaagattaagagctggacggacaagaaagggtatggaaaacctaaggaggccagtggggaagtgagcaacacatctattcaggaggcaagatga

SEQ ID NO: 50200 - DNA, 709 bp, Glycine max
  Peptide Sequence Number=SeqID_141885
gtttcttccctccttgagcaagattgcagttgtggtcagggatttggcgagaggattggaccgcgtaaagcaaactcgaaacagcatagtgggcctaccacggaagtacttagaagacaaggcgagggatatggcgaatcaagaggagtgggtcccatttatggatgtattagcattgctaatctttggggttgtcctctttccaaacgtggatggtttggtggacctagccgcaattgatgcttttgttgcatatcaccatagcaaagacagcccggtggcagctatcttggcggacttatttgacacatttgaccgaagaagagtagattgggaccaacacttggctgggataggaggcagaacaatcaactggtttccacgatggaaggaagggaaaggaggggagttactcttctcatgtggggactaccctaaacatcccgttgataggaacgaggggaaagataaagaacttaggggcattcgtaatggcctcatcggtggttatcatgaatggctgaaagttcttacacgagggttagattggctctccaagttaaagattatcaacgaagagaacttcaaagctccgaaagaggatgaagaaacattcggaaagagtgtgccgggttacgagaagaaaatgcagctaccgcaagagcccttgaacaagaaaccaagagggctcgcaaggaagagcatggcc

SEQ ID NO: 50201 - DNA, 420 bp, Glycine max
  Peptide Sequence Number=SeqID_141886
atggaactccagcggctaaatcaaaatgaagaaaccgacaagaggaaacaaagcatagcactaaaagcctcctcatcaatgcaagaggaaaatgaagatgaagaatcagaagatgaagaagacttctcactctttgtgaagaagttgacaaatttgtcaagaataaaagaatcgagaggcgtcaaaatttctgtcgcaacatgcccttttgcgggcgagcgaaggcgaggctcacgggtgcgctttccaaaggaggaaagatgcgcggagtcgccaccaacgtttatttgtgggaaacgtcggaaaaaccgaaggaaaccggtcgaaatgaaaattctaagttcgggagttgtatttacgtttgaggatggtattagcacctcttacgtttgtctcaaaggacaacagcctactttttag

SEQ ID NO: 50202 - DNA, 264 bp, Glycine max
  Peptide Sequence Number=SeqID_141887
atggagaagtctgaaaagaaaaatatttatgaaaagaaattgaagaaagcatacattacatgggatgaaaacgatatggaatcttctgaagattcagaaaatgaagaaataaacctctgccttatggcaaaaagttatgaaagtgatgaagaggaacccttgaggaaaaagtggtacattgatagcggatgctcaaaacatatgacaggagacgaatcaaaattcacacatatctctcccaagaaaagcggacatgtaacttaa

SEQ ID NO: 50203 - DNA, 105 bp, Glycine max
  Peptide Sequence Number=SeqID_141888
atggttcagcctaaaaaaatatatatgaataagaaggttaagtggtggctggacagaaatatagaaatggcaataacggaagctacagggctccaaatgaggtga

SEQ ID NO: 50204 - DNA, 273 bp, Glycine max
  Peptide Sequence Number=SeqID_141889
atggcctcatttgaagaaacgctagatatggacagggacaagtggatcgtgtggttcgatggggcgtcaaatgttctaggccatggcgttggggcagcattggtctctctggacaatcaatatagtattcttgagggagaagccaatttcgagacgctagagaaggaagttccgttcgagaagaagaagatagagttgaagatattgcccaatcatctgaagtatgtgttcttggaggaagataagcctgtagtgatcagtgtcataccctaa

SEQ ID NO: 50205 - DNA, 49 bp, Glycine max
  Peptide Sequence Number=SeqID_141890
gaatctccaagatagtggaactctcaagcgggttgcttggggactggac

SEQ ID NO: 50206 - DNA, 462 bp, Glycine max
  Peptide Sequence Number=SeqID_141891
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaggcgggttcggggtcggggcggatatcaataatcccataatcgccctcgcccccattttgggttatcagggaaaatccgaatccaaccccaaacctagtcaatgtgatttttctccgtcaaagtcgaagcgagttcggttcaatccccacgaggctagggctccaaaggttatcgcgagatgtttgggttctgagatatga

SEQ ID NO: 50207 - DNA, 403 bp, Glycine max
  Peptide Sequence Number=SeqID_141892
atggagagaagtatgatatatgcttccagtggtggagcccttggagacatgacccctgttgaagccagaaatttaattgagaagatggcttcaaactcccagcaatttagttccagaagtgatgctattgtcattagaggagtgcatgaagtagccacgaattcatcttcatcaagtgagaataagaagcttgaaggtaaactagatgccttggttaacctggtaacccaactggccatgaataaaaaatctgcacctgtcgccagactctgtggtttatgctcctctaccgaccaccacacagacctttgcccttctgtgcaacaatctgaagcaattgaacagcttgaagcttatgctgcaaacatctacaacagaacaattatgacctctctagcaacag

SEQ ID NO: 50208 - DNA, 258 bp, Glycine max
  Peptide Sequence Number=SeqID_141893
atgatcgatatatggtatccagtagagagggaattaggtcactttaaatcctttgtgagaaacaaggcacaacctgaaggatccatagctgagggtgaatttagagaattcataaaaaggagttcaagaggaagaagaccttcgtctacagagatagagaaaaaagtcaataaagagtttgctgattggtttagaaagcggattatgaatccagatacaatgaatgaaatgtctactaatctaaagtttttagcatga

SEQ ID NO: 50209 - DNA, 309 bp, Glycine max
  Peptide Sequence Number=SeqID_141894
atgaggattcccttttttataggccaaggttcaaaaaggtctaaggttgtctttcaatggggtcttttatcgtgtgaacccaatcttgatatctggggcgaaacaaatttgggtgtcaaggtgtcgatttcgggacgagcttccatattgttccataaggcacccaagtgggcactcaagcatcctgtttatggcattgtgatactacggttgggaatttacacagacagacccaacgtttccaagttatgttctttcatcagttcaatgaattcatccatccttatctcggttcattccggaaaataa

SEQ ID NO: 50210 - DNA, 213 bp, Glycine max
  Peptide Sequence Number=SeqID_141895
atgaagcttcattgtaagaactgtgatgacgagagtgatgagcaaaatgatggcgacagcgatgaagtctatttcgttgaagcctttgggaagagacggcaccgtgaggcgccatttggtggaggagattccgattgtggtgccaaggtacaccgtcaagcctctggcgacggtgacattggaaagcacggaccaaaggtgacgcggaggtag

SEQ ID NO: 50211 - DNA, 1020 bp, Glycine max
  Peptide Sequence Number=SeqID_141896
atgaagtccgctgtattgggcgaagacctggaaaaactgtggccattgatcgctgaaggccagtctgactctgcctgttttgacaactgcctggagttgttagtcgctggtggctatagcctgccgcacgccatgatgatgctgatcccagaagcctgggctggcaacccattgatggatgaagaccgccgcgccttctacgaataccacgctgcattgatggagccatgggatggcccggctgccgttgcatttactgacggcaaaatgattggcgccaccctggatcgcaacggtttgcgtccagcacgttacctggtcacagaagacgatatcgtcatgatggcgtctgaaatgggtgtcattactttcccacaagagaaaatcgttaaaaaatggcgtttgcagccaggcaaaatgttgctgatcgacatggagcaaggccgcatcattgatgacgaagaagtcaaaactgaattggcgcaagccaaaccttaccgtcagtggatcgaacaaacccgtttccacctgaccgaactgccaagcgttggtagcggcgaagtcagcctgaatgctgacttgctggatacacaacaggccttcggttactcacaggaagacctgaaatttgtgctgcagcctatgctggataacggcgaagaaggctctggctctatgggtaacgatgcagctttgccagtgctgtccaacaaagccaaaacgctttacaactactttaagcagttgtttgcacaggtaaccaatccgccaattgacccaattcgtgaagagttggtgatgtccttagtgacctttattggcccaaaacctaatctgctcgcaattgacgaaaccaatccgccattgcgcttggaaagcagccaaccggtattgagcctggatggcctggaaaaacttaagcagattgaatcactaaccaaaggccagttcaaatccatcgtactggacctgacttatgaggcagctcttggtaaagcaggcatgaagcaggcactggat

SEQ ID NO: 50212 - DNA, 140 bp, Glycine max
  Peptide Sequence Number=SeqID_141897
tgcgaacaccagaatggattcctactcctccaaccacacctgagcttcagttttcagatgaggaagggggacagattactactcctccggggacaccagtgttacatttggatgatgaggagcaggatcgagatgaatga

SEQ ID NO: 50213 - DNA, 285 bp, Glycine max
  Peptide Sequence Number=SeqID_141898
atggctttcactcttatccaaggaaggaccaagcccaaggaattttgggggctacaccttcaaaacccaaggaagataaggaggtcacattgcctcattaaatgcttcaagtgtcttgggagaggtcacattgcctctcaatgccccacaaagaaaaccatgattaagaggagtcaagacatttatagtagtcaagaggagactacttcttccccgtctagtgaggaagtctacccccatgaagaaggtgacctcctaatggttagaaggctccttggaggctaa

SEQ ID NO: 50214 - DNA, 210 bp, Glycine max
  Peptide Sequence Number=SeqID_141899
atggcggaagcacttgcgcatgcaccttctgatgtggagcagcttagacatgcagtggaggcttgccaagcaaaagctgaaaggttagagcagttgcttaacctaaggatagtgactaaaggcactgaaacatacaatgtcatgcaagattgcctaaggattgctagtgttgtcactgtggatctcaatgtatatgcgcggtcgcgatga

SEQ ID NO: 50215 - DNA, 549 bp, Glycine max
  Peptide Sequence Number=SeqID_141900
atgaagagaagtatgatagatgctgccagtggtggagcccttggagacatgactcttgctgaagccagaagtgtaattgagaagatggcttccaactcccagcaatttagtgccagaaataatgttattgtctttataggagtgcatgaagtagccacgaattcatcttcatcagttgagactaagaaggttgaaggtaaactagatgccttggttaacctagtaacccaactggccatgaataaaaaatctgcacctgtcgccagactctgtggtttatgctcctctgccgaccaccacacagacctttgcccttatgtgcaacaatctgaaacaattgaacaacctgaagcttatgctgcaaacatctacaatagacctcctcaacctcagcagcaaaatcagccacaacagaacaattatgacctctccagcaacagaccatgcgttcctccaccaatccaacagcaacaacagcaacatccccaaaaacaaccaacagttgaggtccctctgcaaccttcccttgaagaacttgtgaggcaatga

SEQ ID NO: 50216 - DNA, 450 bp, Glycine max
  Peptide Sequence Number=SeqID_141901
atgagacatgtttgcccgctagaaggccaccgctcatgcaccgagaaaaaagaggcaaactgggaccgactcttagcaagcaaagaaggagtgtctgtcaattggttcccccgatggaaggaaggaagaaccgggattcttattttgtgcgggaaatttccaaatgttcccttgatggggacgaggggttgcatcaattacaatcccatcctcactataagacaacttggttaccctatgagaggggcactcttagaggaaggccccacaccttttattacacgagttttcaatagcaccaacacgggggtgcttcagagggtccacaaggcatgggaaatgttgcaaaggaaggacaaggaacttagggggagtagcaacgggctcatcggcggttaccataggtggttgaaagcctacgcacaagatctggattggctcccgagttaa

SEQ ID NO: 50217 - DNA, 270 bp, Glycine max
  Peptide Sequence Number=SeqID_141902
atgatagatcaaggccgactagaagtcgacgatgaggggagggaagagcagcatatacgtatgcagtccgcagatgagagaagttttggaagacctaagcctttggtggtatatttcaccaaagacgcagctccccaaaagccccgatacccctcggtagttaaacctgttccgtttccataccgaaacagccacgcagtcccgtggaggtatgcacctccaagtgaaaggaaagaagaggccaccgacgtcagctcattgtcagccaag

SEQ ID NO: 50218 - DNA, 150 bp, Glycine max
  Peptide Sequence Number=SeqID_141903
atggaactcagctccagactcgaaaatggaggacacatgaatgcagccaacgcaattcatccatgtggctccggaaaaggctccaaactcgaaaatggaggacacatgaatgacaacgcaattcattcacgtggcttcggaacaggatga

SEQ ID NO: 50219 - DNA, 240 bp, Glycine max
  Peptide Sequence Number=SeqID_141904
gcgctgattgatgaataccgctttgacctggtgatcctgctggaaaacaacaccccgtgggtggctgacggcatgcgtagccttggcagctccgtggacaggcgtgagttccagaccatgctggtggatatgctcagggagaacaacgttgagtttgtgcatgttgaagagtcggattacgactcccgtttcctgcgctgcgtcgagctggtgagggagatgatgggggagcagggataa

SEQ ID NO: 50220 - DNA, 297 bp, Glycine max
  Peptide Sequence Number=SeqID_141905
atgatagggaaaggtggggcagtcgacaaaagcgaggcttttgctcctacgtatcctcaatttgtgatgagaaactcagacctacctagtttttgcgaaagaggtgcggataaccgtaaggtgtcttcgcatgctaccggactctcaggtcgctggatagcaaagggtgtttgtgggttaccgtcgggtctctccgcatgccaccggactcttgggtcacggcaacaaaagtctctaccgaaagatgctgacatctctggaaagggtgcaaatgacctcattggtctctacttgtaa

SEQ ID NO: 50221 - DNA, 273 bp, Glycine max
  Peptide Sequence Number=SeqID_141906
atggtggcgctagatggaaaggcactatcttggttccaatggtgggagacttgcaattctgatattggatggggcgatttcaaagttgccattcttgaaagattccaaacttcagccactctcaacccttttgctgccctccttgcacttaaacaagaagaaatggtggaagagtacgttgagcaattcgaaagcaaggccattgaccaacctgttgaagaaaaatgccttccaatggagttcagaggcgcaaactgccttcgtacaacttaa

SEQ ID NO: 50222 - DNA, 606 bp, Glycine max
  Peptide Sequence Number=SeqID_141907
atgtctggacctgccttgcgaccatactccccccggaacccaaagactttgatttctcataaggtgccagcgagtcctaaaagcacatccgctgatccctggtcggcatcgtttatggttgagactaggacgttgttcgtctttcataaatccaagaatttcacctctgactatgaaatacgaatgcccccgactgtccctgttaatcattactccgatcccgaaggccaacacaataggatcagaatcctgtggtgttatcccatgctaatgtatacagagcgtaggcttgctttgagcactctaatttcttcaaagagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 50223 - DNA, 279 bp, Glycine max
  Peptide Sequence Number=SeqID_141908
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgtatggccgcgtttgtctcattccacgcctga

SEQ ID NO: 50224 - DNA, 583 bp, Glycine max
  Peptide Sequence Number=SeqID_141909
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccgcgttaactgctaagatggaagacgttcactggctacatgttagtgggcatgcaagcttggcactggccgtcgtttacaacgtcgtgactgggaaaaccctggcgttacccaacttaatcgccttgcagcatatccccctttcgccagctggcgtaatagcgaagaggcccgcaccgatcgcccttcccaacagttgcgcagcctga

SEQ ID NO: 50225 - DNA, 84 bp, Glycine max
  Peptide Sequence Number=SeqID_141910
atggttttgttggtcaaaagagagacggtagttatagttgtggacatgagggttgtggagacgatggttgtggttgaggaataa

SEQ ID NO: 50226 - DNA, 171 bp, Glycine max
  Peptide Sequence Number=SeqID_141911
atgaggtcccataacatccacattgaaagtagtattttattcccatgcaacaaaacgcatgacaacactttcttgaatgccatgggttctcctaagttccttcagtccatcgccaaaaatgaatgggttagcatatttatgaagctttataaagttcttgttccttcgtag

SEQ ID NO: 50227 - DNA, 436 bp, Glycine max
  Peptide Sequence Number=SeqID_141912
gtctacgtgtggatggttaccattaattggtccaacaaatcttaattgggctgatttatgtgaggaattattgggagtcagaccacaagaaggtgaaattaaaggtagtgtggttaaattaagttggttggctcaccattttgcacaaataaataaccacgacgacaaagaacaagtacgaaggtttacccgtgcatggatactaagattcattggaggtgtcttgtttgttgacaaaagcagtaacaaagtttcgctaaggtggctgcgacgtggaaatcaacatatcggcaatgatgatgtgagagttttttgttgcaagttggatattatgaaacgtcatgagtttgtgtgggagccttacacaacaactgttatatcattgttgtctcccatttgtgtagtcagaagtgacgcacggtgcgcggtggtgtga

SEQ ID NO: 50228 - DNA, 552 bp, Glycine max
  Peptide Sequence Number=SeqID_141913
atggttaaggaggagtgtaaggaggtaagtgtctcctccaaaaggttagctacgaaggaaagacattttgaaataaagacaaatattaaagaaatttcccctcttaaacaacctccacattttctcctttgtaaaaagacacttgttcgcattgccacacctcttaggcttgagtttattcctcaagtaaaggagttgttggatgagggtttggttcgcaagagcttaaatccttgtgctttgttggtgcccaaaataggtattattaggcaccaaatccctaaaataggtggtatgatgaatactttgggtggtgcaacactcatttgtaaaatcactcgtgcacccaacatcttcgtgatttgtgtacatagggactcattaggggttcccatgaaccctaagagaataaaagtcattcctgagtgggcccgctccaccaagtgtgttgagggaaaaagcccagagtttcaagaacatcgggatttgaggtcaaatccttttcaagggggagggaatgatgcaatcctaccccgcaagggcattggatag

SEQ ID NO: 50229 - DNA, 881 bp, Glycine max
  Peptide Sequence Number=SeqID_141914
aacaccctagtcgtgtgcatgctattggaaccggtgtcacgatcaagcaatactttggattgactccaaggacctcctacacgtcttcctccatgggtctcgaagacctagagcaactgacacaacaaattagggaccaactagaggagttgatcacagaaaaatcgcagatgcaatcacagggactcgcactgcctcctaagcctaaggttgatccttcagctacttgtgtcagcacaaaagagagttgtgttgatcccttagggaatgatccagacacgagtgactcagaaaaatgcgggttgtacatcgaagaaaatcctccccgcctggatgccttaggaagagtttatgagggatccataattgttcacaacattcctttgttacatgatcaagtcaaggttggtgttgaggaggttagagatgcagatgctcccattcttatacccactgaagagtccgctcgcgctccaactaaatcacagtttccgtcgccatcatcgtccgaaatgacgatggcagcaaccattgcaggttttgttccttcgaggaatgttagggataatgctaatgcgaacaacaacaacactgtgcagactcatcagaagtcttttaagcacaacaattcgaacacctcttctaatggagggcatcatccaccacaaatgtctgggcctcaaggtctgattgctcctgctggcgaaactcttttaggcaccggaatggcaatggtccacatcagcgcaaagacgatcaccaccatcataactatgggggcagacgttttagtgtttatgtacaggtctgatgattgtatgcatttacagaactaccttctcagatggtatatgttccacctccgccactggaatcaatga

SEQ ID NO: 50230 - DNA, 915 bp, Glycine max
  Peptide Sequence Number=SeqID_141915
atgaggggagcgccaaccgaagaaagtctctcgcctttccttgtgaggaatcaaggcgcacaaagtctcgaggcgatacaaagagtccacaaggcgtggagaagtccgttgaggaaagacaaggagcttaggggcatccgaaatggcgtcatcggaggttatcacggatggctaagaattcatgcgcaagggttagattggctctccaaattgaaagttatcgatgaggagaacttcgaagctccagaggaagatgaagaagttcgagccctaacattggagctagggaaggcaaggctcgccaaggagaagttcaaatcagctgctacacacatccggaaggagtgcactgagttacaagaggaaaacgcggccactgcaaaagcccttgaacaagaaaccaaaagggcccgcaaggaggaatatggccgagagaaattccgaggagcattgtggggtagcaacaatgagctcaagctccgaagagaggagagagatcggtcacgggtgcatggcatgatcttaaaagaagagttagttgcctgcacgaggtccaaaagaagtttggctcaacacttggaagcaacggagcaaagcatgctagctatcatagggcaatacaaggaagaattgaaccagtctatggcccatgaacaaaagctagtggaggattttgcacaagtgtacgccgaaaaagaagcaagagggagggtgattgatgcattgcatcaagaagcgactatgtggatggataggttcgccttaaccttgaatggaagtcaagacctcccgcgtctactagccaaagcgaaagccatggccgaagtgtgtacggcccccgaggagattcatgggctaatcaattactgtcaacacatgatagatttgatggcccacataattagaaatcgttag

SEQ ID NO: 50231 - DNA, 609 bp, Glycine max
  Peptide Sequence Number=SeqID_141916
atggcagcgcaattaatccatgaccgagtggagatggagtgcctagagggagtttgggagaccctcgaaggcaatgcaaggtgccgattccggggcacgattcggttcacggctacttcattggtacatccagaggaaccagcacgcacgcttcagcgcactgtggagtggatattacctacacctactccatatcgactagtggagccagtccaagtgatagaggtgatgtcatctgaggaagaccctgaggaggacccagagaagctacctcctgagcttgctgtggatgctcttgactttccagagggtgatgaggacccactccctgaggtggattctcccgtggacgtcatgtcggcatctgaggcagactctacggaggagaacgatcctggagggatagtgactagtggaggccacgcattagatcctttacctcatggtcacgccccgcagccccgagtcgtccctcaagccccgcagacggatatccctcacgttctggagccaggagcatcgtccacatctacggaggagcctagacatgcagtggttagagcgccatctaagtctatgggtggtcacgcttggctcatcgatacatga

SEQ ID NO: 50232 - DNA, 119 bp, Glycine max
  Peptide Sequence Number=SeqID_141917
ttcgaataactgcacatcttccatggtggaattggcgaatggttctaccagaaaatgcagaagaactgccacttgtagacttggagaaatcaaagcccactaggaagaagatggagtga

SEQ ID NO: 50233 - DNA, 258 bp, Glycine max
  Peptide Sequence Number=SeqID_141918
atgaccacatttaaggttcccaacaaaacactcactatcctaagggaaaaattgcttaaaattattacacacaaatggaagtttggtaacctattggaggctcccaacacacttctaatgaaaggcatttttgttacaaaatttgaaagcaatgaagtgcttcttagtccaatagctcttaaggtggctgaccccttgcttcttgactcaaattcttcaagggatgacatcgatcctcctttccaattttctatatga

SEQ ID NO: 50234 - DNA, 441 bp, Glycine max
  Peptide Sequence Number=SeqID_141919
atggtggcccgagtaatgttggggaatggctacgagcccggaatgggtttaggcaaggacaatggcggcataactagcctgataagtgccaaaggaaatcatgggaagtttgggttaggctacaaacccacacaggcatatataaggaaaagcattgcggaaaggaaaagcggaagtcaaggctcacgattaagacatgaagacgaaggaagcccgccctgccacataagtaggagctttataagcgcgggtctaggagatgaagcccaagtcattgcaatatgcgaagatgatgctctgagtgggtcgaatttgttggtgatgcaatcctaccccgcaagggcattggatagaagactccaagtagattgggccagagatccaagggaaggccctagggttctcatgagccttagggtagattttgagcccatgggctaa

SEQ ID NO: 50235 - DNA, 995 bp, Glycine max
  Peptide Sequence Number=SeqID_141920
cttgtcgaacatccaactacttaaactgggacgggaccaatcatgttgattgcctatccgacccagctctaacaactggtttggtttttgaatcacagactttatcctctcaatcggagaggcctacggggcattacgagagaaaaagctcgccgtgggtcaagaccagagagctacaggtacaccaggggcaacagagcactcaggcggggtcggggcaagggcagcacgtcacggaagttctcagcttaatcttaccagcgctatatcttgggtgcgcgatatggtgggactgtctagcacagacacccccaagcatccctgagttacagcagctggcggaggcaacgcaaatcggggaaccggcaagttcttccgcagaagtaaggcagctagtagaccacctcagtgagcaagccagggaggtggccagtgaagcttcaatggaaagaacacccagagctcttgcaatgtggatggctgggctaacgctagcattcgctatctccataggcgcttgctcgaaaggtcggggatgtggaatggagcctgaatctaccattcatgttttaaagggctgcccctgggcatctggcatttggctactctgcccattagcccttcatactcaacagatgcaggctctcaacttctcagattgggtgaaggagatggggaagtgtcttgatgaagagcagctggaacttatgctagtagttgcatgggctttatggagtgatagaaatttgctgctgttccaggacatacagaactatcctgtggatgtggtgaacaaagcaatcagcttcttcgaagagtataagaaggagaagctaaaaatagtgcaaacacctataggttggcaggccccaccccatggtgtttataagattaatactgatgctgcaatttttaaccagcaagggattggctgcttgcttcatcccgcccttccttccctcacctcacgtgccattgatttagatgaattagct

SEQ ID NO: 50236 - DNA, 443 bp, Glycine max
  Peptide Sequence Number=SeqID_141921
gccaccaacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 50237 - DNA, 542 bp, Glycine max
  Peptide Sequence Number=SeqID_141922
tggcatgtattttcatggtgctcgtttttccaattatgaggcatggttaagtgatcctactcacattaggcctagtgctcagatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgcatacgactaactggggtattggtcacagtataaaagacattttagaggcacataaaggtccatttacgggccagggtcataaag

SEQ ID NO: 50238 - DNA, 360 bp, Glycine max
  Peptide Sequence Number=SeqID_141923
atgaattttgcagtgagaaagcctgtagaattcaccccaattccagtgtcctatgctgacttgctcccatatctacttgataattcaatggtagccataaccccaaccaaggttcatcaacctccatttctccgagaatacgactcgaacgcaacatgtgcttgtcatggagaagccccggggcattccattgagcattgtaggggccttaagcgtaaggtgcaaggattttcaactttcaccggaattgggtgcaagccattggtctatttgctcaagcgacctgtggtcttgagtttggacttccaagaccgttcaatcagagattactcgtccttcacgttggtggggttgccgtaa

SEQ ID NO: 50239 - DNA, 312 bp, Glycine max
  misc_feature (311)..(311): n is a, c, g, or t
  Peptide Sequence Number=SeqID_141924
atggcagatgagcaacaccagaggatcacccttgaggattattcaagcagctcaatatcgcaattctttactagcattgcacgtcctgaagtgcaagctcacaacatcaactacctgcattctttaattcatttaatacaagggaatttgttccaaggattacctaacgaagatcctctcgcaacgtgcccttctcaggcgagcgagggcgaggctcacgggtgcgctttccaaaggaggaaagatgcgcggagtcgccaccaacatttatttgtggaaaatgtcgaaaaaaccggggatcctctagagtna

SEQ ID NO: 50240 - DNA, 312 bp, Glycine max
  Peptide Sequence Number=SeqID_141925
atgacaaaaggaagtgaaagtaaacctaatttcggtatctctcgcgtattgggagagtgcaggaatgaccaaacttggtctctgcttgtcatcgggcccgccgcctctggacaaaatttaaccataagaaaggtgaccaaacttggtctctgcttgtcatcgggcccgcgtctctgtgatgacaaaaggggtgttcggataaccgtaaggtatctccgcgtatcatcgggcccgccgcctctggatgatacaagggtgcagaatgaccaaacttggtctctgcttgtcatcgggcccgtcgcctctggatga

SEQ ID NO: 50241 - DNA, 231 bp, Glycine max
  Peptide Sequence Number=SeqID_141926
atgtttgtttggcggttgccggtttgggagattcctgagtggatggctcagttggttttctgggtagatgacccagcctgggttggtgacccagaagaggtagatgatttcttcatggttggctctggaagagccagcctggctcctttgcctgtactccttcctccccgtagggagattcccgaatgccttaggaggcattaccacttttctgtaagaattcacgggtaa

SEQ ID NO: 50242 - DNA, 87 bp, Glycine max
  Peptide Sequence Number=SeqID_141927
atggcaattctgatcgccaatacttcaacaacatttcatagagatgaaagactcgggaatacaggaaaacgcaaggatcgtgcatga

SEQ ID NO: 50243 - DNA, 498 bp, Glycine max
  Peptide Sequence Number=SeqID_141928
atgtacctaaacaggcgagctcctggcagtcaaccaataaaagaacaaagtccacaaagcaaggaggcttgtgtggcggctggccagctatgtaactttggtggtatctggaatttagcctctggtaatcaattaccattcgtgggtaatcgattacagggcttaaaaatggagacaggacgttcaatggcctctggtaatcgattaccaatggtgtgtaatcgattacacagagtgacagggcactggctgtgtaattcgttttggggcactggtaatcgattacatactttgatcgtgattgcagcgcagttgatccatgatcgcgtggtgatggagtgcctagagggtgtctgggagaccctcaaaggcaatgagaggtgccgattccgtgacacaattcgactcactgctacttcattagtacattcggaggaacccgcacgcacacatcagcagcctgtggagtggatactacctacacctactccatattga

SEQ ID NO: 50244 - DNA, 48 bp, Glycine max
  Peptide Sequence Number=SeqID_141929
atggcggtgcgtctgttgcctgctgccagccatccccaggctgctgtg

SEQ ID NO: 50245 - DNA, 165 bp, Glycine max
  Peptide Sequence Number=SeqID_141930
atgaatgttttgagtggtgcaaccctcttttgtaaaatcactcgtacacctaacatcttcatggtgtgtgtacatagggacccattaggtgttgagggaaggagcccagagtatgaagaacctcgggatttgaggtcgaatcctttccaaggtggaggggaatga

SEQ ID NO: 50246 - DNA, 282 bp, Glycine max
  Peptide Sequence Number=SeqID_141931
atgggatcaagtcaaaagccttcgcttaaaaagaggttctatcaagtcaaaatcaagagcttagaggtcactagtttaggagagttggggcaattaatgggtcaacttcaacggtgcttcacatttgaggacttccagctagtgccgactgtgaaagagtttgaagaaatcctgggatgcccactgggaggaaggaagccatatcttttctctgggttctatccctccacgacaagagttgccaaggtggtgaaatctcagcacaagagttggaccgtgtaa

SEQ ID NO: 50247 - DNA, 600 bp, Glycine max
  Peptide Sequence Number=SeqID_141932
atggtcatagaccagtccctttacttcaaactcacccagttatctagtgatggtgtaccgtttgaaggtacacttgatgatgattggaagttcgacatttctgtttctgatgcccgtcggttggtttgcaccaaccaagcggatatgaccggaaggcttcttgccggatcattggcattcgaattctgcatcatgcactacttgattgtgcgcatcctacttcctagatcatccaacattgcacagccctttgttaaagtcaagagatctttctctatcgatgtgaatgtggtctcctcttttggataccgcaaagagagggatggttcttgggtgaagaaggacgctcccgcacaagctgcagaagaccgctctccatcaccacctcctcagagagatgattcttcatctcttatgcacaacattcttgacagattggatggactccacaccttcgttggtgagtgctttgacttattggacaaccgcattgatgccattgatgcacggtttgcaggaatggatacacgcatcactcagcttgaggaagatatgagttacgttcgtcagtgcttcgaccttccacaagcatcttcatag

SEQ ID NO: 50248 - DNA, 288 bp, Glycine max
  Peptide Sequence Number=SeqID_141933
atgaagaaatccaagccgaggcgcttccgtaacgtttccgtgagtaattacgcgaagattctcgaccgttcttcaacattcatcatttgttcttcattttcttcagtcttcaacggtaaatggatcatttttaaggtccaacgccttaaaatgatcacctttcaagtaaaagaatcgcttgattcacgcttaaagaaagaactacgtaggtctgatttcctcttcgctggagggtacgtaggagcaagagccccgcttttgtcgacctcaaaaaataaaaagaaataa

SEQ ID NO: 50249 - DNA, 231 bp, Glycine max
  Peptide Sequence Number=SeqID_141934
atgtacatcaagtatggcccaaaatacatcatgaagcatagccaacaaaacatgttatccaacaaaaaaccccccacacttattcctaaaacaattccaaaagctccaaaattccttaaggttaaggaagcatcaataagaatcaagccaaggctattgtgcaagcaatcaatggggcaaaacacaccaaatgattatgatgatggatggctcaaattctcacaaaggtaa

SEQ ID NO: 50250 - DNA, 333 bp, Glycine max
  Peptide Sequence Number=SeqID_141935
atgacccaagagctagtagcccgcagagatgccttatggttatccgcacctcgtcattcagtgaccccaggtcatgtgacacgcggagacaaaatttggtcattctgcacccctttgccattcagacacagtcgtgtccgatggcacgcagacaaattatggtcattctgcacccttttgtcatctagaggcggcgggcccgacgacatgcggagacaaaatttggtcattccgcacccctttccattcagacacagtcgtgtccgatggcacgcagagacaaattatggtcattctgcactctttgtcatccagacgcggcgggcccgatga

SEQ ID NO: 50251 - DNA, 231 bp, Glycine max
  Peptide Sequence Number=SeqID_141936
atggagcctccggtgactgggaaatatgtttttgttattttccggattggttccttcgccaaatataaaaaaaaaggagtagagacgacagtcgtcatcacggaaagggcaggacggacgaaatcagtgccttatctttgctttcctcttatctccgatgagagatacttggcaccctttgttgcacaatatgtgaagtcccgagacgtgccaaaaatcaaaaggaagcag

SEQ ID NO: 50252 - DNA, 96 bp, Glycine max
  Peptide Sequence Number=SeqID_141937
atggagaattggcgaacagcgctacgcaataacttcgcggggctccagactcgaagactcgttggtggaggacacatgaacagcgctaggcaataa

SEQ ID NO: 50253 - DNA, 141 bp, Glycine max
  Peptide Sequence Number=SeqID_141938
atgaagctttatgatggtgctattcgaactttctcaaatgtgagaggagatgacatcacaagggtacaagtatgttggttcaaagtggggatacaaggtgtacaaggggggacacttggtgttgcgatgatagaaaaataa

SEQ ID NO: 50254 - DNA, 124 bp, Glycine max
  Peptide Sequence Number=SeqID_141939
cctaccactggttactgcaccttaaagaaaattccttgggtaaaatgggaagctatttgcttacctaaggaggaaggtggtttggggattaaagaaatatctaaatttaatgaagctttgctgg

SEQ ID NO: 50255 - DNA, 588 bp, Glycine max
  Peptide Sequence Number=SeqID_141940
atgatatcccagaggcttttgacagtaggaacgaaaaggaagttactacagaccgtgggggagagatggaggcagtttaaatcagacctcacgaggaaatgggcccttgcagccgatcaggacggtgtcgaggacactgtctgtgacaaatacggcatcagcaaggaaaagtgggcccagttttgccagactcgcagagacccttcttgggaggatgtgcgcatgaaggcacaggccatccagaagcacaatattgccccccacattttgtctcgtgggggttatgattatttggagcagaagctcctggctgagaagaccaagaagaagatgcaggaagctgcacagtcaggaagcattgatggcgtcatcgaccctccatccccggattcatttgaggagcaggccacacagggatcattcatcccccatggacgtcaggatgttctggccgctgctattggacgtccagagcaccctggacgtgtccgtggtattggagccgatgtcaccatcaagcaatactttggattggctccacggacgtctcgcaacgcttcctccctgcctcctgacgaattacactag

SEQ ID NO: 50256 - DNA, 553 bp, Glycine max
  Peptide Sequence Number=SeqID_141941
gtcgactctagaggatcccacctttaccgtgagctgatggcgggcagcggaccaggcaatcagcgcatcaaagtacgcctgcggccgttcgctataaccaaaaataccgtgatcaacgcgctgatgcagcgcctgctgcaccaccggcggacaggtgaaatcaaaatcggaaacccacatcggcagcagctttgccgcgccagcgccgaagtcgagagtgctgacgccgagcgttgtcgccatatataccccggccgaagtccacggcagcagcggttcaataacggtgccggcatcctcgatagtgcgcgacaggttcttgttatccagccccatgcgacgataggcgtctttgaacagctccgccggaaccagcagcgccagcttgccgtcactggtcgcgccggtgaccagaatggtggtggccacggtcgctgcaatcagttggccgacgcttttgataaccgtcaacaggcggttgatgatgatggtcagcgcgccggtcaacgtgagcgcgccggcgaacgagaaggcgcagaacaccagcaggatg

SEQ ID NO: 50257 - DNA, 750 bp, Glycine max
  Peptide Sequence Number=SeqID_141942
ggtgttctagggcattcaatagagcaatgtgtggccttcaaacacaaggatagcttgaatgtaaggactaatcccctcaccggtcatggaggctcagcgattaatgcggtggaagaatgggaaccttgggggccaaagtggatgagagaagtgttaacctctaggaggttcatattggaagcattgcgtgaagcaaatatgatttgccttgacggggacaagggagattcttgtttaatacatctggaggcatcacacgatgtggcaacgtgcccgatggtggaagagttgctacaagggatgatggataaaggccaaattgaagtttgtagcgcaagaaaaagggaaggggatctcgtcccagtaaagaatcctacgcctttcccttacaaaagtgataaggcggtgtcgtggaagtacgttgcacaagggcccgacggaaggaaggacgtgtctgtcgtacatgttaaggatgacctatcctccactaaggtcacaaacatatccggtacgagtggcatgactcatagcgggcggatcttcacagcacccgaactaccgatgcgatccaaagacccaaaggggaaagcaaaggcagatgtggaagaaagtgataaggcgggcctggttccgaatgatgaggtcccagttggaaggttcaccaaggaagaggatgacttctgcaaaaagggaatatccattgaagaagcaaccaagttcctgagaatcatacaacaaagtgagttcaag

SEQ ID NO: 50258 - DNA, 191 bp, Glycine max
  Peptide Sequence Number=SeqID_141943
atatccaccctagtcactatggacgcatttgtccaattgacacgtcggaaggaatcaatgttggacttattggatctctagcaattcatgcgaggattggaaattctttggcacttaatcgagatattcaggaggaacagactgttccagcccgataccgtcaagaatttcttacgattgcatgggaacag

SEQ ID NO: 50259 - DNA, 318 bp, Glycine max
  Peptide Sequence Number=SeqID_141944
atgcttccacaggccgcagacgcgccgccacctcatcaggctggcccagctggatcgtttgatacggagcagtatttgcggcatttggttcgccagcaggcggccaaccaccgggcgcatgtacagacccatgattgtctttaccagttgagcctcagcctgcagggccagggttttacttcttttccgttccctactccggaccagttcagggcagaggtcgcatggcctggagattggcctgaggcccgggcaggagaaaaaacaaagcagaggctccagacgaggcagatgaggcccgcgaggacgaggagatga

SEQ ID NO: 50260 - DNA, 226 bp, Glycine max
  Peptide Sequence Number=SeqID_141945
gtgcagcaggattttagcttggtgcagaaaatgcttgtgtgtggttggctgtggaaagagtaatcttgagaggattgatggggacccggtgttgagagaaacgaggatatgggctacgtgggagtacgtgagctcagttggaggtgagcaacaggggatggtgggtttatgcgcgcattgtggatgtggaaaacttgttgtgcaccatcgcccgaccgccacctag

SEQ ID NO: 50261 - DNA, 276 bp, Glycine max
  Peptide Sequence Number=SeqID_141946
atggcaagcagagaccaagtttggtcattctgcaccagatacgcggagataccttacggttatctgcacccctttgctaggcagacacagttgtgtccgatggcaagcagagaccaagtttggtcattctgcatccacatgatacgcggaggggctgacacagtctttgcaccttttgttccatccgggaacaacaaagtcatttacatgcggaaatttcatggtcgcccgcgactctcgtcaaccgagcgacgagaaattagtgtcatacactga

SEQ ID NO: 50262 - DNA, 318 bp, Glycine max
  Peptide Sequence Number=SeqID_141947
atggccttctccaagagagattccactcccaccctccatcttgatattaagtatagtctaggatatttctcagccaatgattcctcctccccattccacttgtcctcccaaaattttatttggtcttcgctgcccaccctccacttcatttcctgttggataatctgtccttggtgtgaactggtgagagccttttgtaagtctctccaccaaacagatttgttgcctaccctgtccacttcagccaagcctctccgtcctccatatttggagttcagcaccttagccctcctctttgttcagcttcaaatagtttga

SEQ ID NO: 50263 - DNA, 411 bp, Glycine max
  Peptide Sequence Number=SeqID_141948
atggttaaggaggaatgtaaagaggtaagtgtctcctccaagaggttagctaagaaggaaagtcattttacaataaagacaaacattaaagaaacttcacctcttagacaacatccacattttctcctttgtaaaaagacacttgttagaattgccacacctcttgggcttaagtttattcctcaagtaaaggagttgttggatgagggtttagttctcaagagcttaaatccttgtgctttgttggttgcttcaaaggataagcattgcttcaagattaatacaaggttgcttcaacaaacaaagccttgcttcaagattaactcaggatcaagccttgcttcaagtttaactcaagatcaagacttgcctcaaaacaaagtgtttccaagacatccaaggctctggtaa

SEQ ID NO: 50264 - DNA, 324 bp, Glycine max
  Peptide Sequence Number=SeqID_141949
atggatggtttcattgaaccgatggaagaacataatttggaaacgttggaatcctcatcctttcccccgaagcaaaggacagcggaatctcctcaagggagagcagatagaatgttattgcctagcgctgttcatgtgtcctccactttcgagtttggagctgtgtttcatgattgcctaagtgcggaccctcaaggcaatcctccattctcccctttttcagagcgctatgaatgttactgcctagcgctgttcatgtgtcctccattatcaagcgcgaagcctctggtgactgggaaacacattattctgttgttcttctga

SEQ ID NO: 50265 - DNA, 294 bp, Glycine max
  Peptide Sequence Number=SeqID_141950
atggggaattggcgaacagcgctacgcaataacttcgcggggctccagactccgctaggcaataacattcatggggctccgaaaaaaaagtggggaatggagaattggcgaacagcgctatgcaataacttcccgaggctccatactggaaggtggaggatgcatgaacagcgcttggcaataacattcatggggctccgaaaaaagtggagaatggagaattggcgaacagcgctacgcaacaacttcgcggggctccagactcgaaggtggaggacacatgaacagtgctag

SEQ ID NO: 50266 - DNA, 363 bp, Glycine max
  Peptide Sequence Number=SeqID_141951
atggacgagaagatgaagaaaagacaacatgacgcaatgacaactgagaatacaccaaactctggggatcccccatctctcattcaaagacatgccaagtgggtgttggcacgcactaagcaatatggacagatgacatctcattcggcacaagaaatatctgataaaattggtacctttgtcccccatggtcgtgaaggcatactgaacactgccatcgggccaccggatcatggaggccatgttcgggcagtggggtctggggtcacaataagtcaatactttggaagggaacagtggaaaaatgaaatacaggtattgaaagatgagttgaaggaacaaatcatacttgagatgtcgtag

SEQ ID NO: 50267 - DNA, 846 bp, Glycine max
  Peptide Sequence Number=SeqID_141952
atggggacgaggggttgcatcagctacaatcccgttcttgctataagacaacttggctaccctatgagaggggcgccactagaggatgagctcgcgcctgtcatttcacgaggcttcaataagaccaacgtggagacacttcagaaggtccgcaaggcatgggaggtgttgcaaaagaaggacaaggaactcaggggtagtaacaatgggcccattggtggctatcgtaagtggttaaaagcccacgtgcaaggtttggattggcttccgagtttgagaaccgctaaaagagaggaagttgaggcaccagaggaagacgaagaagtgcaggccctcagggcggaactcgagcaagcccaaacagttaaagaaaggttcaagtcagcagctctgaaaatccaaaaggagaatactgaactgagagatataaatgtggctaccaccaaagccttggaacgagaaaccaagagggcttgtagggaagaacacggccgaaacaaattccgaggggctctgtggggcagcaatagtgagcttaaactccgaagagaggaaatgtaccaatcacgagtagatagtttgatcttgaaagatgaattgaaggcttgctcgaggtccaaaagaagtttgtctcagcggttatgcgagacagagaccaacatgttagctatcatcaccaagtaccaagaagaactaaatctagcctcggcccacgagcatagagtggcggaagagtatgcccaagtgtacgcgggaaaggaggctagaggaagggtgatcgactcactacatcaagaggcaacgatgtggatggaccgatttgcccttaccttgaacgagagttaa

SEQ ID NO: 50268 - DNA, 507 bp, Glycine max
  Peptide Sequence Number=SeqID_141953
atgtcagttctggaattatacatagaaaaggatgtggctggtaattctatgtttcattctgcaaattctcttacatcatgtggaaataatttatctaataatgaggcgcaacctccaagaaatgtgagcaatttacatggtgatgaagatgatgatgatgattatcttgtgtctaactcatacattgaagagtctttagacgaagatgatagtgttgacggtatatctgatacagacgatgaagtcaccgacatgattcaaccatttgatgtgcgacataaactgtatccattagtaatccttaataaactacaagacgtgagaatgtgtcacatggtcgatcccatctttgcgcttggcgatcaggatttcttctgccccgatgtctccccatttctacttggtcagcctcagcaaaaaattggtgacgcaaatcagctcctaataagtcacctatatcaagtattattctgggtacattccatggcgtacctaatggggcgttag

SEQ ID NO: 50269 - DNA, 868 bp, Glycine max
  Peptide Sequence Number=SeqID_141954
gtcgactctagaggatcccacggttgtcctctttccaaacgttgacgatttggtggacttagctgccattgacgctttcctcgcatatctccatagcaaggagagtccagtggtggctatcttggcagatttgtttgacacctttgaccggaggtgtgagaaaaacagtgcacggattgtctgttgtttacctgctctctgtgtgtggttggtttcacacctattccaacaagacacaagacacccgtgttcgcttcaaagttatcgctcatgcgccgaaaaaggaagagtcgattgggaccaacatttggctgggataggaggcaacgcaatcaattggtttcctctttggaaggaaggcaaggaaggagttcttttctcgtgtggggactaccctaatgttccattgatagggactaggggttgtattaattataatcccgcactcgccataagacagctagggtatcccatgaggggagcgccaacagaagaaagtctctcgcctttccttgtgagggatctaggcgcgcaaagtctcaaggtgatacaaagagtccacaaggcgtggagaagtccgttgaggaaagacaaggagcttagaggcatccaaaatggcgtcatcggtggttatcatggatggctaagagttcacacgcgaggattagattggctctccaaattgaaagttatcaatgaggagaacttcgaagctccggaggaagatgaagaagtccaagctctcaaattagagctagggaaggctagactcgccaaggagaagttcaaatcagccactacacacatccgaaaagagtgcaccgagttacaagaggaaaacgcggccactgcaagagcccttgaataa

SEQ ID NO: 50270 - DNA, 195 bp, Glycine max
  Peptide Sequence Number=SeqID_141955
atgccttcctttcgcgatttggagcaaaaatggctaccaaaggttggagctttgttggagcttcaatggtggaggaagaagaaaagaatggcaacctatgccaaatgtctccatttgagtggagcaaaagagcccactttttctcttgatgtgactcatgctcagccacatgaagagaaaaatctgaccttttga

SEQ ID NO: 50271 - DNA, 837 bp, Glycine max
  Peptide Sequence Number=SeqID_141956
atggcgcgtgaattatccctggacgttcttgaggaaatgctggaaaaggtcagggtcgttgccgaagagaaacggagtgagctggcagaattagaacagcagcgcgctgagcagcaggaaaaaattaatgccctgctggaactgatgaaagccgatggtatttctccaaccgaactgctgaactctgaacgggcgctggcgggtaaaacggtgaaaaaacgtaaaccgcgtgaagcgaaatatcgctttattgaccagaacggtgaagagaaaacgtggaccggccagggtcgtacgccgaagcctattgccagcgcgctggctaacgcaaacatagaacctcctcatcgttttagcgatcttcaccttagcccacgtatgacgtcgggtacagcgtatttcaccgatgacggattacgaggtacgccggttccagggcatcaccctgagcagtctcgccataccgcaaaagcccgtcacaccggcgaacagcagcccggctccgacaaaaccgctgagcaggaaaaagccgccggagacgctatagcccagcaccacgccgcacagaatgagcagcccggcggcaatctgcacctgacgcatcagcggcagcggctgggatctgtcttcgacggtctgcagcccggcctgcttccagccctgaatccccccttcgatcacaaatgcctgagcgggcgaggctgcccgggcaaggcgatcggcattccccgaggtccgggcaccggactggcagtggaaaattatcgtgtcaccggccccggctttaagccctgcaggtgggatcctctagagtcgacctgcaggcatgcaagctga

SEQ ID NO: 50272 - DNA, 481 bp, Glycine max
  Peptide Sequence Number=SeqID_141957
gggcctgggcaactacaggtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagatacaggcgtttcccctggcggctccctcgtgcgctcttccttgttcttgcctttcggtttaccggtgtcattccgctg

SEQ ID NO: 50273 - DNA, 249 bp, Glycine max
  Peptide Sequence Number=SeqID_141958
atgggtcataacaacagcttccagaattgccccatgtatggtgttgcttgtcaatgttatgattcaacaagcgattctcctcaaatttcagccagcccgtatcaattagacttcacactttatgcttcggggtcatggaatgccccagggctcctccacgataagcacacgttgcgttcgagtcgtatcctcagaaaaatggaggtggtcttcgtcattggaagtgcggtagacaggctttgtggttga

SEQ ID NO: 50274 - DNA, 387 bp, Glycine max
  Peptide Sequence Number=SeqID_141959
atgacaaaacttggtctctgcgtaccatcggacacgactgtgtctgaatggcaaaggggtgcggataaccgtaaggtatctccgcgtatcataatgaccaaacttggtctctgcgtgccatcagacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaaggtatctccgcgtatcataatgaccaaacttggtctctgcgtaccaatcggacacgacttgtgtctgaatggcaaagcgggtgcggataaccgtaaggtatctccgcgtatcatgtgtgcagaatga

SEQ ID NO: 50275 - DNA, 354 bp, Glycine max
  Peptide Sequence Number=SeqID_141960
atggccacaatgatggaggccatgatgagcataaatgaaataatggaggtcaatgtgactgcaatagcctctaccggaaccattgctgaggtgtacctgaccccccaatatggcctcaacaaaataaatcatccaacctcagatatggtaggtctggaaggcaaagagttgggaggtacgggcggccctcatttagtgcaaaaaataagcgtgccatatggcttgcctcccaactatacaccacctaatgtgacgtacactctcggtgaggatgtcaataactccgctcccatactcgttgaaagacgacaacctcaaactgatcatgcacatgtctctcaacccatggggtag

SEQ ID NO: 50276 - DNA, 456 bp, Glycine max
  Peptide Sequence Number=SeqID_141961
atgactagaggcaatccatctgacttacaaccctttgatcctgagatagataggacatttcatagattagttaggcatcattttataccttttgatcatcctgagcattccattactggtgaatctgtgcattctgttattggtgattttgaacatcctgatttggagcattatgattctgatcattctgattctgcacattctgagaacatggcacaacctccaccccgtgagaggactctaagggaaatggctgcacctgatttcacctacaaaagcttgtgcatccaataccctgatgaggatgtcccatatgttcttaaaattggactgattcatttgcttccaaagtttcatggccttgcaggtgaagacccgcacaaacatttgaaggaatttcatattttctgctccaccatgaaacccccagatgtccaggaggatcacatattttga

SEQ ID NO: 50277 - DNA, 360 bp, Glycine max
  Peptide Sequence Number=SeqID_141962
atgtcaggatttacacacaattctcctcaaatttcagccagcccgcatcaattagaccttgcaccttacgcttcagagccctataatgctcaatggaacgccccggggctcctccacgataagcacacgttgcgttcgagtcgtatcctcagaaaaatggaggttgaggaaccttggttggggttatggctaccattgaattatcgagtggataggggatcaagtttagcatatgacaacggaatttggggtgaaccctacaggctttttgctgcaaaattcctttttgttggtgttttttggtttgtgctaaaggcggtcttcgtcattggaagtgcggtagacaggctttgtggttga

SEQ ID NO: 50278 - DNA, 180 bp, Glycine max
  Peptide Sequence Number=SeqID_141963
atggtcagtgcattgatgatgctcatgtttcatacttcgtattacatggaaatagaaaaatacttgtacttgggggcatgtcactcggttcagaacttccttaagactcaggttgatcaccatgggggggggggggagttgcctatgcacgacaaggtgaccttgacacttgttgcctag

SEQ ID NO: 50279 - DNA, 1179 bp, Glycine max
  Peptide Sequence Number=SeqID_141964
atggaattttacgccaacctctatgaccccgaggataaatcacctaagcaagtgagggtgagaggtcatctagtgaagtttgatgaagatactcttaacacatttctgaagacccctgtaattttggaggatggggagaatttatgtacttattccaggtttgcactcctaagacctgatcctcaagagttggctgctaagttctgtatcccagggaagggattcgagcttaatgttgatgggcagcctttgaagatactgaggaagaatatgaccaccttagctcagacatggagcgttctttccttttctaacatgattcctacctcccacacatccgatgtgaccttggacagcgccaagtcgatttatggtattattatgaagatggatatgaacttggagtacctcatctgccaccagatctcccttattgcacaacatgatacatctagacttggattctctgccttgatcatagctctatgcaaggccaggggagtccaatcagattctagatccctggagaacttgagccataccattaacttggcatatattaagaagaactattggaatcttgatgatccaacagtgacatttagagggccaaggaaggccaggggtaagagatcagaggtccccactacttcagcagcaccagagacaccaactcctacttcttccacagctccagtacctctcattcagactccagttattcctcctacatttacacagctaccacttccagctcctttatatgcaggaccctcagatttttcatttacaccacagatgcttcattccatggcccagagcttacatagggggcagtccatcatcatgcagagcctacagggcttgggcttgccatccattatgagcatggatgagtttaatatgcaggaacctattcttgaggagccagcagcagcagtagagggggaggatgagctcacacctcctaagccattttattttgatgcagatgcacacatggctcaggaggaggggacttccatagatcaaatacttaagccatctcctgcaccagttcctgaggagacccagccatctacaccagtcacggagccagagcagcctatccaggattcatcagcagctccaacactagatcataatgaagatcagccacaagatgagcaggatgtttaa

SEQ ID NO: 50280 - DNA, 162 bp, Glycine max
  Peptide Sequence Number=SeqID_141965
atggagggaggcataggttccatacaagacctcgctcccaaagaagagaaaaggataaaaggggaatggagaagaagaagagttgagaggagacaccacttcaaggagaagatgagtcaagaagaagctcaccaccatagaaagccatggataagagcttga

SEQ ID NO: 50281 - DNA, 255 bp, Glycine max
  Peptide Sequence Number=SeqID_141966
atggtgctccggcgcgaggtggtatttgacggaggtgaccacggcggggaaggcggcggacatgggagcgcagaagtggtggaacatggtagaggtggcactggctacgatgaagccgccaccgtggaagtaaacgatgaaaggtctttggtgagaactgggagagtggggtctgaagagggtgcggtgtggggaatgtggcgcaagcgagttagggttccgttaaggttgagaaccatgtcgaggtgtttgtag

SEQ ID NO: 50282 - DNA, 315 bp, Glycine max
  Peptide Sequence Number=SeqID_141967
atgctgaaactggctgcaaaggataaatcattcatacacaagggaaataaaaatcctgatcctgtgtatgctcattcgggtccagtgctggtgcagatgatagatcctaagaaagaggcaggtccaacactggtgcagatggctcaggctgaggagatggctctggctcgggtggagtggactctaaggtctctagaatgtcgtcctcctggtcctgctgaggctcatgggctgcagaggcctcaccccctcccaaaggagaaggttggactcctggccaggccaccttctaaagaaattcttcaatgcttataa

SEQ ID NO: 50283 - DNA, 488 bp, Glycine max
  Peptide Sequence Number=SeqID_141968
gactacacgtcctcgcctttaaagggctacacgccctcacctttagaggactacacgtcctcgcccttagagggccacaggccctcgcctttagaggactacacatcctcctcttcagaggactacacgtcctccccttcagaggactacacgtccttagcttccaaggacgacatgtcctcacctttagaggactacacgtcctcgcctttagaggactacacgtcctcgccttcagaggactacacgtcctcgtcttcagagggctgcacgcccacgccttcagagtactacacgtccttgccttcagaggactacacgtcctcaccttcagaggacttcacgtcgtcgccttcagtgggatacacgccctcgtctttagaggactacacattctcgccttcagagggctagacgccctcgcctttagaggactacacgtcctccccatccgaggactacacgtcctccccttcagaggactacat

SEQ ID NO: 50284 - DNA, 774 bp, Glycine max
  Peptide Sequence Number=SeqID_141969
atgtccaaatcttttgaatttgggatgaccggctctctcgatgagtcgatctcttgctttctcataagaatggaccctcggtttctgggccccccccttgatattggagggcaaccaactgtgcaagcacaaccagagaggaaggctatcacgcagctactatgcataccggggcaagatttcacccgtgccgctgcaaaaagacgacaacattctgcccagcaaccacaatgccaatctccccctgcagatgtatcagttggtctgcgtcgtcatgacatagggatcgcgcccacaagacgcccagtggacccgaaaaattccaacagggccctggggtttccagctctggttacgggtctctgtcagtcctacagggtgcccgttcccccagcaaggtcatgccatcgtgacataggaatcgcacccacaaagacacccagtggactcggagaagtccaacagggccatggggtgctcgttccccccggcaagggattgtgcccgcaagacgcgcagtggacctggagaagtccaacagggtcttggagttgccaagctctaattacgggcctctgtcagttctacggagtgcctgtcgcccccagcaaggtcatcaggccccctactaagcgagctttcatcaagaagtactgtgtccccaggcaagtgcagggcgaaacaccacagcagcttggggatggccggcagcgggcaacagacgcaccgccatcacctctagagttcacctcagctgatccacaaaaaggttag

SEQ ID NO: 50285 - DNA, 54 bp, Glycine max
  Peptide Sequence Number=SeqID_141970
ttatgtaaagataagtctaaacgcgccggatcccttaaaatgacgttggatcaa

SEQ ID NO: 50286 - DNA, 708 bp, Glycine max
  Peptide Sequence Number=SeqID_141971
atgaaagctgttgtatttgcctatcacgatatgggttgcacgggcacgctggccctgctggaagcgggctatgacattgcggcaatctttacccatccggacacggcgggcgaaaatcactttttcagctcagtggcgcgcatcgccgccgagcgggggattccggtttatgccccggacgacgtgaaccatccgctgtgggtggagcgcatccgcgcgcttgcccctgatgtcatcttctcgttttactatcgcaacctgatctgcgacgagatcctcggcctggccgcaaaaggagcatttaaccttcacggctcactgctgccagcctaccgtgggcgcgcgccgctgaactgggtgctggtgaacggcgaaacggaaacgggcgtgaccctgcaccggatggtccaccgtgcggatgcgggggccatcattgcccagcaccgcgtggcaatcgatgcggatgaaacggcgctgcagctgcaccagaaactttgcaccgtggcacaaagcctgctgcgcgacgcgctgccagctatcctgaacggcaccttcagcgagaccgcgcaggatgagagcaaagcaagtaccttcggtcgccgcacgccagaggatggtcgtctggactggaaccaacctgctcgccagcttcacaacctggtgcgcgccgtgaccgacccatggccgggggcatacagctttgcgggc

SEQ ID NO: 50287 - DNA, 189 bp, Glycine max
  Peptide Sequence Number=SeqID_141972
atgggtcttcattcttcatctagtgttaatggtgaggattatactcctaaggatcccttgcatagggcacatcctagacctcactcccattggagagaaaaggaaagaaagcctcaagaggctaacattaacctcctatacttccatgggaaggacaatgtagaggctaacttagattgggaaataagg

SEQ ID NO: 50288 - DNA, 557 bp, Glycine max
  Peptide Sequence Number=SeqID_141973
atgaaagcctttcgctggtgtgcagtagcagcgttgatgctggcggcgcttcctcttcgcgccgcctgtacctggcctgcctgggagcagttcaaaaaggattacatcagcgagggcgggcgcgtcattgatcccagtgacacgcgcaaaattacgacgtcggaagggcaaagctatgcgttgttctttgctctggccgccaacgatcgccgcgcgtttgagcaaatactgacatggacgcgcgataaccttgccggcggcaatctcaacgaccatctgcctgcctggctctgggggcagaaagacaaagaaaactgggcggtgattgataccaactccgcctcagatgccgatgtctggatcgcctggtcactgcttgaagcgggccggttatggaaacatccggactacacccgcacgggtaaggcgctgttgaaacgcattgccggtgaggaagtggtgaaagtaccagggctcggcgccatgctgcttccgtgtaaagtcggttttgctgatgaaaacgcctggcgctttaaccccagctatcttcctccgca

SEQ ID NO: 50289 - DNA, 447 bp, Glycine max
  Peptide Sequence Number=SeqID_141974
gttcatcaagtcaaggtcaagtatggaagtaaccagcttgcaaaatttggcgcagaagatggatcgaggaaagaacatgctttacagtgcccataccaaacgcgtgctagagctagagtaatgagtgaaatagaggaggtgcaagagcagatgaaggccgacatggaggccatgaaaaagaaaatagccatgttgagcatgaagaagataatggaggtcaacacggctgcagttgccactaccagcgccgccgctgagggaggcaaagcgttaggaagtacgggcggcccccattttgtgaacaagaattccttcccaccatatggcttgcctcccaactatacaccacccgatgttgcacacgctcctgataagaatgtcaataactccactcccatactctttgagagccaacaactccaatctgatcaagcacatgtctcttaa

SEQ ID NO: 50290 - DNA, 186 bp, Glycine max
  Peptide Sequence Number=SeqID_141975
atgaccaagagcaagggcaaggatccacttgaaggacttggaggacctatgacaagggctagagcaaggaaagccaaggacgctcttcaacaagtgctgtccatactatttgaatacaagcccaagtttcaaggagaaaagtccaaggttttacactcagccattaagtttgttttaattccctag

SEQ ID NO: 50291 - DNA, 536 bp, Glycine max
  Peptide Sequence Number=SeqID_141976
ggcaacagcttatcgctgtcggcgtagacgaaaaaggtttcgccgctgtttttattcacgatcagctgatcgccattgcggaaacgggtaatggcgaccttatcgccgtcctgcagacgcgtgcgctgctgcccggcggcaatctggaaatgccgggttggccacatcagcgtgctgagcccgtaggcggcacgcgataccgtcatggtggggcggcccgggcaggagcgcggcaagggttatcgccttcatgggtgttctccactgaggccagccactgcgggcaggaagaacctctccactccattgattttgcattattcgcgcggctggcgcaatcgccgtttcgccgccgcttccatttaggcgcgaaagagcgacagtactgtattgagaaaggcccggcggtgatcgaccaacacgcggccgattttatccagcaaagactggccgcagccgaaccaaagaatgatggcaaacagacgccaatgcgcggccatccggtggtttatcgcccagcacgccacggcaacctg

SEQ ID NO: 50292 - DNA, 97 bp, Glycine max
  Peptide Sequence Number=SeqID_141977
gtcgactctagaggatcccacgacggagaaaaaaatgatggcaatgatagtagatacattaccagtattctactatgaaaagatggtgggctactga

SEQ ID NO: 50293 - DNA, 191 bp, Glycine max
  Peptide Sequence Number=SeqID_141978
atggcaagtcaagaaaagtgggtcccgtttgcggatatactagctttgctaatctttggggttgtcctctttccgaacgtggacggtttggtggacctagccgcaattaatgctttccttgcatatcaccatagcaaggagagcccagtggtggctatctttgatgcaatcctatcccgcaagggcattgg

SEQ ID NO: 50294 - DNA, 427 bp, Glycine max
  Peptide Sequence Number=SeqID_141979
tcctaacctttctccaccttttgttgcccctattcctcagacatctcaagcatcacctgttaattcaagctctgttcctcttattcctccaggtttttcacccttacctgctcattcccctatcacaactatttttgtaccttgtccctccacttcttctgcacccatccctattcagccacaaaattctaagtctactaaccctacttcatctacttcagagtccgtgtctatacccaactctatcccagtcaatacccaccctatgcaaacaaggtctaaatttggtattcacaaccctagacttcacccttcaccttttctcactcattttgagcctaaaactgtgaaacaagctctagcaagcaaagattggctcattgctatgcaacatgagtatgatcccttgctgaaaaatcatacttag

SEQ ID NO: 50295 - DNA, 288 bp, Glycine max
  Peptide Sequence Number=SeqID_141980
atgaatcctccaccattgcgtccgaagccccacgaattgattgctgtcgcaacctacccttcggcgggagggcgacgcgagactcgcgggatgcgtgttccacgaaaggaatacgcgcggagtcgccaccaacgtttatttgaggaaaacgtcggaataaccggaaaagacgcgatctacgaactttttagtgaaaggttcgggagttgtatttacgcacggggaagggtgtttccctttgctcctacgtattcctcaatttgggatgagaaaatcagacctacgtag

SEQ ID NO: 50296 - DNA, 456 bp, Glycine max
  Peptide Sequence Number=SeqID_141981
atggtttgcaattgctatgagcttctgttttcaatttcgagcatctcgatatattacgggattcattcggacatccgaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 50297 - DNA, 231 bp, Glycine max
  Peptide Sequence Number=SeqID_141982
atggagtcgccaactgttgcaacctacccttcggcgggagggcgacgcgagactcacaagtgcgtcttccaagaaaagaaaatgcgcggagtcgccaccaacgtttattcgaggaaaacgtcggaaaaaccggaaaggtgtggtctacgaactttaagtgtgaaaggttcgggagttgtatttacgcacgggaaaggtattagcaccctatgcgtccgtcacaagggatga

SEQ ID NO: 50298 - DNA, 255 bp, Glycine max
  Peptide Sequence Number=SeqID_141983
atgtcaccctatcaggtggtttttggtaaggcatgccaccttccggtggagattgagcaccgtgcgtattgggcggtgaagagttgtaacatggcatttgatgaagcatttgagattaaaaatgacgttactggcaaggtcttcaaagtgaacagtcaccaactcaagctttttcatgagagcctccaagcggaggaggaatttatggcagacctctctttgatcttgccaattttatgtgatgatatgttttga

SEQ ID NO: 50299 - DNA, 300 bp, Glycine max
  Peptide Sequence Number=SeqID_141984
atgggtgccaagtacctcgaagtggtcaaacgagggtcgcatcccaacaaacggatggcgcataatgaccataatttgtctctgcgttccctcgggcatgatcgagcctggatggcaaggcacagaatgaccataatttgtctctgcgtgccatcggacactatcgcaacgtgcccttcgcgggcgagcgaaggcgaggctcacgggtgcgctttccaaaggaggaaagatgtgcggagttgccaccaacgtttatttgtggaaaacgtcggaaaaaccgaaggaaactggtcaaaatga

SEQ ID NO: 50300 - DNA, 330 bp, Glycine max
  Peptide Sequence Number=SeqID_141985
atgacaaagtacatacctcccacgaggggtctctacggcagggacttccatccaagccttgtatgtcacatcgaccttatcacgagcgcgatccccaaatatgttcttaatttcttcttgtggggaccgtcggccttcccggtcgcaggatcgatgttgaccaccgatctctctgccctaggtagtctagtggccaaggatcatagccatgtggctttgcatgtccgcttcaaggtagatggagatgctgatgctattgcaggaggaggaggtggaggaggagaaggaggaggaggaggcgaggcaggtggagtagccatgggcctataa

SEQ ID NO: 50301 - DNA, 219 bp, Glycine max
  Peptide Sequence Number=SeqID_141986
atgtcccacgatgttaaagataatcgagggaagtgggccccgaactacgaagggccttttgttgtgaaaagggctttttccagaggggccctggggcagaatcgtcttaggcagtggtcagatgccgggacgaagctgaaggcagaaaccaatcaaggtaaaacggtaacgcggccacagtttgccgcgcaatgtcatttcctactttcaggtacttag

SEQ ID NO: 50302 - DNA, 546 bp, Glycine max
  Peptide Sequence Number=SeqID_141987
atgcacaactattatgagaaaggaagagctcctgatcttgaaagtgtattggaagacttcatgacgtaccaagctagctctaaaggtgactgttattccatgcaacagcagggagctcagtttgaaagggactattcttctgtagattatcaatgggagtcaaaatggaaaccttattatcacaatgaagtagaaggattgtctaatctggatgacctgctaatgcaattcaaagatactatagattcaatgcaacaagcctttaaaagaactgaaactcagcttggcaagttggtagatgacatgactaaagttgtggtcagaagagaagaagagtatgaaaagattgaagcacatcaagaaagcattcttcaagttaccacaatccatcatcaattgatcaatgaagaagaaaaggatgaagtctccagtactccagaatatccttgcatggcaactgctggctacgttgtagggacaaataaaggtcgattgccgctcagtgtagaggatcagaaaattattttgacctctttgaagccatga

SEQ ID NO: 50303 - DNA, 883 bp, Glycine max
  Peptide Sequence Number=SeqID_141988
aatcttggcaggtaaaggcgaatgggccccgttcatagacattctcgcattgttgatctttggaggagtcctctttctgaatgtggatgggttggtggacctagcagcgatcgacgcttttctcgcctatcatgaccacaaggaaagcccagttgtcgctatgctagctgacctatatgacaccttcgaccaaaggcatgcttgcccgctagaaagccaccgttcatgcacagagaaaggaggggcaaattgggaccaactcttagcaaacaaagaaggagcgtctgtcaactggttccctcgatggaaagaaggaagaaccggagttcttatttcgtgcggaggatttccaaatgttcccttgatagggacgaggggttgcatcagttacaatcccgttcttgctataaggcaacttggctaccctatgaaaggggcaccattagaggaagagatcgcgcctatcatttcacgaggttttaataggaacaacatggagacacttcagaaggtccgcaaggcatggaaggtggtgcgaaagaaggacaaagaactctgggcagtaacaatgggccctcggtggctaccaaccgctaaaagggaggaagttgaggcaccggaggaagacgaagaggtgcaggcccttttgacagaactcgagcaagctcaaacagtcaaagagaggttcaaatcagcagctctgaagatccgaaaggagaatgccgaactgagagatataaatatagctaccaccaaggccttggaacaagagaccaagagggctcgtagggaagagcacggccggaacaagttccgaggggctctgtggggcatcaacagcgagcttagctccggagagaggaaagggatcaatcacgagtag

SEQ ID NO: 50304 - DNA, 99 bp, Glycine max
  Peptide Sequence Number=SeqID_141989
atggcagaaatcaaccaaggtaagatgatgaccgctcacgatcggtcgcatatcgtttggctcttacttgcaggtaatcgacgcctaattctaacttaa

SEQ ID NO: 50305 - DNA, 818 bp, Glycine max
  Peptide Sequence Number=SeqID_141990
atggttagaacacgaggtctacgtcatgtggtaggcacaggtagaggtagaggacttagtcaggatgtggctgaggatgttcctcaccgtcgtaggcccactgcctcagcacgtaggcaacgggttacccagagagtcgaggatgttcctcagttgcctgaggatgttcctcagttggctgaggatgtgcctcatgtgtttgatggtagcccagagaggacaggagccgccgatggtgccgagtctgatcgagtggctagtaatgggacagctgctgatgatgaggggtttcccggtggaccacacgatccatctgttttgataggatttgctgatcatgtggcacacaacatatggagtggacaggagcgacccgatctcaagttggtctcccatggtaggaaagtagataaatttgggagaccggctgctaagatcgaatgtatgattgcggccaccagattggatccattgatcaggtgttctgtgatcaccactgatcctggactcatatctgcctttgttgagaggtggcatagggagacgagcagcttccacctcctagtaggggaggtgacgatcactctagacaacatttcgtcgctcctgcacattctgattactggcacgctgcattcattcgagctgctggctacatctgacgcagtggccctgttgacggagatacttgaggtcaccccagacgaggctacagctaagacacgtcaggcaggtgggcctcatgttcggttgtcctggcttcgggacatgtaccagagtaggtgtcgggccaggcagtgggttgctgcagctcgggc

SEQ ID NO: 50306 - DNA, 441 bp, Glycine max
  Peptide Sequence Number=SeqID_141991
atgcataaggcattgcggtctggtgcacctctcccttaccctcagcttgtgactttatttcttcaacattttgaaattcctttggattctgagccttttgtgctagttaaacgctcctttgctattggtgctggtgcggtaacctcctttggctaccgtaaggacgtagatgggcagtggctgaagaaggacgcacaacctctgcaagacgagtgtactccctctcctccacctcaacgagatgattcctcggtcctcatgaatgaagttcttttggaattacgaggcctttgcacctatgttggtgaacgctttaattccttggatggtcgcatagatgccattgatgctcgctttgaaggaatggatacccgcatcactcagcttgaaaaggatgtgagttatcttcgtcggtgcttcgaccttccaccaccttcctag

SEQ ID NO: 50307 - DNA, 912 bp, Glycine max
  Peptide Sequence Number=SeqID_141992
atggccctaaaaaagcttcccacgaaaaggtccaggaagcacaccaccggagcaggctccaatgctgccccgcaagctgacatggacttcgattggcaccgattctggagcaccgagcatcatcagcactttaagaccatcaagggatggcactgggcaccacttgtgacacccaaggctaaattcgactcggagatatggattcccttcgacacaaatgccctcaatcagttcctaggccacccactggttttggtggagggccaacagtgtgagtacaaccagaggaggagacaggtctctggctttgatgaggtggccattgcccagctgttgtgcataccgaggaaagatttcactcggaccgctgcaggaagaagggtgcggatcatgcgcaccagcatgaccacccttacccatatatggatgatgttgctatgcagcaacattctgcccagcgaacataactctgacctccccctgccgaagtgccagttggtttatgctattctgacacaagtgagtgtgcacgtggctcagctggtttctaacgacatttatcaatttgcaggggcggcacctatgaggcaccttatagacctggagaggtccaatagggccttggggtttcccgctctgattacgggcctctgtcagttctacagagtggttgtcacccccagcaagggcgaggcaccacagcaacctggagacggccatccgcaggcagccgatgcaccactatcacccctggagtccacctcagctcacctacggaggttggagcgttgcataaggcatgtggctgaccagcaggcagccaaccacagagggcccgcggggacctccggaggtggggacgaagcccaggaggatgaggacatggccgacttgatagacttcctcttgtga

SEQ ID NO: 50308 - DNA, 336 bp, Glycine max
  Peptide Sequence Number=SeqID_141993
atggaaggatattcagccaacaaggacagtgtggatgacactgtttgcgaaaaatatggcattagcaaggaggacgtgtggaaaaaggcacaggccatccaaaagcaaaacactgtcccccacgtgttgtctcgtaggggttatgaatatttaaaacagaagctgatggctaagaagacaaagaaaaaactggaggaagttgctcaatccagaagcactgaggccatgattgaccctccatctcccatcagacgacacgtgaagtggaaaatggtctgcaccaagaaaactggccaaatgacgtctaaggcagcaaaggaaattgttgagaagatt

SEQ ID NO: 50309 - DNA, 277 bp, Glycine max
  Peptide Sequence Number=SeqID_141994
atgatgagaatcatgaaactggccaaatacaggctaaaggcccaagtggagaaggacgaaggcccaagtaatccttgtggcgtctaccctgacttatcttccttcactggaagtggcgtctacccagacttatcttccttcaccggaagtggcgtctaccctgacttatcttccttcaccggaagtggcgtcatccaaaaactctacagcctgtatcaagtgatccgccccgtaaggttcacatcatctggtatcagagcttcggctcttgatacag

SEQ ID NO: 50310 - DNA, 524 bp, Glycine max
  Peptide Sequence Number=SeqID_141995
gagcatctgtcaactggttccctcgatggaaggaagaccagagttcttatttcatgcggaggatttccaaatgttcccttgatggggacgaggggttgcatcagctacaatcccgttcttgctataagacaacttggctaccctatgagaggggcgccactagaggatgagctcacgcctatcatttcacgtggtttcaataagaccaacgtggagacacttcagaaggccattgcctccctcgcccagtattatgatccgccattaaggtgcttcacctttggggacttccagctatcacctatggtagaagaatttgaagagatcctaggatgccctctaggggagaactggacaagcccatacctcttctcagaaagaggaaagtgggcctcgttcagtagatattctcgcactgttgatcttcggaaagatgagtcctctttccgaatgtggagggttggtggactagcagcgatcaaagacaagcttttctcgcttatcataatcacaaggaaagcccg

SEQ ID NO: 50311 - DNA, 453 bp, Glycine max
  Peptide Sequence Number=SeqID_141996
atgcagtggcacgacaggtttcccgagtggaaagcgggcagtgagcgcaacgcaattaatggaacaaaagctggtaccgggcccccccttgaggtcggcggtatcgataagcatgatttgccttgcactgttcgcctatcctccattctccacttttcttctgagccccatgaattgattggcactcatgcatcctccaccaacgagtctggagccccacgaattgattgcctagcactgttcgcctatcctccattctccacttttattcggagccccatcccgggggatccactagttctagagcggccgccaccgcggtggagctccaattcgccctatagtgagtcgtattacaattcactggccgtcgttttacaacgtcgtgactgggaaaaccctggcgttacccaagttaatcgccttgcagcacatccccctttcgccagctga

SEQ ID NO: 50312 - DNA, 177 bp, Glycine max
  Peptide Sequence Number=SeqID_141997
atggctaccaaaggttggagctttgttggagcttcaatggtggaggaagaagaagagaatggcaactccctcgcgtttctctgcacccgtcggggccagttttcgaaagtaggcaatatatatatcaaaacgctcagaatgaaaccccgagcgtggttcagaggttggttttgttaa

SEQ ID NO: 50313 - DNA, 476 bp, Glycine max
  Peptide Sequence Number=SeqID_141998
tttgtgttgtttgaatgttgaattacttggatgttggggaaagcttgggaggattgatggggacccggtgttgagagaaacgaggatatgggctacgtgggcgtacgtgagctcagttggaggtgggcagcaggggatggtgggtttatgcgcgatttgtggatgtggaaaactgttgtgcaccatcgcccgaccgccacctagtaccacatgtgatggagtggtacctggagatatgtcgcgggggtcaggagaccttggggacgtcaggcgagctcctggcagtcaacagataaaaggaacaaagaccacaaagcaaggaggcttgtggtggctggccagctgtgaatcttgtgtgatatatgggttgtggcctctggtaatcgattaccaagggcttgaaaacgaggttgtggaggcctctggtaatcgattaccagtctgtgtaatcgattacacagaggaatgggtcactg

SEQ ID NO: 50314 - DNA, 363 bp, Glycine max
  Peptide Sequence Number=SeqID_141999
acttatcaaggtaatccttgtggcgtctaccctgacttatcttccttcaccggaagtggcgtctaccctgacttatcttccttcattggaagtggcgtctaccctgacttatcttccttcaccggaagtggcgtctaccctaacttatcttccttcaccagaagtggcgtcatccaaaccttcgtagcctgtatcaaacgatccgccccaggttcaactttcaattttgagcgtctcgttatattacgggactcaaaaagacatccgagaaaaaagttattgtcgtttgaattcgctcagagcttcaatattcaatttcgagcgtctcgttatattacgggactcaatcagacatccgagtaa

SEQ ID NO: 50315 - DNA, 240 bp, Glycine max
  Peptide Sequence Number=SeqID_142000
atgtcgttcaccaaaggaaagatgtctgtaaatgagatgactctgaagaaactctccacaaagaggtctagaagggacgccactggagaaggctctagtgccgcctcagagtttgatagtcactggttccggagtgttgagcaccaacagcgcttcgaggccatcaagggatggtcattccacagggagaggcttgtccagctcagggaaaacgagtacctgacttccagggagagatag

SEQ ID NO: 50316 - DNA, 576 bp, Glycine max
  Peptide Sequence Number=SeqID_142001
atgcaagcttatcgattaccgtcgtacctcgatggtgttttgaggtgctccagcggtcacgctgcgactaattccaccacaacatacgaccgcgaagctataaatgtaaacgccgtacagggcgcgtttcgcctaattcagagtgcagctaactgcaattgggaaggttgcgatcggtgcgggcctcacttgcccgctattacgccagtcgggaaacctgggatcgtgctgcaaggctgcattaagttgatcggtccaacgcgcggggaggcgttttcccagcacgtacgttgggcgctaaaacgacggccagtgaattgtatactggcttactatgttggcactgatgagggtgtcagtgaagtggagcttccaccgcgtgtggcaggcgctcagaaaaaagctggccaccggtgcgtcagcaggaatagtgatacagatattgtgaaattccaagcttcctcgctcactgacctcgactacctcgagtcgttcgactgcggcgagcggaaatggcttacgaacggggcggagatttcctggaagatgccaggaagatacttaacagggaagtga

SEQ ID NO: 50317 - DNA, 120 bp, Glycine max
  Peptide Sequence Number=SeqID_142002
atgtctttaggcacaaatgaaggaaataaaattcagaatttaggaattcaagttaagtggtggctggacagaaatatagaaatggcaataactgaagctacagggctccaaatgaggtga

SEQ ID NO: 50318 - DNA, 770 bp, Glycine max
  Peptide Sequence Number=SeqID_142003
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggctcaatcaaacatcaacgagtatctagtaaagcagattcacttgagccatctcagagcacgactgtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50319 - DNA, 210 bp, Glycine max
  Peptide Sequence Number=SeqID_142004
atgagtgaccaagaggaaatacaggaacagatgaaagccgacatgtcggctttgaaagagcaaatggcttccatgatggatgccaggctaggaatgaggcaagtaatggagaataacacagccaccgctgccgctgttagttcggctgccgaagcagacaaaactctcccagctaccgcgcatcatcctatcccaaacgtggcaggatga

SEQ ID NO: 50320 - DNA, 140 bp, Glycine max
  Peptide Sequence Number=SeqID_142005
ggggagaatggaggattgccttgagggtccatactttggcaatcatgaaacatagctccaaactcgaagggtccgcacttatggcaatcatgaaacatagctccaaactcgaaggtggaggacacatgaacgcgtgctag

SEQ ID NO: 50321 - DNA, 551 bp, Glycine max
  Peptide Sequence Number=SeqID_142006
atgagcggagcgccaacagaagaaagtctctcgcctttccttgtgagggatctaggcgcgcaaagtctcaaggtgatacaaagagtccataaggcgtggagaagtcgattgaggaaagacaaggagcttagaggcatccaaaatggcgtcatcggtggttatcgtggatggctaagagttcacacgcgagggttagattggctctccaaattgaaagttatcaatgaggagaacttcgaagctccggaggaagatgaagaagtccaagctctaaaattagagctagggaaggcaagactcgcgaaggagaagttcaaatcagccgctacacacatccggaaagagtataccgagttacaagaggaaaacgcggtcactgcaagagaccttgaacaagaaaccaaaagggaccgtaaggaggaatatggccgagagaaattccgaggagcattgtggggtagcaacaatgagctcaagctccgaagagaggaaagagaccggtcacgggagcatggcatgatcttaaaagaagagttagctgcgtgcgcaag

SEQ ID NO: 50322 - DNA, 136 bp, Glycine max
  Peptide Sequence Number=SeqID_142007
atggcggtcaccggtggtcagtggtggtggaggaggagcttgggggtgttaggggagggtttaagggaagagaaggaggaagaaaatggctcatttatgctgctggacgtatttgtagcctgcaacactcgccaag

SEQ ID NO: 50323 - DNA, 151 bp, Glycine max
  Peptide Sequence Number=SeqID_142008
gaatagtgggggcacgatatgcggggcgacgcgagactcgcgggatgcgtgttccacgaaaggaatacgcgcggagtcgccaccaacgtttatttgaggaaaacgtcggaaaaaccggaaaagacgcgatctacgaactttttagtgaaag

SEQ ID NO: 50324 - DNA, 150 bp, Glycine max
  Peptide Sequence Number=SeqID_142009
atgtatatctggcaacacaaagttaatgacagtgctcagaatattggattaagcaattcaaaaggctgtgcttcagtttcttcacctgaaaatcaaaattatatgtcctcagctaatgagcccgcaattaatagagaaggtaacaattaa

SEQ ID NO: 50325 - DNA, 696 bp, Glycine max
  Peptide Sequence Number=SeqID_142010
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttctcgcccccgttttcaccatgggcaaatatatacgcaaggcgacaaggtgctgatgccgctggcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 50326 - DNA, 390 bp, Glycine max
  Peptide Sequence Number=SeqID_142011
atgcctcaaaatgttctttacgatgccattgggatatatcaacggtggtatttgaattcggacgcttacataccgtgcgctcggggtgatgctccggtaagctttactgattccctagtgtatgatggtgttaatttcgaggtgctccagtggcgtaatcatggtttctatcagctgtcccttcctgttcagctactgacggggaatggtgttatccgtcaattcggcacacaagctaccgagccggaagcatcagcgctggcaagtgtaaagcctggggtgcctaagacgctgcagctaactcaccacttacccattgccgttgcgcttcactgcgccgctattccagtcggcgaaacctgtcgtgccattcgctgcattcaaggctga

SEQ ID NO: 50327 - DNA, 329 bp, Glycine max
  Peptide Sequence Number=SeqID_142012
atggctaagtggattgctttaaggaacctcatgctagaggacactgagacacaacgctctgataggatgtggcattggggcatggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 50328 - DNA, 566 bp, Glycine max
  Peptide Sequence Number=SeqID_142013
ggggaaacgcctggtatctttatagtcctgtcgggtttcgccaccactgatttgagcgtcagatttcgtgatgcttgtcaggggggcggagcctatggaaacaacggttatgcgcggaccctctcacttccaacggtgtctaagtatcttcctggcatcttcgaattccgccccgggggattcaacactgtcgtgactggaacaccctggcgttacagccaactagtaatcgccagtatgcagcacatccgccctttagcgccagctggcgtaatagcgcaaaggcccgcaccgatcgcccttcgcgcaacagttggccgattcagcctgaatgcagcgaatggcgacagccttgtgcaccccaggctttacacttgccgcgctgatgcttccggctgcatcacccctcgaggcgcacggtattgcgcaataagctatacctgtgacatccttggagtgaaacgtaccacggtatacgcagaattccaaagtcaaatcctggtgtccctgttgataccgggaagccctgggccaacttttggcgaaaatgagacgttgatcggcac

SEQ ID NO: 50329 - DNA, 186 bp, Glycine max
  Peptide Sequence Number=SeqID_142014
aacgggttgagggggtaggtgtagttgatataaaggaagtaataaattggggtttatcaggacccatgcttcgggcttccggaatacaatgggatctccgtaaagtggataattatgaatgttaccgaagaattgattgggaagttcaatggcaaaaagaaggagaacaatacaattccttagctc

SEQ ID NO: 50330 - DNA, 285 bp, Glycine max
  Peptide Sequence Number=SeqID_142015
atgacatcatcaaaacaccaaagtcaaagtctttacttctacaattttatggttaacgctgtctctagaacatatccattggatttaatgatgaaatttgtgcattttcagctcagcagttgggctaagcgtgcatccactgctaagcgtagcttcagcatgcttagcgcgaaggagaatctggcagagcatcaacatcaaagccgcgcgctaagcgcagcaggtgccttcagccaggctaagcgcaagactagcactaagtccaattccacttactcgcgctaa

SEQ ID NO: 50331 - DNA, 761 bp, Glycine max
  Peptide Sequence Number=SeqID_142016
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttctaccctacctacacccctgattatggggctgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50332 - DNA, 369 bp, Glycine max
  Peptide Sequence Number=SeqID_142017
atgtggcaggttagctcgcctgggcgagcaacccctgcactaaaatataaaaacaagggaggggacgttttttgcactcaaaaactccccccccccccctcattcaaaaggagaaagcttacgggactcacggtttttgctccccccagccacctttggttgcattttgctttcatttttggtactcctactcactcccacaagtttgtatgggaaggccctaggcctatgttggattctaaaacaatggggcatggcacattgcccccactctcttggtattcattcctaaacatgcgcccacgaagtggtcgggggaatgcctcaatgacatatgaacatgggtttggacagcatgaaggaatttaa

SEQ ID NO: 50333 - DNA, 191 bp, Glycine max
  Peptide Sequence Number=SeqID_142018
acatcctcaccacttgtgtttttgcagtctttcatcttgttcttctctttgttgtaaaggaggtttctggactatggaaagctaaatcctctgttggatcttcccttggaaactggtctgattctaaagtccttgatagtacgggactaagttgttgtgctatcacgaggaatcggggtacaagaacttag

SEQ ID NO: 50334 - DNA, 144 bp, Glycine max
  Peptide Sequence Number=SeqID_142019
atgtgggtgtcgagggagtggtttccggcagatttcaggcgggaggagaaagagaagagcgatttcaggcaggaggatgacaaagagaagagggagggcaagttaaccgatgttaacatcaaatacattacgtcggttttttaa

SEQ ID NO: 50335 - DNA, 285 bp, Glycine max
  Peptide Sequence Number=SeqID_142020
atggaatgcccaagggctcctccacgatatgcacatgttgcgttcgagtcgtatcctcagaaaaatggaggtttgagggaacctagcaggggttatggctaccattgcattatcaagaatggcagtcacaacatgggcttctccctcatcctcaccctctttcatttgccccagttttctcattcgtccaagcaggaagacgaatatattagcacttttgatcagacccacatcgatcctttcactggcaaagaccagatccgctcagctttgaaggtgccgtag

SEQ ID NO: 50336 - DNA, 258 bp, Glycine max
  Peptide Sequence Number=SeqID_142021
atgggttggaaaaagggcatgcatggtttgccagcaaacatagaatctgatgaagcagcagtaacccaagcagatcaactccctgactctgcacacctacgccctaaagcttgcgctcagcttatgggtgtgtcgatagctacattctggcggttagtctctactggcaaattaaaaacccacaaactcacagaaagaacgaccacggtcagagctggcgacttgcgcgcgtttatgtctggaaaagtggagggctaa

SEQ ID NO: 50337 - DNA, 573 bp, Glycine max
  Peptide Sequence Number=SeqID_142022
atggaccatatcgtagccaaggtgctcatcgataatggttccagtttaaacgtgatgcctaagagcactttggagaaattaccattcaatgcctcccacctaaagccgagttcaatggtggttcgtgccttcgacggcacccgccgagagccttgcctgtccgatgcagctgtaatgatggcccgagttatgttggggaacggttacgaacccggaatgggtttaggcaaagacaacggcggcataactagcctgataaatgccaaaggaaatcgtgggaagtatggtttaggctataagcccactcaggaagatataaagagaagcatcgcgggaaggaagagcggtagtcaaagctcgcggttgagacaagaaagtgaaggaagcccgccctaccacataagtagaagctttataagcgcgggtctgggagacgaaggtcaagtggtcgcgatatatggagatgatgttccgagtacattggatttggtacgaccatgccctcctgatttccagctgggaaattggcgagtggaggaacgccccgacatttacgcaatgagcataatgtaa

SEQ ID NO: 50338 - DNA, 113 bp, Glycine max
  Peptide Sequence Number=SeqID_142023
atggttcttagagatggagaatatataagtgaatctgatgttgaagaggaagaggagagtgagtacgtagaggacgaggagacttcggagggagatttgttgatgattaggca

SEQ ID NO: 50339 - DNA, 317 bp, Glycine max
  Peptide Sequence Number=SeqID_142024
ccgaggcgcttccgaaacgtttccgtaacgttttccgtgaggaatttcgcaaaggtttcaaccgttcttcgacgttcttcattcgttcttcatcgttcttcgatcttcaacggagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 50340 - DNA, 179 bp, Glycine max
  Peptide Sequence Number=SeqID_142025
atggcaggacgtggtagggatcataaccgtgatgtcctcgaccggatcacaactgtgttggaaactctagtgcaggaacgtgatgtggagccggcagagtatcggggactcatggctttccgtaagaaccacccgccgatgttcagtggggactatgacccagagggtgctaggttatg

SEQ ID NO: 50341 - DNA, 195 bp, Glycine max
  Peptide Sequence Number=SeqID_142026
atgacttcaaaagaattgaacgaggagccatatgaagtgaaaatctcatgtacgaataggtccgagtcaaatagcaatgattcgaagcactctacactattttggaacccaaggactcaatcgtatggatatgtaaatacaggatttccaatcctagcaggaaaagggggggaacggatactcaatttcaagtga

SEQ ID NO: 50342 - DNA, 72 bp, Glycine max
  Peptide Sequence Number=SeqID_142027
ggtctggaagaacaaaactgtttttcaggttcgtgtgtgtgccgcttcacgttcaatttgcaatggttggag

SEQ ID NO: 50343 - DNA, 1023 bp, Glycine max
  Peptide Sequence Number=SeqID_142028
atgtacaaaagtatcatcagacccattctgttcaaatttgatcccgaggaagttcatcatttaacattttcaatgcttaagaattttggatttctcaccaaactattttttcctaaaccaatcgaagataaacgtcttgaaagagaagtttttggcttgaaatttaaaaatccggtaggcttggcagccggttttgataagaatgcagtgctttttgaagaactcgctgatcttggttttggttttgtggaaatcggaacacttacacccaaaggccaaccgggaaatgacaagaaaagactttttcgcttaaaagaagattcagccattatcaataggatgggcttcaacaatgaaggagtagatgctgctgttgaaaggcttaagaaaaataaaaatgtactgatcggtggaaacatcgggaaaaataaagtaactcctaatgaagaagcggtaaatgattacaaaatttgttttgagaaacttttcccgtatgtagactattttgttgttaatgtaagctcgcctaatacacccaaccttcgtgaacttcaggataaagaacctttaactcagcttttgggaactttgcaacaaatgaataacggaaaagccaatccaaaaccaatccttctaaaaatagcacctgatctatccgatgatcagttgttggacattatcgatattgtaaaggatactaaaatagcaggagttatagcaaccaatactacactttcccgcgagaatcttagttccgagaataaatctgaaaccggaggattatcaggaaaaccactagctaaaagatctacagaagtgatccgttttctttctgaaaagagtggtagagcatttccgattatcggagtgggaggaatccattctgcaaaagatgcaattgaaaagcttgatgcaggagcaagccttatccagctttatacaggttttatttatgagggtccggaattgatcaatgagatcaacaaagaacttttaaaaagggcttcaagattacctagataa

SEQ ID NO: 50344 - DNA, 195 bp, Glycine max
  Peptide Sequence Number=SeqID_142029
atgaagaaacaacaatggaagagaagcggaagacaaaggagaagaggtgagaggaggcaccatccactagggaataagccatggaagaaggagcttcaccaccatgttgagccttggataagaagtttggagaggatgcttcaatggaggaaaagaaagagggagagaaagagagaggggggagcacgaaattga

SEQ ID NO: 50345 - DNA, 631 bp, Glycine max
  Peptide Sequence Number=SeqID_142030
atgctacagtgcgaggggtatttctcttatctcagacataatatcaaaattcccaacggtgagaatgctcgtaattgggttgcgaacgtggtgttcaaatttcacaacgatccaacggtgaatgagtccgagatcatcattttttctaagacaggctcaaaaagagatattattgttgaaactcaaaatggagaattacaaagaatccatgaactacaccctagttatctatcactacagtaccctctactatttccttatggagaagatggatataaagctgacatacttcaccgttctacttcatctagcaaaaaaagaaagcgaaatcgtctgacaatgagagagtgttttgcttatagacttcagttcaagtcaaatgaagcacagactttattgcattctcgaaaattatttcaacaattcattgttgaaggttataccatggttgaatctataagacttagctacatcagaaacaaccaaaagaaacttagagttgacaagtattgtagcttacaaaattcattggatactggaacagctaaaggcttaaccaaaggcaaaagagtcatcttaccttcaacgtttgttgggagcccacgttatatggatcaactttactttgatg

SEQ ID NO: 50346 - DNA, 93 bp, Glycine max
  misc_feature (22)..(22): n is a, c, g, or t
  Peptide Sequence Number=SeqID_142031
atggcctttgtggataactggncggtgggtaaggaggaggaactgaggccaatttgtccacatcatattcttgacaactcgcttttgctctaa

SEQ ID NO: 50347 - DNA, 306 bp, Glycine max
  Peptide Sequence Number=SeqID_142032
atgtcaatccttatcctcagaagcaaaaaagaagagaagggaaatttccaatcaaagaaaaagagaaggaaaatttccaatcaaaggaaaaaaggaagcaagggaattcccaatcatgagtgggagaaagaaaacagaaaagaaagaaaattcccaaccaaaggatgggagaaacgactttttcaccccgcactaaacaaaaacagaaaaggaaaagccaacaaaaaatcaaaagccaaaaacacacaaaagccgaaaaacccaccaaaagaacccattcccaagggaagtcctattgatccatga

SEQ ID NO: 50348 - DNA, 932 bp, Glycine max
  Peptide Sequence Number=SeqID_142033
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcgagtccaggagcgtccacgctgcagggagtgagttacgacggcaccactgccggggtgacggagcgagatgccgtctctaaatcagtcaatgagatcactggaaggcgctctctgcgtctcactttccaagagggtctctttgggccaagcaggcatggtgcctcccgccagtcatcccagcactttgggagatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50349 - DNA, 324 bp, Glycine max
  Peptide Sequence Number=SeqID_142034
atggtgcagatgaccatacaaaaaggtgcggatgaccaagttttgtctttgcgtgctgtcgcaacgtgcccttcgcgggcgagcgagggcgaggctcacgggtgcgctttccaaaggaggaaaggtgcgcggagtcgccaccaacgtttatttgtggaaaacgtcgggaaaaccgaaggaaaccagtcaaatgaaaattctaagttcgggagttgtatttacgctcgaggaaggtcgacaaaagtggggcttttgctcctacgtaccctcctttggagaggaaatcagacctacgtagttcttacttatgcatggatcaagtga

SEQ ID NO: 50350 - DNA, 504 bp, Glycine max
  Peptide Sequence Number=SeqID_142035
atggtcatccaaaccccttttgctatccaaagacaatcaagtccaatggcacgtggagacaaaacttggtcatccgcaccctttttgctatccagagacaatcaagtccattggcatgcggagagaaaacatgatcatccgcaccctttatgctatctagagacaatcatgttcgattgcacgcagagacaaaacatggtcatccataccttctttgccatccagacacaatcaagtccgatggcgcgtggagacaaaaagaaacaatcaaggccgatggcctgcagagacaaaacacggtcatccgcaccctttttgctatccaaagacaatgaagttcgatggcacgtagagacaaaacatggtcatccgtaccttgtttgccatccagagacaatcaagtccgatggcgcgtggagacaaacatggttatccacaccatttttgctatacagagacagtcaagtcggatggtacccggagacagaacatggtcacacatag

SEQ ID NO: 50351 - DNA, 450 bp, Glycine max
  Peptide Sequence Number=SeqID_142036
atggcacacagagaaaaaacatggtcatccactggtgcaagctccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggccatggataagagcatggacgaagaaggagatgaatgaagggagagggagagaaatagagaggggggagcacgaaattgaaggaataaaagaggtagagaagtggtattcagagacaatcaagtccgatggcacgcgaagaccaaacatggtcatccgcctttttacaatccagagacaatcaacttcgatggcacgcagagacaaaacatggtcatcgacacccttttccctatctagagacaataaagtctga

SEQ ID NO: 50352 - DNA, 1020 bp, Glycine max
  Peptide Sequence Number=SeqID_142037
atgggatcgagtcaagcgccttcgcttaaaaagaggttctatcaagtcaaggtcaagagcctaggaaccaccagtctaaaagaattggggcagttgatgggccagctccagcaacaagcgtttcgcaaagcttatggtaaaatctgggacctagccatggcagaagtctctacagaggccattgcctcccttgcccagtattatgaccagccgttgaggtgcttcacttttggggacttccagctatcacccatggtggaagaatttgaagagatcctaggatgccctatagggggaaggaaaccatacctcttctcaggattctatccctctttagctagaatttctaagatagtccaaatctcggcgcaggaattagaccacagaaagcaagtaaaaaatggggtggttggagtaccgagaagatgtttggaggcaaaggcaataatcttggcaggtagaggcgaatgggccccgttcatagacatcctcacactattgatcttcagaggatttctctttccaaatgtggatgtgttagtgggcctagcagcgatcgacacttttctcgcctatcacgaccgcaaggaaagcccggttgtcgctatactagccgatctatatgacaccttcgaccgaagatgtgagaagagcagtgcaaggattgtttgctgtaccccggccttctatgtgtggttggtttcacacctttgtcgccaagaagtgaggcatccttgcccactagaaagccaccgttcatgcacagagaagagaggggcaaattgggaccaactcttagcaagcaaagaaggagcatctgtcaactggttccctcattggaaagaaggaagaattggggtttttattccgtgtgcaggatttccgaatgttcccttgatagggacaaggggttgcatcagttacaatcccgttcttgttataaagtcaacttggctaccctatgagaggggcaccactagaggaagagctcatgcctattattgcacgaggtttcaataa

SEQ ID NO: 50353 - DNA, 604 bp, Glycine max
  Peptide Sequence Number=SeqID_142038
agggctacacaccctcgccttcaggggactacacgtcctcgccttcagaggactacacgtcctcgccttcagagggcaacacgccctcgcctttagaggactacacgtcctagccttcagagggctacatgccctcgccttcagaggactacacttcctcgccttcagagggctgcacgtcctcgccttcagaggactacacgccctcgctttcagaggactacacgtcctcgcattcagagggctgcacgccctcgccatcagatggttgcatgccctcaccttcagaggactacatgccctcacctttagagggctgcacgccctcgccatcagaggactacatgtcctcgccatcatagggctacacgacctcaccatcagaggactacatgccttcaccatcagagggctgcacgccctcgccttccgaggactacacgtcctcgccatcagagggctacacgacctcaccatcagagggctacacatcctcgccttcagtggactacacatcatcgccttcagaggactacacgtcctcgccatcagagggcaacacgccctcgccttcagaggactacacgtcctcgccttcagatga

SEQ ID NO: 50354 - DNA, 821 bp, Glycine max
  Peptide Sequence Number=SeqID_142039
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttttcaatgcaatccatgcatgtttgttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50355 - DNA, 360 bp, Glycine max
  Peptide Sequence Number=SeqID_142040
atggggacaaggggttgcatcagttgcaatcccgttcttgctataaggcaacttggctaccctatgagaggggcaccgctagaggaagagctcgcacctgtcatttcacgaggtttcaataaggccaatggggagacacttcagaaggtccgcaaggcatgggaggtggtgcaaaagaaggacaaagaactcaagggcagtaacaatgggcccatcggtggctaccgaaggtggttgaaagcccacgtgcaaggtttggattggctcccaagtttgagaaccgctagaagggtggaggttgaggcaccggaagatgacgaagaggtgcaagcccttagggcagaactcgagcaagcctaa

SEQ ID NO: 50356 - DNA, 126 bp, Glycine max
  Peptide Sequence Number=SeqID_142041
atgcgtcctccgttatcaagtacggagcctacggtgaggggaaaatacgagaaagaagaaggagagacgggagtcacttatttcaaatcgttttgggttggaactattgtgattgagatcaattaa

SEQ ID NO: 50357 - DNA, 546 bp, Glycine max
  Peptide Sequence Number=SeqID_142042
atggggcctcatcaagaagaggcaacactagtggacttaggaaccggcagtgggaaaaaggaagtaaagataggcatgggtatggccgcacccatccgtgaagaattgatagccctgctaaaagactaccaagacatctttgcttggttgtaccaagaatttattttcttcttgaattggttaactaatgttcctgttagtgcttgcatgcgtagatcttctgtaggtgaattggttccattggatttagaaattgaagcaaccttcagaagaaacaatgcagagagaaaaagaaagattttgcatgatagaacagtagcatcaatccttgaagaggctcacttttctgagtcatcatcttctaattcacctacatccatggaatctcaaacagcagaatttgaagctgaagtcatggctgaagagcaacctcaacgagtgaccctagaagattactcaagtacatctgtgccgcagttctttactagcattgtgcagctggaggttcaagcacataatataacctatccacattcattaatttag

SEQ ID NO: 50358 - DNA, 607 bp, Glycine max
  Peptide Sequence Number=SeqID_142043
atgagtgaactcaagcttccgaaagacgaccgcagcatcgaggtctacagattatccggcacgccggtcgcggttgaaaaacgaagtgccgccgatttcaaccgcgtcgctttcgcggccgcccacgtggtggccgatccactcgccgacaacgacccgtggctgacccccgcgatcgattgggatgcgaccttgcgtttccgtcatcgcctttgggacctcggcctcggggtcgcagaagcgatggacacggcgcagcgcggcatggggctggcatggccgcaggcccaggagctgatctcccgttcgctcaaggaagccgccagccgcaaggatgcgctgattgcctgcggggtgggcaccgatcatctgaacggcagcggttacgatctgaatcagattgtccactcttacctcgaacagcttgattttgttcagggagaaggcgggcgagttatcctgatggccagccgcgcgctcgccgccgccgcccgttcgcccgatgattacctcaagacctacaccagggtgctttcccgcgccgagcagaaagtggtgatccactggctgggcgaaatgttcgacccggcgctcgagggctactggg

SEQ ID NO: 50359 - DNA, 855 bp, Glycine max
  Peptide Sequence Number=SeqID_142044
ccgccattgacgctttcctcacgtatcaccatagcaaggagagtccagtggtggctaccttggcagatttgtttgatacctttgaccggagatgtgagaaaaacagtgcacggattgtctattgtttacccgctctctgtgtgtggttggtttcacacctattccaacaagacacaagacacccgtgtccgcttcaaagctatcgctcatgtgccgaaaaaaggaagggtcgattgggaccaacatttggctggaataggaggcaacgcaatcaattggtttcctcgttggaaggaaggcaaggaaggagttctcttctcgtgtggggactaccctaatgttccattgatagggactaggggcgcgcaaagtctcaaggtgatacaaagagtccacaaggcatggagaagtccattgaagaaagacaaggagcttagaggcatccgaaatggcgtcatcggtggttatcatggatggctaagagttcacacgcgagggttagattggctctccaaattgaaagttatcaatgaggagaacttcgaagctccggaggaagatgaagaagtccaagctctcaaaattagagctagggaaggtgagactcgccaaggagaagttcaaatcagccgctacacacatccggaaagagagcattgtggggtagcaacaacgagctcaagctctgaagggaggaaagagaccggtcacgggtccaagaggagtttggctcaatgcttggaagccacggagcaaagcatgctagctatcatagggcagtacaaggaagagttgaaccagtctgtgacccatgaacaaaagctagtggaggattttgatggcccacataattag

SEQ ID NO: 50360 - DNA, 283 bp, Glycine max
  Peptide Sequence Number=SeqID_142045
atggggatcgcacccacaagacacccagtggacccggaaaagtccaacagggccctggggtttccagctctggttacgggcctctatcagtcctacagggtgcccgtacccccccggcaaggtcacgtcatcatagctctaattacgggtctctgtcagttctacggagtacctgtcacctccagcaagggcatcaggccccctactaatcgagctttcatcaagaagtactgcgccccagacaggcgcaaggcgaaacaccacagcagcattgggatggccg

SEQ ID NO: 50361 - DNA, 397 bp, Glycine max
  Peptide Sequence Number=SeqID_142046
atggcgatatatcccgcatgcgggaaagcgtgcggaaattatgttgaggtggttatgtttagaaaattggcagcagaatgctttggtacattctggctggtatttggtggctgcggtagcgccgttctggcagcagcattcccggaattaggtattggttttgtcggcgtggcgctggcctttggtttaaccgtattaaccatggcctttgccgtgggtcatatttccggcggtcattttaacccggccgtgacgttgggtttgtgggccggcggtcgtttcccggcgaaagaggtgatcggttatatcgtcgcccaggtggtgggcggtattattgccgcagccgttctgtacgtcatcgccagcggtaaagagggcttcgacgcggcagccagcg

SEQ ID NO: 50362 - DNA, 402 bp, Glycine max
  Peptide Sequence Number=SeqID_142047
atgacgccagagcagcagcaaatcctgctgcgggcttcagccgcatcgacgttctctggtctcattgctggtgtcagcgggccatcgggtcagtgccttacgggcgattggtgccagtgcccccgttttgccgaagctgtttatcctgatcttcttaaccaccctgctggtgcagatggggattatgctggtcgtggtgccgggcgtgttgctggctatcgtgctctcttttgccccgatcatgatcgtgcaggacaaaatgggtatttttaccgcaatgcgcagcagtatcaggctcgcatgggcgaatatgcgtctggtagcccctgccgtgatcggctggctgctggcgaaaacgcttctgctcctgtttgcgccgaattttgcggttttaacgcctaa

SEQ ID NO: 50363 - DNA, 552 bp, Glycine max
  Peptide Sequence Number=SeqID_142048
cttttaccagaaagttatgtggtagtctattacacagagtttgataagttcaaggaggaactcgagagacgccattgggatgagaagctgactaatttttctaacagcagtatagacatcgccattgtgaaggagttttatgccaacctttatgaacccgatgataaatcacctaagcaggtgagggtgagaggtcatttagtgaagtttgatgaggatactttgaacacatttttaaagacccctgtagtgctggaagagggggagaacttgtgtacatattccagatttgcactcgtgaggcccgatcctcaggagttggctgctaagctttgtatcccagggaggggattcgggcttaatgctaatgggaagcctttgaagattttgaggaagaacatgactactctagctcagacatggagcattctttccttttctaacctcattcccacctcccacacatctgatgtgaccctggacagagccaaattgatcagtgtgctaagcacagcagttgtccaacaagagggatctaaggatgaagcttag

SEQ ID NO: 50364 - DNA, 561 bp, Glycine max
  Peptide Sequence Number=SeqID_142049
atgcactacattattgttagaattttgcttccccggtattcaaatttggctcaagcctctgaggaggatttgattttgatgtgggctttccttaccggtcatcagatcgactgggctcacttggttcggtaccgaatgcataaggcattacgagccaatgcacctctcccttaccctcaattagtcactctatttctccgtcattttcaaattccgcttgatgatgaaccatttgttcaagtcaagcgtgcctttgctattggtgttggtgcagtgacttcttttggataccataaggatcggaatggtcaatggctgaagaaagatgcacttcctcctcaagatgagcgttctctttctcctcctcctcagcgagatgattcagccctcatgactgaagttctttccgaattatggggtcttcgtacttatgttggcgaatgttttgattctctggatactcgctttgccggcatggatatctgtctcacacagcttgaagaagatgtgggttatattcgtcagtgcttcgaccttccaccaccacctccacctttttag

SEQ ID NO: 50365 - DNA, 658 bp, Glycine max
  Peptide Sequence Number=SeqID_142050
gaattctcatgctcaaatcaacactggcggctgtcgcagctgtgtttgctctttctgccgtttcccctgctgcgctggcagcaaaaggggaccctcacgttctgctgaccacctccgccgggaatattgagctggaactgaatagccagaaagctccggtttctgtgaaaaacttcctcgactatgtgaacagtggtttctacaacaacaccaccttccaccgcgtgatccctgggtttatggtgcagggcggtggttttaatgagcagatgcagcagaaacagccgaacccgccgattaaaaacgaagcagataacggcctgctgaacacccgcggcaccatttccatggcgcgtaccgcggataaagacagcgcgaccagccagttctttatcaacgtggcggataacgccttcctcgaccacggccagcgcgacttcggttatgcggtgttcggtaaagtggtgaaagggatggacgtggcggacaagatttctcaggttcctacccatgacgttggcccgtaccagaatgtgccgtcaaaacctgtcgtgatcctctccgcgaaagttctgccgccagttgtctccttgaaaaaggtcatggtcctttccgaaccccacattgaacgctggagcttgggcctttccgctcccgg

SEQ ID NO: 50366 - DNA, 645 bp, Glycine max
  Peptide Sequence Number=SeqID_142051
atggagacacttcagaaggcccgcaaggcaagggagatggtgcaaaagaaggacaaagaactcaggggtagtaacaatgggcctatcggtggctaccataagtggttgagagcccacgtgcaaggtttggattgggttccgagtttgagaaccgctaaaagggaggaagttgaggcaccggaggaagacgaagaggtgcaggcctttagggctgaactcaagcaagcccaaacagtcaaagaaaggttcaaatcagcagctcttaaaatccgaaaggagaataccgaactgagagatataaatatagctaccaccaaagccttggaacaagaaaccaagagggctcgtagggaagagcacggtcggaacaagttccgaggggctctgtggggcagcaacaacgagcttaagctccggagagaggaaagggaccaatcacgagtagacagtttgatcttgaaagatgagttgaaggtttgctcaaggtccaaaagaaacttgtctcaacggttatgcaaaacagaaaccaacatactagccatcgtcagccggtaccaagaagaactaaatctagccacggcccacgagcacagagtggcggacgagtatgcccaagtgtatgcggaaaaggaggctagaggaagg

SEQ ID NO: 50367 - DNA, 594 bp, Glycine max
  Peptide Sequence Number=SeqID_142052
atgaagcacttcactgacaccctcatcagtgccaacataggaacaaaagctggtaccgggccccccctcgaggtcgacggtatcgataagcttgatattgcaccaagagtcctacgacccgaaacaacttatccactggctaaaagatggagtggtggtagattagaatatagggccacaccgcatggtgacttagtcggatataggtctcgtatagatcaagttactatgagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 50368 - DNA, 654 bp, Glycine max
  Peptide Sequence Number=SeqID_142053
tgggacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50369 - DNA, 219 bp, Glycine max
  Peptide Sequence Number=SeqID_142054
atgaacttaaaaagaaaaggacacgctttacggtgcccttaccgaactcgtgctagagctagagtaatgggtgaagcagaggaggtgcaagagaagatgaaggccgaaatggaggccatgaaagagcaaatggccacaatgatggaggccataataagcatgaaaaagataagggaagtcgatatggttgcagtttccgctaccaacgctgttgctaag

SEQ ID NO: 50370 - DNA, 696 bp, Glycine max
  Peptide Sequence Number=SeqID_142055
atggagcttacatcaccaatgtggagacacttcagaaggtccgcaaggcatgggaggtggtgcaaaagaaggacaaagaactcaagggtagtaacaatgggcttattggtggctcccgagtttgagaacagcaaaaagggaggagttgaggcaccagaggatgacgaagaggtgcaggcccttagggcagaactcgagcaagcccaaacagtcaaagaaaggttcaaatcagcagctctgaagatccgaaaggagaatgccgaactaagagatataaatatagctaccaccaaggccttggaacaagagaccaagagggctcgtagggaagagcacggccggaacaagttccgagtggctctgtggggcagcaatagcgagcttaagctccggagagaggaaagggaccaatcccaagtagaaagtttgatcttaaaagatgagttgaaggtttgctcgaggtccaaaagaaacatgtctcagcggttatgcgagacagagaccaacatgttagccatcatcagcaagtaccaagaagaacaaaatcttgccacggcccacgagcatagagtggcggacgagtatgcccaagtgtacacggaaaaggaggctagaggaagggtgatcgactcgttgcagacacctactctgcccttgaggagatccacggacttctcggctattgtcagcatatga

SEQ ID NO: 50371 - DNA, 654 bp, Glycine max
  Peptide Sequence Number=SeqID_142056
atggtagatattgatgtttctgagcatcaaattgccaaggaaatcactgccaatcgagtccagcattggccaaagaaagggaagctttcagcagggaagctaagtgtgaagtatgcgattctacacaggattggtgctgcaaactgggtacccaccaatcatacttccactgttgccacagaatcttttgctgtcaaattacccattgccttccctactgtattatgtggcattatgttgagtcaacatcccaatatgttaaactacactgactctgtgataaagagagaatctcctctatccctgcactacaaactgtttgaggggacacatgtcccagacattgtctcgacatcagggaaagctgctgcttcaggtgctgtgtccaagaatgctctgattgctgaactcaaggacacatgcaaggtgctggaagcaaccatcaaagccaccacagagaagaagatggagctagaacggctgatcacaaggctctcagaaagtggcattgatgatgaagaagcagctgaagaagaggaagaggcagctgaggaagacaaagaagcagctgaagaagaagaagaagctgctgaggaagaggaagaagcagcagaagagacagaatcagatgatgattctgaagccaccccatga

SEQ ID NO: 50372 - DNA, 69 bp, Glycine max
  Peptide Sequence Number=SeqID_142057
atggaagagaagcttgcttgtgtggattctatggaggctggatcttggagcctcaatgaggtcctttaa

SEQ ID NO: 50373 - DNA, 3615 bp, Glycine max
  Peptide Sequence Number=SeqID_142058
atgttaccggtggttgaaaacaccgcgagtccacccgaaaataaattcaaatctaggactcttgataagcccatagcttatcacagaccacataagcataagagctctaacacaagaaaagctagagagagagagagaaagtggagcgagaaaaatactgaaaccctccttcgccattctcgttctgctccgtccctctcgatcttcgccagggattctctggcaggtattgttgatctgttcggttctagatcttttcgggcgggttttgttgacggctccgtcatgtcttccctcagcagagagcttgtttttctcatacttcagtttctcgatgaagagaaatttaaggagactgttcacaagttggagcaagaatcgggatttttctttaacatgaggtattttgaggatatggtgacgaatggggagtgggatgaggtggagaagtacttgtctggttttacgaaggtggatgacaatagatactccatgaagatcttctttgagatacggaagcagaaatacttagaagcattggacaaacacaatgaacagctatccaagtatggagatacaaaatctgcacgaggcataatgctggctgaactgaagaaattgatagaagctaaccctctgtttcgtgacaagcttcaatttcctactttaaagaactccagattgcggactctaattaatcagagtttaaattggcaacatcaactttgtaagaacccaaggcccaaccctgacataaagaccctttttgtggaccatagttgtgggcaaccaaatggtgcgcgagccccatctcccgttaccaatcccttaatgggtgctgtcccaaaggctggaggattcccaccccttggtgctcatggtccatttcagcccacaccagctgctcttccgacatcccttgctggatggatggctaacccatctcctgttccacacccttcggcttctgctggacccataggtttggcagcagctaataatgcagctattttaaagcggccgagaacccctcctaccaataacccagctatggactatcaaactgctgattcagatcatgtattgaagagaacaagaccttttggattatcagatgaagtcagtaatctaccagtaaatttgcttcccgttgcttactctggccagagccatggtcagagctcctattcctctgatgacttgcccaagactattgtgatgactctcaaccaaggttcaattgtcaaaagcatggatttccatccacttcagcaaattctacttcttgttggaacaaacatgggtgatgtcatggtgtgggatataggcagccgtgaaaggatcgcacagagaaattttaaagtatgggaacttggatcatgctctgtggctttacaagcatctctttccaatgattactcagcatcagtcaatcgggtggtgtggagtcctgatggaacactttgcagtgttgcttattctaaacatattgttcacatatattcctatcaaggtggggatgatcttagaaaccacctagagattgaagctcatgctgggagtgtcaacgatctcgctttttcttatccaaacaaacagctttgtgttgtgacctgtggagaggatagggtcatcaaggtatgggatgccgttactggtgcaaagcagtatacttttgagggtcatgaagcacctgtatattctgtatgccctcatcacaaagaaagtattcagttcatcttctcaactgcaactgatggaaaaataaaagcatggttgtatgataacatgggttctagggttgactatgatgcacctggtcattcttctactacaatggcatatagtgctgatggaacaagattgttctcgtgtggcacaaataaagaaggggaatcatttctagtggaatggaatgaaagtgaaggagcagtaaagcgtacttatcatggtcttgggaagagatctgtgggtgtggttcaatttgataccaccaagaataggttcttagctgctggtgatgagtttatgatcaaattctgggacatggataatacaaacatgttgacaagtgttgaggcagatggtggattactggcttctccctgtattagatttaacaaggatggaatactgttggctgtctccacaaatgacagtggagttaaaattctagctaatgcagaaggaattaggctgcttcgaacagtggagaatcgtacatttgatgcttctagagttgcttctgcagctgttgtgaaggcacctaccattggagcttttccttctaccaatgtaactgttggaacaagccttgctgatagagctcctccagtagcagccatggttgggattaataatgatactcgaaatttagctgatgtgaaacccagaattgttgatgaagctgtggaaaaatctaggatatggaagctgacagaaattaatgaaccatcacaatgccgctccctgaaacttcctgatagtttatcatctatgagggtactgtcagatattaaaatcgtatatattcataatatttttttggtttctaggttaatttatacaaatcagggggttgcaattttggctttggcagcaaatgctgttcacaagctttggaaatggcagagaaatgagcggaacactactgggaaggcaactgcaagtattcaaccacaactatggcaaccttctagtggaatactgatgactaatgatataagtgatactaacccagaggatgctgtgtcatgttttgcactgtcaaagaatgattcatatgttatgtctgcttcagggggaaaaatttctctattcaatatgatgacatttaagacaatgacaactttcatgccacctccaccagctgctacatttcttgcatttcatcctcaagacaacaatattattgctattggcatggaggactcttccatacaaatctataatgttagagtggacgaggtcaaaactaagctaaagggtcatcagaagagaattactggtcttgccttttctcatgttctaaatgtgcttgtatcatctggagctgactctcagttgtgtgtttggagcacagatggatgggaaaagcaagcaagtaaattcctacaaatgcccagtggacgaccacctgcgcctcttgcagatactcgggtccaatttcatctagaccagacacatttactggctgttcatgaaacccaaatagccttgtacgaggcaccaaagttggaatgtataaagcagttttcacctcgggaagccaatccaatcacacatgctacatattcatgtgatagtcagtcaatatatgtaagctttgaagatggaagtattggcattcttaccgtcccagcgctcagattaagatgtagaataaatcaatctgcttatctccatccaaatccaagcttgagagtgcatcctcttgtgattgctgcacatccctccgaacccaatcaatttgcattaggacttacagatggtggagtacatgtacttgaaccactagaggcagaaggaaaatggggtactccacctccaaacgagaacggtgctgggcctagcactacttcaggtgctgctgtttcagagcaaacccaaagatga

SEQ ID NO: 50374 - DNA, 2811 bp, Glycine max
  Peptide Sequence Number=SeqID_142059
atgccatcagttggtacctctgtcccttctccttcaatactctcggtccttttatgccaatcagattccatacttcagaacattggcaagaattattctgatgtaccaagttctccttaccttcgtgaggattttgagaatccttttgatttttgttatgagtctaatattgtttccaagatacatttgatctccatttctgatgatggaaaaatgtggaactggctcttgactgctgaagggcaagcaaacacccaaaaaaatgataagaagttagatttggtcaacaatgaccatacggtatcacatcctggggccaactctaacaccttagtatcttctgctggtggacgtgacctaaatgcaggcaggcaacgagagcgtttcaatgataatagaagccgcctgcagacctcagtctttggccaggaagaaatttcaatgaagattagcttagttggacagcttcagcttctttcttcaacagtgactatgctggcagtaccaaccccttctctaacagccaccctggcccgtggaggaaattatccagcagcagctgttcccctggttgctttgggaacacagagtgggacaatagatgttgttgatgtttcagccaatgccgttgcttcaagtttatcagtacataatggtattgttaggggactacgatggctaggaaattccagactggtttcattttcttatactcaggctaatgaaaaatccggaggatatattaacaagctagttgttacctgccttcgaagtggccttaacaagatgttccgagttatgcaaaagccagaacgtgcaccaataagagctctgagaacatcttcatctggaaggtatcttctaattttgtttcgtgatgcacctgtcgaggtttgggcaatgactaaaaatcccatcatgcttagatcattagctcttccatttacggtattagaatggactcttccaactgttccgcgtccttctaaagatcaaacatctggggcatcagatgaagcatccaaactatcaaaaacttcctcttcagattcaaaagagggttctagcacagagggatctcaggatgacacgtctgaaagttttgcatttgctctggtgaatggggcacttggagtttttgaagtgcatgttagcattgtccacagaccgaaatggccttcttcttcatttgtatcatcggatggattaatcactgcaatggcctaccgtttgcctcatgtggtcatgggagacagaatagggaacataagatggtgggatgtgacaacaggacattcttcctcattcaacactcacagagaaggaatccggcgaatcaaattctcaccttttgtaccaggggaccagagccgggggcgtatagctgttctgttttatgataatactttttctgtatttgatttggattcaccagaccccttagctaattcacttttgcaacctcaatttcctggaacccttgtattggaacttgattggttgcccttgcgaactgttaagaatgatccactggtactgtgcattgctggagcagatagtagttttcgtcttgttgaagttaatgctacaaccatagaaaagagacctcacttaattccaggaactccttcatctaaaggggatcttcgcacctacatgatcgacataccacctcttggcgactcagtggtgcctgagatgctcttaaaagtattggaaccatatagaaaagaaggttgcatgcttgatgatgagagagcaaagttgtatgctagtattgtggataaaggttgtgccgcaaggtttgcatttgcagctataatatttggtgaatcctcagaagctctgttttggctacagctgcctcaggcacttaaacatttgttgaacaaggtattgagaaagcctccaccaaaagaatccacagcagcacctatctctgatgttgatgatgagacatctctactatctcggatatcatcaaagggaaaaccgacggaagaaacaggaagagatgtattgagtcaaggtcaactaaggttaatggcttttgaccgagaagagttgtggaaaagtgctagtgaacgcatttcttggcatgaaaaattagaaggtgaagaggctatacagaaacgtattcatgagctggtgtcagttggaaacctagaagctgcagttagtttattgctttctacacctccagagagctcttatttctacgtcaatgcacttcgtgcagttgctctctcttctgctgtttcaaggtctcttcatgaacttgcagtgaaggttgttgcagccaacatggtgagggctgacaggtcactctctggcatgcatcttctatgtgcagttggaagatatcaagaagcatgttctcagctacaagatgctgggtgctggacggatgctgcaaccttagctgctagccacttaaagggatcagactatgcaagagtgttgcaaagatgggcgagccatgtcctgcacactgaacataacatctggagggccctgattttgtatgttgccgctggtgcactgcaagaggctttggctgctcttcgtgaggctcagttacctgacacagctgcaatgtttatccttgcatgccgtgaaacccatgcagaagtagtttctaacctaggtattcttgacgaagaatcaagttcatcagttaaggatgagctactaaacttgcgagctttagatccaaataatgaagatgtcattgcagttaatgaatatttagggcaatatcaaagaaagttggtgcatctatgcatggattcacagcctttctctgaataa

SEQ ID NO: 50375 - DNA, 384 bp, Glycine max
  Peptide Sequence Number=SeqID_142060
atggcactatcgacttatcccccttttccctataaatgcaaacaaaaggcattggccttcaacgtcacaagttctttcactggaaggagaacaagaagaaaaaaccgacacaaagatctagtcctagctagaatcaaacaggggcgatctcaccttcaagaacacatcgccatggcaaggaacttgcttcttgtgctttttgcagtagccaccctcctccatggctcagcagcccaaaccagacacatggtcggtgatgccacgggctggatcatccctgctggcggcgctgccacctacaccgcctgggcttccaacaaaaccttcaccgtaaacgacactctcgtgttcaacttcgccaccggccaacacaacgtggccaag

SEQ ID NO: 50376 - DNA, 594 bp, Glycine max
  Peptide Sequence Number=SeqID_142061
atgatgaagcgtcagattatcgagatcattggttacgtgatgtgtcgctccactgtcaaacagaaaatcatgttgcgatgggccggcagttgcagtattgacctgaacctgtccagtgtgagccggagagttatgaggtggcggtgggacactaggatgctgctactggaaggttttgcactgagagagaacatgacctttgatgttgcaccactgacagcggccgagaaaaggtttgcgagatgctttggcataggtgtttttgagaaggatccagagatcatgcgaggtcttggtttgagacaccagggaggccacttcattagagagagtgtggtgggggtcgtttccgacggagtcggcgtcgaagatgttggagcggagatgatagccatcaaggagagcttcaacttgttgtttccaattaggataattgttgggaagaagtttggtgacattggtgaaagtgatgcaagcaaggggtttggatggctcatgggggttgagaatgaaggagttgttgtcggccatgggaggcaagggtggggaacgacgtccttaattgaagaaatagggaatggatggatcgtttag

SEQ ID NO: 50377 - DNA, 162 bp, Glycine max
  Peptide Sequence Number=SeqID_142062
atggcacagaggcacagggttgttccaggagatttgtggtcaaaggaatttggtgaaaaaaggaatcaatacagaccctatgtgccccttctgtgtgaaggtatgaagagactgtggatggcatcaaatgtgtggggtcagaatggatcagcagggtgttag

SEQ ID NO: 50378 - DNA, 2427 bp, Glycine max
  Peptide Sequence Number=SeqID_142063
atgggaggtgggaacagaagatcaaaaggtggaaacagaaaatccaacaacagcagtggcagcggcattcctaaatctcgaaaaagaggttcggatgttaaaactgcattgttcgtcgaaggcggtttcttgtctgattggcatctcccttcccctacccaaattccagggagaagttctggatccaataacaaatctgggagccatcgtagaggtgaaggctctgtatctaaaagtgggtttgcgaaatctttgggagctactattcgatacaattatccttcatttgatgttcagttgcttcagagtaacttatgtttaatgacatattaccaggaggttgcatgtgctgggattgggaacaatggtgaagatagtaatttaaatcagctgcaaccttttgttttcgcagactccaagaagggtcaaattattgctcatatagaccaaacacctccttcaaaacccaacaatgtgaaatataggtacacttatgatgcagattttattttgggtgacagttctcatagaggattgggtttccctgctgaacaagacaaaaccccaagtggcattggcacttctgaacagatgccccagtcaactccagttttagattcatcaccatttgagaaggatgctgattctggtgagggtatggattgtgagttaaccaatcagatggcagaagacttgccatcaaatgtgtctgctgagagaaattcagggtttctgacaattggaggtcttaaattatacactcaggacatctcggataatgaaagtgatgaatataatgacggagactcaccagatgaggacagctctgcgtcttctgagccagaagagttacttggatcatctgaaaccaatgactctgaatactcatctgatagtgattcagacattaatgaagaggttgtggaagattatttggaaggagttggtggtagtgacaacatcatggaagcaaaatggttgctaaaacctgttttggatgagtcaaatgatgatagttcttccagcagttgctatgacgaggcattggagaagttgagtggctttgtccttcaagaagcctccagggaatatggcatgaagaaagctcaaccatggaagaaacgctctgtaggttctggacctttagctttggaagacctaatgttggaaaaggatccaagatccatctctgctagaaagaagcatgttcctcgattccctcaatcttggccttcacatgctcagaagagtaaagcttccaaaagaattcatggtcccattctctatttggttgatggaatcggggtacagtcttatggggatttcacatccatggagtttgaaactggaaatggttgtgtattctatacaggtgaaaaaaagaaacttcgtaaagaaaggattgctgtaaagcgcagggaaagaatgctgcatcgtggggttgatcttgagaaaattaattcgaaattagaaaaaattgttttggagcaagtggatatgttctcttttcagcctatgcattctcgggattgttcacagatacaacaattagcagcaatttatcaattgcagagtagcagccaaggatctggcaaaaaaagatttgtgacagtgatgcgaacgcagtctacatccatgccatcttcaagtggtagacagcgcctggaaaagttgttgggagttgatgatgaggatgccgatttttccgtggctgactatgtgaataagaaatctgtgagtggagacagaagactgggaaagaaaaatgctaaaaggaatgattttagattccaagaacctcaatctgcccagaacaagtactcaggaagccataaagtgaaggacaagaaagggagtggacaaaagggttcatatgctaatcagcctgtgtcatttgtatcaagtggcttaatccattcagaaactgtacaggttacagttgatgctgaagagactaataggaatggtgtcaccagctctgctaatataggttcatttgaagaacacactactggttttggttcaaaaatgatggctaaaatgggatacacggagggagcaggattggggaaaaatggtcaaggtatggcacaacctattgaggttattcaaaggcccaaatcacttggtttaggtgtagaattttccaacaattcagctgagccagctaggaacaaatcttcaagagttggtgctaaatcacttggtgtgggtgtagaattctccaacagcccggctaagccagctccaaacaaatcttctaatgttggtgcttttgaaaaacacactaaaggctttggatcaaagatgatggcaaagatgggctttgtggaaggcacgggattaggtagagaatcacaaggcattaccactccgttgagtgctgttaggcttccaaagtcgcgaggactaggtgccaaaagttaa

SEQ ID NO: 50379 - DNA, 1449 bp, Glycine max
  Peptide Sequence Number=SeqID_142064
atgggtgtggatgtgcaggctcaaggttggaaagctaagtcaaaaaccctggaagaagttctggaatcaacttctaaaatggaaccaaaacttattggctatgatgaaactcccattgatgtaacagataccaatactgccaagcacatagtggttaatgctgacccgtacaacaactctaacccagaaatttgccctatgcaactgacagatgaaatatgctctccatgtgtgaaacctttcggccaacggcttcaatcttctgctaagggaaagcttagtcaaatatttgaaaatcgtgattgtggcagtgactcgtctgggacaggaacagcaagatcacgattgtatgaattatgtgctgcgtattgctggaaacctccttcatttgaatgctgcaagaaagagggaccagaccacctgaaacaatttacttgcaaggtgaccttagagatagaagaggcccagaatttgattttagagtttgttggggaacctctgtcaaagaagaaagatgcagcagagagtgcggcagagggtgcattatggaccaagtgcctcccagaaattgcagagaagaagaagatgaaagtagcgtatattctcattcctttgaacaccttattacaagctatttataaggcaaggttgcatgctttccttatgggctgcgcacgtagcttcccattcataacattccctggcccatcaaaaacaccttgtcctcaaggtgttggggctaccaccatggcttcaacattcgaaccaggatcccaaattaaaatgggtgaagaaatgagcagatggagtgtaaaaggtgagggggaaggagtggtcgagctcctttccacggctgaagtgctccttgcggactccgagaatggtgatcccgcgggggtcagaggacatgtgagggttgctgttggtgatgagggaaacaatcacaatgggaagcggaccgggcaagtgcgaccagtggaggtgacggcggaggtggtgacggagccgacggtggaggtggtggcggagacggagtccgcggacagcattccgaaagcttctcttcttgaaggtgtggagcagcgtggtaggggtgcggaactggtattgggtttgcatttgagatcggagtggcagggggaaaacggttcaggagttcatctatctttagattcatggagtgcatgctctcgtcaagacgagggtggtggtagtggaaggtggaagctccgtacggcgagtggcagtcatggacggcagccatggaagcttcgtatggtggttgctgaaatgaaggaaggggatgaagggtgtgcggcaacgaaggtgtgtggagatgggtatgacagccatggaaggcggccatggactctcaacgaaagcaccaatgttatacttggatttcgaggaccaagtgcctcccagaaattgcagagaagaagaagatga

SEQ ID NO: 50380 - DNA, 1383 bp, Glycine max
  Peptide Sequence Number=SeqID_142065
atggcgcctcagaaactgaccgattacgagcgcaaacggctcgagaacattcgccgcaacgatgaaatgatggctgcactcaaactccattccaaagctactcaactctccaacttcaagcgtccaagggtgggaaccaaatcctacaacatgaaatcggaaaagaaacccaaaaccgaaaccccaattgtgattaggcgctccctgcgaaccaggggaattccgccagattccaaaggtcttgacggagattccgtgggtcccaccactcccagaaaaaccgaaccttccgttgtaagtctgggtcctatttccatggctgatgctcgagaaagcgatcactcagatagcttcttcgttgaatcactcatgggtatggcccaattgaaagcccaatatgctagtgttgaaaaggggaaagtggaggcttcccttgggttggaagctctgtatttggatcccgagaatattgcgcgggttgttcctggaaggataaccagtgcacggtttttcccttccagtagtgtcaaaatgatcgcggtgggtaacacgtttgggaatgttgggttttggaatgtgggacaaagtgaggttcatttataccgtccccatcgagctcccatttccgggatcttgattcaaccacattgcttgtccaagatatacacaagttgttatgatggaattcttaggctaatggatgccgagaaggaaatctttgatctggtatttgagagtgatgaaagtatatttgctctctctcaaccaacaaatgagacaaactgcctatatcttgctgagggttctggaggtttgactatttgggataacaggattggaaaacgtttgtcgcactgggttttgcatgaaagtagaattaacacaatagatttcaactgtaaaaaccctcatattgcagctactagttccactgatggaactgcctgcacctgggatttgagatataccgatggagataagctcacagccttgaggacatttacccataaaagatctgtacaatctgcttacttctctccttctggatgtagcctggcaactacaagcttggacaacacaattgctatttacagtggagttaacatggaggatgcagctgttattaatcataacaatcagactggcagatggctttctactttcagcagagcaaaatggggttgggatgactcatatctctttgttggaaatttgaaaagaggagttgatgttgtctcagcagttcaaaggaagatggttatgactctagagagccagcacatgtctgccattccttgcagatttgatacacactcttacgaggttgggatgctagcaggagctacaagtggaggccaggtttatatttggacgtcgcgctag

SEQ ID NO: 50381 - DNA, 141 bp, Glycine max
  Peptide Sequence Number=SeqID_142066
atgcatcaacaaggctataaattcatcagctttcttgagcttctagggcttaaaatcctggaggtggagagatataagatgcataagaagttcaagaaagctgtggaaaagcatgaccaggacttgagagaggaaaattga

SEQ ID NO: 50382 - DNA, 291 bp, Glycine max
  Peptide Sequence Number=SeqID_142067
atgaggggaagaaggaaacagaagaaccaaccaagaacaacaacagggaggcatggcggaggagggtttgcgtggcgatgccaagggaagagtaggagaggagagcttgcggaggagcgtggcggcaacaacacagaaagaagaagtagagcaagttgcgaaaagaagcacagagaaagacagtgtgatttggggaaaaaaatgaaagaaagtgaaagcaaggtgtggtgccgagaagagaaggagaaaagtggaaaaaatgaggagatgggcgggagagatgggaggtga

SEQ ID NO: 50383 - DNA, 3231 bp, Glycine max
  Peptide Sequence Number=SeqID_142068
atggtggtgggtgaccgttttccggtgggtatgcgtgtacttgccgttgatgacgacaaaacgtgtctcacagttttggagaacctgcttcgcaaatgccagtataatgtcactacaactaatcaggcaattaaggcgctagaaatgttgaggaaaaacagaaacaagtttgaccttgttattagcgatgtaaatatgcctgacatggatgggtttaaacttcttgagctagtgggacttgaaatggacctacctgttattagtaagctcaaacacttctgttctgtcttgacattcattcaacttgagtttaagcaaagaaatatttccaaattcgatttgttatctcacaatgatggatacggtgataaagagcgggtgatgagaggtgttatacagggtgcttgtgactacttaaccaaaccagttcgaattgaagagttacagaacatatggcaacatgtactgcgaaggaggattgatagcaaggataagaataagactgcaagtgagggaaaaggctgcagtatggctggtaagtttgcaaatgaggagaaagccagatatatggctggggaatgtagtcaagccatggcaccaaaaaataataccgaccagaatataaaactgggtcaaaaaaggaaggaactaagtgaggatgaggaagaggaagaatatgataaagagaatgaggaacactcaaatcagaagaagcctcgtttagtttgggatgccgagttgcataggaaatttcttgctgctgttaatcatctgggaattgacaaggctttccccaagagaatactcgacttgatgaatgtcgaaggacttacaagagaaaacgtagcaagccatctgcagaaatacagactcggtctcagaaaacctactcagcagcctagcatggttgctgcgttgggtagtagtgatccttacctgcagatggattcagtagaaggctttcgcactttgtcgggatcagtaggaatgttaagcaccacactaccatcatatgcatctggtggagtgttttgtaggctgaacccaccatctggcttgagaggagttaactctgcactttttcagcctgttctgtctcaaaacaatagcatgtctgcaaaagcatttggaaacatgcaactgtccatgttttctgcaaatcaaacctcaagtttattacagggcattccaacatcaatagatgctaataaatttcagcagaaccgttcacctggtattaggaagttgagtccacttgatgattcaagtggatttaaagtttcctctggtttctcagacactagagctaccgttataaatccaaataattttgtgcatgatctctcaaataatcatttacttttacaaagaaattcaccaccagcacagaattcgggagcattcagaaatcactcttctcttggagctgcgtcggtgaacacacaatcatttgaccctggtatctgtgaattggatcataatcggcataataaaagctggcagggaacaactcagatatctaagtttcctaccaatacttctgctgtcagtaaggttttcactcatgatcagctggctcaaaataacttaaaattttcctcatccactttttgcagtgggaacagtccagttgatttttcttccactagggctattgctcctcccttggaggatgctagaggtaagctgcaaagtcaagaaggcttacttgagaatatcttactagcttcatgttacacccaacatcaaagctgggaatcagataagcggggttgcaacaaagacatgagccaaaccttcaactccacaaagtctgtctctcctaatggagacactagttccttaggacatagtttagaccaaaataattcagttagcagcgagggaattggtgcatctttggttaatccatcaatcacacaatcaaatgaaggtgagaaattctattcgatgaagtcaaatgatgcctgcattttgcggagcatggagtcccaagaaggactcatgcagaatacttttgggtccttaaatgacataatgagtgaaataaccgaacaggttcttaatatgcgccttgagaacggtaacaagttctctagcaggggcctgaagagtggcgacgagggcggaagcagggctcttcaaagcccccaagagagtggcgtaaatctcggcgcgggtggggagggattcgaggttcttaacctcatcggggccgtaaaacttgccctcaaaaacggcgccggtgaagtcgttgtcctcgagcttcttctccttctggaagttccagtagggcttgatggcggaagggatctcctcggtgtggacgaagagccatacgttcatgcccttcatgcagggcttcagggtctcccagggcgtgccctccaccgccttgtagacgagtcaggaggtagcagttctccagctgctaccgcactgtctccaccgttgcctctttcttgctgcggggaatggcggcacggatggagttgggcttgggcttgggcttgggcttttgaggaggtcattgcggaggccgtggcttccatggtcggaattgaaaaaaaagagagagcaagatgggaagggactgaggattgtagcaaaacactgcaaaccccttcggcgttttgtccttacgttgttattaagaagcgtaacgcattcaccacgatggtgaccaaagcgatggaggtggtgaaggatctggacgtgaagcggtacatgggtcggtggtacgagattgcgtgcttcccgtcgaggtttcaacccagtgacggcaccaacaccagagccacctacactctccgagatgacggcaccatcaacgttcttaacgagacttggagtggcggcaaaagaggtttcattgagggcactgcttataaggctgatcccaacagcgacgaggccaagttgaaggtcaagttctgggtgcctccctttttacccatcattcccgttactggggattactggcttttgtacattgaccaggattatcactatgctgtcattggccaaccttccaggaattatctttggatattgtccaggaagaaccatatggatgaggaaacctacaaccagcttgttgagagagctaaggatgaggggtatgatgtgagcaaactccacaagactccacacagtgattctccaccggaggaagaaggtcctcaggacaccaaaggcgtttggtggatcaagtcccttctggggaaatag

SEQ ID NO: 50384 - DNA, 2265 bp, Glycine max
  Peptide Sequence Number=SeqID_142069
atgttcagaagcttgtttctgatttccttgttgcttcatacaatagtggcccaaaaacctgcacttccaaatcttcctacacctcaagtccctccccagaaatggtcaacattaagtggcaatgagcctcttgtaatagcccgtggtggtttttcgggactcttcccagaaggctctcctgacgcaattgggctatcacaaggcataagcgttttcttgtgcaatcttcaggtggcaaaagatggcggtgccttttgtgtcacggggactacgcttgacaatacaacaactatatcattggtggatcctaaggaaaaaacctacaatgtcgatgggaaggacgtgcgaggacacttttctttggattaccctggtcttctgattgaccagaatgtatcaatgactcaggccatattttctcgacccaatttttacgatggtacttccccagttcttaatcttgatgctctactaagcggaaaatctcccccgaggctttggttgaatgttcagaatgcagcactctacaccgaaaacggagtacaggtggtagatattgttttagaattattgagtttttatcaaatagagtttgtttcatcaacaagtattggtttcttgaagagtatcagtgggaaatcaaacaaggcaactaaggttgtctttaaacttcttaataataataaggttgaaccttcaaccaagaagccatatggaagtattgtgaaggatcttgccacaatcaagtcatttgcatcaggaataatggtcccaaaagaatacatatggccagttaaaccagacaaatatctaggacctcccacaacacttgtggctgatgcccataaatcaggactagaagtttatgcttctggttttgctaatgacttcttttctagttatagttataactacgaccctattgccgagtaccttcaatttttagacagaggtgattctgttgatggtgttgtcactgatttcccagcaacagcatcaaatgccatcgcttgctttgcacacaacaataccttgcccaaaaaaggaccaactttgatcataagcaacaatggagcaagtggagtttatccaggcagcactgaccttgcatatcagcaagcaatagatgatggcgctgacattatagattgctcagttcaaatgacaaaagatggaattgccttctgctcaaactccacagacctaacatcagataccaccgcaatgcctaaattcatgtctcgatcttccaatgtcccagaacttcaaccaaaaagtggaattttctcctttgaccttacatggagtgagattcagacattaaaacctcaaatggttagtaaaggcagtgatttcctaagaaaccccgcaaacaagaccagtggtaaatttgtcaccctctcagcatttttggagttagccaaggctaaggcagttcctggcattttggtcaacatacaaaatgccccctaccttgcatcccaaaagggtcttgacattgtagatgctgtcagcactgctttgagcaatgccacctttgacaagcaagccaaacaacaagttctgattcaatcagatgacagctcggtcctatccaggtttaaagacatcccatcttataaaagggttatgttattgaaggataaaatgggcgacgtaccaagacaaacagtggaagaaataaagaagcatgcggatgcagtgaatcttccaaaaacctcaattatcaaagtatctaattccatcttagtaggaatgacaaatgttgtcaaagagttgaaagatgcaaacctcacagtattcgtccataatctcaaaaacgaatacacaaccctggcattcgactattggtctgatcctaatgtcgagattgcaacttacgtccaaactgccaaggttgatggaatcgtgaccgattttccagccactgcaagtagattcatgaggagtccatgtagcgatccgacccatgatcctactatcttacctgctaagcctggtgatctattgaacactattccaactgaacttctgccaccagcacaggctccacttcctcctcttgaggttgcagacgttgttgacccacctcttcccgccgtgactaaaaattctaattcaactaaagctgagcctgctgctggtcctggggctaaacctgcctccccccctgcttccccttcaggtgccagggtaaatgttgccaacagtggcctttcaatagtagctattttggtgtttgctatgctcttcgctgctcattaa

SEQ ID NO: 50385 - DNA, 993 bp, Glycine max
  Peptide Sequence Number=SeqID_142070
atgatttctttgcgagacaaagcacggctgatgatgaatatatattgctttggaaggaatctagtcactactgctgcatcctatttacctcctgttcaactcccaacacaaagggaagtgcatttttggtatattttacctgatgaggtaaagagcacaaccctattgaaccgatatttagaaattctatcaccttgtgagaaagaaaatatatttcgcatgcgtggggaacaactgagaaaaggagcactcctggcccgtgcattggttcgcactacattggcaagatatcagacgaattttcaaattgatccaaaatccttaaagtttatgaagaacaattatggcaagcctgagttggactggcaatatgctgatgattggagcctaccgcatctgcattttaatatctcacacacttcttctttgatagcttgtggagtgactgtgggttcacctattggtattgatgtggaagagaaacaaaggaggttaaagaatgatattttagcctttgcacaacgattcttttctccccatgaaatagaaatgctgactcacattgcagaccctgaacttcggcttcaggagtttattaaattatggactctgaaggagtcttatgtgaaagcaatagggaggggcttctcagcctcaccttttaagactttcactattcgattaagagaccaccatgtgaaaggagacatccatgctccacctcttataacttctaaggcacctgatattactgttgttgaggcttctgatgacgtgaagaatccgtcgaacaattggcagtttgtgcttcttgagttagctggttctcactacgctgccatttgtatagaacagaacagcgtcaatacaggaaatggacgtattccaataaacctgaccctaaggaaaacaataccatacgtggaggatgaatgtatttctgcaacagacagtgctgtagtgattggtggcttgactagactgtcagattag

SEQ ID NO: 50386 - DNA, 435 bp, Glycine max
  Peptide Sequence Number=SeqID_142071
atggctggagctttgagtctctcccaattcccagttcgtgggtctgtttctttgcccaaaagaagaatacccagaagaagcttttgcattaggggcatgtcagaaatctcttccactttttctgtgagcacccaacaagaagaaccaacttctaatgcttcgtcagtgacaattgcacctccccccaacttcaagccccctgagcctaaacgctttgcaatcagacctgacaagaccagtgaagtatttggagctttgcttcctttgctctttcgctttgctaccggagttttcgtttctggcgtgtttgaaagtgtttgtcccttgagcatgtttcttctttctaaaaatttgtctcaacttgaagaagagaatgagaagacataccctgccgattctgtttttgggtttttaaaacacttgttttggaaataa

SEQ ID NO: 50387 - DNA, 870 bp, Glycine max
  Peptide Sequence Number=SeqID_142072
atggtaattaaaagttatttatgtgattcagatttgaattgtgtagatacaaattcaaacacgctagctaacattctcaacaacatggacgtgatctttgagcttcaaagagggaggtcattctccatggaagtaggttactttgacactgtcttagaaatcaaagagaaagtacaaaagtatcaaaatattccggtctctaagcaaaccctaatcctcaatggccaagttctccatgacaatgacgatccttggaaggtcaaaatccttcataacacatgcattcaactccaagtgacccccgaaaaggaggagaataaggagttaattacttctgcgcacaccaagattcaactcaacgtgaaaatcacgtccaaaacgcacctcatccctcttgaggtggatgtgaacgacaccgttttgaggctgaaggagaagattcacgagatggaaaccctagcagtgccagttaaccggttgctcttgcatgcttcttcaacgggtgcagaattgcatgatcatcaattgctgcgagactgtgatgtttcggaaaacagcgagattgacgttggtttccggccgtcgcccacggtggcgtctccagggttgaagaggctaaagctgatggttttgcctaagagcgggacgaagaaggttccagtggaagtgaatgcatctgataatgtgggggagctgaggaaggagttgcagaagttgcaccagagggttcagtttcatttgccacaagacgggtatttcttcatttacaagcaaaatgttatggatgatgataggtctttccgttggcaccatgttgcacagggtgataccattgaaatattcaatggaagtgttactggtggatcatga

SEQ ID NO: 50388 - DNA, 213 bp, Glycine max
  Peptide Sequence Number=SeqID_142073
atgaccatatcttgtgaactccgtaatccacagcctgaaaccgcaaaaactggaacctcagcttataaacaaatagcaatggggaaagggggaagaccgctctccgaggaaggcgccggcgatgatgaaggtgacgtagacggagttgcggcgcatgaggaccttgtagaggctttcgaaaacgcctcctcctctgcttcttcgaggcactga

SEQ ID NO: 50389 - DNA, 405 bp, Glycine max
  Peptide Sequence Number=SeqID_142074
atgggggaatgcatggaacaaatgggctcattctgggatgattttgattttgaatgtagaagtgtccttcagataatttggcaggggagctcatgtgtgtttggggtaaaaggaatttttaggtatctgacttgttttctagagcaggataccttggcttcagaggaagatggaaagaaaagtgggagtctaggggacttcaatgttgttaggaaaccagttgggagaagatgggaaacaagattgtggacatcaagtaaatcagaaatggagaattcaacacttttattgactccatggaacttctggagattccacttgcaagaagaatatatatgtggttcaaaagtggtggatcaacttgtagcaagcttgacatgtttctactctcacctgaatggctaa

SEQ ID NO: 50390 - DNA, 1470 bp, Glycine max
  Peptide Sequence Number=SeqID_142075
atggccaccggagtgaccagaaaaatttctgctgcatcagctcgggcccacaccagaagggcgaagaaaaccaattctctaccccttccttcaggaattcttggaacagcactagcagtgttgtttattgggtttctagcatgggcttatcaggttattcaacctccccctcccaagatatgcggcactcctgatggaccacctataacagcaccaagaatcaaattaagagacggaaggcatttggcatacaaagagcatggtgttccaaaagatgcagccaagtataaaatcatctctgtacatggttttaatagttgcaggcatgatgctgtgattgccgataccctatcaccggatgttgttgaggagctggggatctacattgtatctttcgacagacctggttatggggaaagtgatcctgatccaaatcgtacactaaaaagcattgctctagatatacaagagcttgcagatcagctgggattgggctccaaattctatgtagttggtgtctccatgggtggacaagttgtttggaactgccttaagtacatacctcacaggctgacaggtgcagtacttgtcgccccagttgtcaactactggtggcctggtctacctgcaaacttaactactgaagcctatgaccaacaaaaattacaagaccaatgggcacttcgtgttgctcactacgtaccatggctaacttactggtggaacactcagcgatggttcccaggatctagtgtaattgctcatagtccacatatcttttctcatcaagacaaagaacttctgcctaagttgttgtccgatagaaagagttatgcggagctttcccgcagaaacctaggcagcatttctcccaacatgccatctgtttgcctaatcggattcgagataacagatggcgatgctggtggttggccctcacatgggcaaggctcttcgctatgcgaaggtatgggggagggatgttgtacgcagccttacccttgcatatgcaaagaggctgtttccggattcgaacccatgaccaacaagtcaccaaggcacaactttaccgctgcaccaggtaattgtacattgccttctccttgtatatgcaaagaagttgtttccagattcgagcccatgaccaaccggtcaccaagacacaacttcactaaggcacaggtaatacagcaaggtgattatgaaaccatccaccgcgacataaatattggatttggtaactgggaatatagtccccttgatcttgaaaacccatttccaaataacgaaggctctgtccatctttggcaaggagatgaggatatgatggttccagttacactgcaacgatacatagcacaaaaccttccatggattaactatcatgaactccaaggttctggtcacatttttgctcatgctgatggtatgagtgatactatcatcaagtcacttttacgtgcgaagtag

SEQ ID NO: 50391 - DNA, 600 bp, Glycine max
  Peptide Sequence Number=SeqID_142076
atggagcttcaactgggtctcgctctctcaacccattctcgtgcctacgaccagcctttcagccacaaaaaacgtaccttctcccaactcatgatgatggaacatgcaccaccaccacaccatgttatgcttcctactctgtctctcctccctttaactccaagccaccatgttgttgatgatcaccatagccaatgctctaacatcaccaaggatgaggaggaggagggtgtagtgggttggccaccagtaaaccattggaggaagaaacttcatgtggaagaggttgtcgggaataataataatattgatcacatggtatgggttgatcatcgtcaaactcatagtctccaaggatattcatcgaatactctgtacgtgaaggtgaagatggagggtgtggggattgcacggaaggttgatctcagtatgcatcaatcatttcacacgctcaaggaaaccttgatggacatgtttggaaaatgtcatcatcaacaatcaaacaactatgaacttgcttatctggacaaagaaggtgactggcttctcgcccaagatgtaccatggaggcaagtgcatcctacctacctatcaccttaa

SEQ ID NO: 50392 - DNA, 336 bp, Glycine max
  Peptide Sequence Number=SeqID_142077
atgcatatccaaggactgacagaggcccgtaatcagagctggaaaccccaggaccctgttggacttctttgggtccactgggtgtcctgtgggcgcgatccctgcaaacaacagatgatgacaaaggtgatgaacaaaaagctcaaaagatcaaagaacaactcaagtgaatcaaagaacatctcaagtaaatcaagaacaagtcaagagttcaagaatcaaggagaattcaagactcaagaagaaagcctagaatcaagaatcaagactcaagatctcaagaatcaagatcaagattcaagaatgacgaaaagactcaatcaagataagtattaa

SEQ ID NO: 50393 - DNA, 477 bp, Glycine max
  Peptide Sequence Number=SeqID_142078
atggttggtttcgcacctttttcgccaagagagaaaggaggggcaaatcgggaccaactcttagcaagcaaagaaggaacatctgtcaactggttccctcgacggaaagaaggaagaaccgaagttcttatttcgtgcggaggatttccaaatgttcccttgatggggacgaggggttgcatcagttacaattccgttcttgctataagacaacttggctaccctatgagaggggcgccactagaggatgagctcgcacctgtcatttcacgaggtttcaataagaccaacatggagacacttcagaaggtccgcaaggcatgggaggtgttgcaaaagaaggacaaggaactcaggggcagtaacaatgggcccatcagtggctaccgtaagtggttaaaagcccacgtgcaaggtttggattggcttccgagtttgagaaacgctaaaagagaggaagttgaggcagaatgctga

SEQ ID NO: 50394 - DNA, 1191 bp, Glycine max
  Peptide Sequence Number=SeqID_142079
atggcgaatcaagaggagtgggtcctgtttgcggatgtattagattttctaatctttggggttgtcctctttccaaatgtggacattttggtggacctagctgcgattgatgctttccttgcatatcaccatagcaaggagtggccggtggtagctatcttggcggatttatttgatacatttgaccgaaggtgcgagaagaacagcgcacggattatctgctgcttacccgctctttgtgtatggttggtttcacacctattccaacaagacataaggcacccatgtccgctccaaagtcattgctcgtgtgtcaaaaagagaagagtagattgggaccaatacttggctgggataggaggcagaacaatcaactggtttcctcgatggaaggaaggaaaggagggagttctcttctcatgtggggactacccaaacattccgttgatagggacgaggggttgtattaactacaatctcacacttgctataagacagttagggtaccccatgaggggagcatcgatggaagagagcctctcgcctttccttgtgagagatttcggtgtgcaaagtttcaagattgtacaaagagtccacaaggcgtgggaaagcccgttaagaaaagataaagaacttaggggcatccgtaatggcatcatcgatggttatcatgaatggctgaaagttcatacacgagggttagattggctctccaagttgaaaattatcaacgaggagaacttcgaagctccggaagaggatgaagaagtccgagctctaaaaacagagctaggaaaggcaagactcgccaaagaaaaattcaagttagtcgctacagacgtccgaaaagagtgtgccgagttacgagaagaaaatgcagctatcgcaagagcccttgaacaagaaaccaagagggctcgcaaggaagagcatggtcgagacaaattccgtggagctttgtggggcagcaacaaggaactcaagcttcaaagggaagagagagaccaatcacgagtacatagcatggtcttaaaggaggagttagctgcctgctcaagatccaagaagagtttggcccaacacttagaagccacggagcaaagcatgctagctataatagggcaatacaaagaggagttaaaccaatctttggctcatgagcaaaagctagtagaagacttcacacaa

SEQ ID NO: 50395 - DNA, 768 bp, Glycine max
  Peptide Sequence Number=SeqID_142080
atggaggaagctgctcaatctggaagcactgacaccgtgattgatcctccatctcccatcagacgtcacgtcaaatggaagattgcccgcacgaagaaagctggccagatgacgtatgaggcagcaaaggaaattgctgacaagattgtgtcacagggttcctttgtcgcccatggatgtcaggatgtactgactgttaccattgggcgacctgaacaccccagtcgtgtacgtgctgctggagctggtgtgacgatcaagcaatcctttggaccggctccaaggacctcctgcatgtcttcctcgatggctcccaaagacctagagcagctgactcaacaaatcagggaccagctggaggagtcgatcacagaaaaagtgactagacagctgatgttatccttcagccatatgcaaatccagtttcaatcacagatgcaatcacagggacttgcactgcctcttgagcctgaggttggtcctttagctgctcgtgtcagcacaaaggagtgttgtcttgatccctcagggaacgatccagacacaggtgactcaaacaaatacggattgtacatcgaagaaaatcctccccgcctggttaccctaggaatagtttatgagggatccacaaccgttcaccacaaccgtttgttgcatgatcaagtaaaagtcggtgttgaggaggttagagatgcagatgctcctattcctatacccactgaagaggttaagttagtggggcagacacttaacaccttccttgcttag

SEQ ID NO: 50396 - DNA, 831 bp, Glycine max
  Peptide Sequence Number=SeqID_142081
ggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaagtagaatttggagcattccaaaaacttggagatccaactacaaaaaacagttgttgcgagggttgcccaaaggcaatatataaggcatacccagtaaaacttacaagtaaaccagatatagagatggcaattagggttgctgtttccattattagaattctaaagtttcaagatcacaatagatctataggataa

SEQ ID NO: 50397 - DNA, 570 bp, Glycine max
  Peptide Sequence Number=SeqID_142082
atgccgatctccccctgcggaagtatcagttggtctgtgccgttccgacataggtacgatcgtgcccacaagacacccagtggacccggagaagtccaacagggccctggggtttccaactctggttacgggcctctgtcagtcctacagggtgcccgttccccccaacaagggatcgtgcctgcaagacacccagcggacccgaagaagtccaatagggtcctggggtttccagctctgattacgagcctctgtcagttttacggagtgcctgtcacccccagcaaggtcatcaagccccctattaaccgggctttcatcaagaagtactgcgcccccaggcaggcgcagggcgagacaccacaacagcctggggatggccggcagcgggccataaacgcaccgccaccacctctagagcccctaagctcatctacaaaagctggaatgttgcctacgacccgtggtcgaccagcaggcgaccaagtccaaagccaaagcaaaagtactaggtccgtgaccgacaagtcatcacgcgtccagctcaagacgttaaagaagcgctactag

SEQ ID NO: 50398 - DNA, 274 bp, Glycine max
  Peptide Sequence Number=SeqID_142083
ttgtcatcatcaaaaaggaggagattgtagaagcaagtttcaagatgatgaatcaagattgattcaaggagttttgatgataacaaagatgatgacaaaaagctcaagagaatgtgttcaagattgggtcaagaacacttcaagaatcaagagaaatttgaattcaagattcaagaatcaagtttcaagaatcaagtttcaagaatcaagaatcaagaataatcaagttgaagattcaagaatcaagaaaagactcaatcaagataagtactaa

SEQ ID NO: 50399 - DNA, 343 bp, Glycine max
  Peptide Sequence Number=SeqID_142084
taaggtgatcggaccgccgatcacccaggccttcatcgagaagtattgcacgcctaggcaagcacaaggtgatgcacctcaggccacagacgcaccgccaccacctcatcaggccgatcccgctggatcactaggcatggagcgttatctacagcacttggttcgccagcaggcggccaaccaccgggggcagtttggggctgaggtcgcatggcccggagactggctcaaggcccaggcatggcaggcgcccgcaggatcccctggtgcggaagaggaggcctgtatggatgaggagatgacggacttgctcggtttcttgggaggaagcggagcaacgtga

SEQ ID NO: 50400 - DNA, 174 bp, Glycine max
  Peptide Sequence Number=SeqID_142085
atgacctttcctccaaaagacactggtatagcaaacttaaaatgtgttgttcttcctccgggcagtagtaatgatgcaatcccacttgaagctactgttatgacaattcctccattagaccgtatagtagaggataaagttttccaaataaatgttttcccattgcctccataa

SEQ ID NO: 50401 - DNA, 270 bp, Glycine max
  Peptide Sequence Number=SeqID_142086
atggctctggaatggtggtctcggatgaagcatcctatacctgttggggtacttgggctatgggaccttcaccttccctatcaagagaaggttgggccccaggccaagctaccctctctaagaactactctactgataagatggatcctaggggagctaccctctgtaggctctacagcaatagaatttatccctgatggatactttgaagcattgcttcaaagcgctgagagtcaacatgagttgggactgaaggagctgcagaagtag

SEQ ID NO: 50402 - DNA, 582 bp, Glycine max
  Peptide Sequence Number=SeqID_142087
atgtgtcctccaccgtcgagtttggagctatgtttcatgattgcctatgtgcggaccctcaaggcaatcctccattctcgccctttttttcgaagccccatgaatttattgcctagcacgtttcatgtttcccccaccttcgagattggagctatgtttcatgattgcctaagtgcggaccctcaagggaatcctccattctccccctttttcggagcccccccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 50403 - DNA, 819 bp, Glycine max
  Peptide Sequence Number=SeqID_142088
gtcgactctagaggatcccacgaggagggagtgcgagacatgcgttcatgggtgagggatcagtggattccttttgacgcagatgccctcagccagttcctaggtgacccgctagtgttggaggaaggccagaagtgcgagttcagtcagaggaggaacaggaccgacaagttcgacgaggaggccattgctcagctgttatgcacaccggggcaggatttcacctggaccactgcagggaggcgggtgcggatcatgcgcaccagcatgaccaccttgacccagatgtggatgacattgctgcttagcaatgtcttgcctagtgatcataactccggtctccctctgctgaagtgtcagctggtgcaccctctagacccggataagtataacagggccctggggtttccgacattgatcacgggcctctgccagtcgttcggggttcccgtcacccccagcaaagtgatccgaccatcaatcacccaagccttcattgagaagtactgcacgcctaggcaggcacaaggtgacacacctcagggcgtgggcgcatcgccaccacctcctcaggctggtcccgctggatcactaggcatggagcgctatcaacaacacttggttcgccagcaggcggccaaccaccgcagacaggggcagagttccaccccttttgtgtgccctaccccggagcagtttgcggctaaggtcgcatggccgggagattggcccgatgcccaggcaggggaggagcctacaggatcccccggtaggatggatgagccccgcatggacgaggatatgactgacctattcgat

SEQ ID NO: 50404 - DNA, 668 bp, Glycine max
  Peptide Sequence Number=SeqID_142089
atgggtgatcaagaggagacgcaggaacagatgaaagccgacatgtcggctctgaaagaacaaatggcctccatgatggaggccatgttaggtatgaaacagctcatggagaagaacgcggccactgccgccgctgtcagttcggctgccgaagcagacccgactctcttggcaactacgcaccatcctccctcaaacatagtaggacggggaagggacacactagggcacgatggcagccctcacctgggatacaaccgagcggcttacccttatggattgccgcccaactattcaccacccatcttgcaagaagatgcgggccacattgcttctcccgtccatgaaaaagagcctcctcagcagcccgacgaagtccataaagaccctcaagattatgctcggagggatgtcgagttttatcccccgatccccgaagggccggcaccaggcacgttgccccaacccaacatcgcagcatcgccaatagttttgtctatggaagggccgcccccggcaattgaagaaaggaggaagctcgatctccttgaggaaagattgagggctgtggaaggatttggggactatccgtttgcagacatgacggatctttgcttagtacccgatgttgttattcccccgaaattcaaagtgccggacttcgacaa

SEQ ID NO: 50405 - DNA, 378 bp, Glycine max
  Peptide Sequence Number=SeqID_142090
atggcattgccatatggcctgcctcccaactatacaccactcaatgtggcgtacactcctagtgagaatgtcaataactccactcccatactcattgagagccaacaacctcaatctgatcatgcacatgtctctcaatccatgggggagacacatgaaattccccaccacaatctagccgacttcgagccttgcctcggaaatgccactgaagggcaagcagttggtggtatacccctgcaaaacactttggaggggcctcaattttgcccccaaccacaacctttctatggaaaaatggtgggttacacaccttcaagctttgtggatttggtcttcgtcggcgaaaggatcaaaagtgggtcaggaaagaggtaa

SEQ ID NO: 50406 - DNA, 216 bp, Glycine max
  Peptide Sequence Number=SeqID_142091
atgtcgcaacctacccttcggcgggagggtgacgcgagggctaacaggtgcgtcttccaagggaggaaaatgcctggagtcgcccccaacgtttattcaaggaaaacgtcggaaaaaccagaaaagacgtggtctatgaactttaagtgtgaaaggttcgagagttgtatttacgcacggggaaggatgtttcccatgctcctacgtattccttaa

SEQ ID NO: 50407 - DNA, 633 bp, Glycine max
  Peptide Sequence Number=SeqID_142092
atgccttatgtggaggccgcagaggagtcattagaaaccgctttccagtcttttgaggtggtaagaatttcctccgtggactccttctctgggcaagcttgcctgtccgatgcagcagtaatgatggcccgagttatgttggggaacggttacgaacccagaatgggtttaggcaaagacaacggcggcataactagcctgataaatgccaaaggaaatcgtgggaagtatgggttaggctataagcccactcaggcagatataaagagaagcatcgcgggaaggaagaacggtagtcaaagctcgcggttgagacaagaaggtgaaggaagcccgccttgccacataagtagaagctttataagcgcgggtctgggggacgaaggtcaagtggtcgcgatatacgaagatgatgttccgagtacattggatttggtacgaccatgccctcctgatttccagctgggaaattggcgagtggaggaacgccccgacatttacgcaacgagcataatatccgatgacgagtccctcaaaggtactaatactgggacccgcctatccacttcgagcaagaaacgaatcaaacggaagatgaagggaacgaggatgtgggacttcccccgaaattag

SEQ ID NO: 50408 - DNA, 303 bp, Glycine max
  Peptide Sequence Number=SeqID_142093
atgccccatgggttgtttccttacaaaagtcacgcgctaatgccattgaggcatttcaccgaacacttggtgggcgcgcgtttaggcgtcaatagcaagagaacggggacaatgtggcatagccccaaaaggagatcaaaataccccaatgaaaagctagaaagcttagggatggaacacttacttgttgacgatgaacaaaagcgcaaaacggaatcaaaaaaagcgaaaaagggtgaccctagggctgcaaattcgtcaatcccgtgggggtggctcgcccagctcgcccaggcgagctaa

SEQ ID NO: 50409 - DNA, 243 bp, Glycine max
  Peptide Sequence Number=SeqID_142094
atgaaggataagaaggttgcagcagctggtgtcttgctaagcgagacatatgcgcttagcgaacaacatccgctaagcgagatatcagctcgcttagcgagtgtggagaatttggaagagaatctgtcatgcatgcatgcgctcagcgcgccatcagttcacccagcgagtcatttgtctcttctggtgataacttgccatgaaaggctaaagcttttgttgggaatttctgctgagccttga

SEQ ID NO: 50410 - DNA, 231 bp, Glycine max
  Peptide Sequence Number=SeqID_142095
atgcttatgtatggctggttgtggaaagggttgtacatattgggttatggacgttttctagtagatcccaacgatcaaaatcttggagggattgatggggacccggtgttgagaggaacgaggatgagggctacatgggagtacgtgagctcagttgaaggtgggcaactggggatggtggatttatgtgtgatttgtggatgtggagagtcgacttgcaccatcgcctga

SEQ ID NO: 50411 - DNA, 363 bp, Glycine max
  Peptide Sequence Number=SeqID_142096
atggttatgggggatttcatcagcagactctcctttcccgcatgtttgcattttagcgaagaaaacaccgagactttttcaagtctcacaagttatccagaactacgtaggtctgagttcctcattggaggatacgtaggagcaagagcctcgcttttgtcgaccacaccgccttttgttgccatgacccaaaagctggtagcccgcggagacgtcttacggttatccgcgcctcttcattcgatgaccccaagtgtgattgatgagcagaggccaatgtggccatctgcgcccttttcggagatgtcagcatcttccggtggagactttttcaagtctcacaagttatctagaactacgtag

SEQ ID NO: 50412 - DNA, 550 bp, Glycine max
  Peptide Sequence Number=SeqID_142097
caccacacccgccgcgcttaatgcgccgctacagggcgcgtcccattcgccattcaggctgagcaactgttgggaagggcgatcggtgcggagcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaggagttagtcttgaagtcatgcgccggttaa

SEQ ID NO: 50413 - DNA, 495 bp, Glycine max
  Peptide Sequence Number=SeqID_142098
atggaagggttagtggacctagcagtgattgacgctttcctcgcctttcatcatggcaaggaaagcccggtcgtcgccattttggccaagcctgtctatccgctacaaggtcaccgctcgtgcgtcgaaaaaggaaaggcgaattgggaccaactcttggctagcatggaggggcgtctgctaattggttccctcgctagaaggaaggaagaatcaggattctatcttcatgcgaaggatgagtgccatcagacgaaagcatcacgcctttcatcgcacggggtttcagtgaccacaacgcgagggtactccaaggagttcgcaaggcatgggatgcggcgtgaagaaaggacagagagcttaggggaagcaactgtgagagacaatgaggttaaaacttcggaagaaagtgatgaggtacaagccctaaaggcagagcttgaaagagcccgggtagtccaagagaagttcaagtccatagccatcaaagtctga

SEQ ID NO: 50414 - DNA, 447 bp, Glycine max
  Peptide Sequence Number=SeqID_142099
atggccggaacaaattccgaggggctctgtggggcagtaacagtgagcttaagctccggagagaggaaagggaccaatcacaagtccaagagaagcttgtctcagcggttatgcgagaccgagaccaacatgttagccatcattagcaagtaccaagaagaattaaatctagccacggcccacgagcacaaagtggcgggcgaatatgctcgagtgtgcacggaaaaggaggctagaggaagggtgattgactcgttacatcgagaggcaacgatgtggatggaccgatttgcccttactttgaacgagagtcaagaacttccccgattgctggccaaggccaaagcaatggcggacgcctactccgcccccgaggagatccacagactcctcaactattgtcaacatatgatagacttaatggcccatataattaggaaccgctag

SEQ ID NO: 50415 - DNA, 228 bp, Glycine max
  Peptide Sequence Number=SeqID_142100
atgttgaaggataataatgttcggtttcggtgtcttttcatgagagttgatgcactccccgaggttattgtggccggcagagatttgtctttgatgagtgcagtgaaaactgtattcccggatgctacgaacttgttgtgtcggttccacattgacaagaatgtgaaggcaaagtgcaaaaccctggttgctcaaaagaatgcatgggattatgtgatggaggcttag

SEQ ID NO: 50416 - DNA, 585 bp, Glycine max
  Peptide Sequence Number=SeqID_142101
atgtctcttgccactctctttggaaaacttcaagaacatgaaatggaacttatgagactccatcaacatgaagagaatgatataaagagaaaaagaatagcattcagagcctcatcatcttttattcaagaagaaagtgacaaagaggacttgactgaaacaaaagaagatgatgatgatttcagactctttgtgaaaaggttcaataaatttctgagaaataaaagaaataaaagaaaatcaaacatcaatacaaagaagaaagaagaagactcctccttagccccatcatgctatgaaagtaatcaaccttggcacatgagatccgattatcttgtctttgaaagaagaattgaaaatctgacaagaggaatctcaaagaaaagaaagaaaagaaagcatagatcacttgggatgaaaataaaaaaaaaaattcttcaagtgattcagaaaaataaaatcataaatctgggtatcatgatgaaagactatgaaaatggagaagagcaaaagcaatacattgataacaatttctccaaacacatggcatgcatcaaagtttattcatatttctccccaagataa

SEQ ID NO: 50417 - DNA, 180 bp, Glycine max
  Peptide Sequence Number=SeqID_142102
atgggtaaagaagtgttggatgagggtttggctttgcaagagcttaacattcctgtgctttgtcatggtgcccaaggaattgatcaaggggttcccatgaaccctaagagaataaaggtcattcctgagtggcctactccaccaagtataagaaaaatttggggcttccatgacttatga

SEQ ID NO: 50418 - DNA, 369 bp, Glycine max
  Peptide Sequence Number=SeqID_142103
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcccgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagtcacgacgttgtaaaacgacggccagtgaattgtaa

SEQ ID NO: 50419 - DNA, 222 bp, Glycine max
  Peptide Sequence Number=SeqID_142104
atgttgctaagtagcaatgtcattcatatctgggtaatagtggtcatgttggtgcgcatgatccgcactcgtttctttgcagcggcacgggtgaaatcttgccccggtatgcataggagctgcacgatagcctcctcctctggttgtacttgcataggtggccctcctccaggatcagggggtggtccaagaactgataaaaggaaactattggccccttaa

SEQ ID NO: 50420 - DNA, 525 bp, Glycine max
  Peptide Sequence Number=SeqID_142105
atgatggtggcccgggtgatgttggggcacggctacaagcccggaatgggtttgggcaagaacaacggcggcaggaccggcctggtaagcaccagaggaaaccgcgggaagtttgggttaggatataaacctacaccggctgacataaggaaaaacatctcgaaaaggaagaacaaaggccaaggcctgcgatcgggacagcaagccaaagaggctccgccatgccacatcagtaggagcttcgtaagtgtgggtttaatacgcgagggacaagtcaccgcgatatgcgatgaggactccccgaggagatcggatttggtacagcgatgccctcacggtttccaactaggaaattggcgggtggaggaacgcccgggggtttacacaacaagcataatatccgacgacaagtctcgcgaaggtactaataccggggacccgatcgtcaatttcgagcaagaagcaagtcggacagaggatgaacaggacgaggatgtagggcttccccagagctggagaggataa

SEQ ID NO: 50421 - DNA, 522 bp, Glycine max
  Peptide Sequence Number=SeqID_142106
atgatgcaggattttgaaatccgtgcatatttcctgcatcatcttgttattatgattggtgccattgtcagtaatgatcttccaagggagtccttaccgacaaatcagctccctctttatgaatctgaccactacactcctcgtgacattggtgtaggaagccactttgacccatttggtgaaataatctattgccacgagaatgaagagatgaccgttcaaagccttgggttcgatggctcctatgacgtctattccccacatggaaaaaggccaaggggcggacatgacattcaggggatgaggcggagcattgacattgtccacgaacgcttgacatttatggcatttccttacatggatgcagcaatcactttccatggtgagccagtaataacctgctctcaggatcttccaggccatagcatgcccattggcgtgcgttccaaacgaaccctcgtggacttcctcgatcatgtggttcgtctctttggcatccacgcatcgcaggggatcctctag

SEQ ID NO: 50422 - DNA, 234 bp, Glycine max
  Peptide Sequence Number=SeqID_142107
atgaagggaaaccaacaaggagtaagtcatgtggagtcgccaacagtcgcaacctacccttcggcgggagggcgacgcgtgactcgtgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 50423 - DNA, 201 bp, Glycine max
  Peptide Sequence Number=SeqID_142108
atgaagtatggctccaaactctttgggtggaggacgcatgaacgaaaacgcaattcatggggctccgataaaaggcgagaatggaggattgcactagagggtcctcacaagtcaatcatgaagcatagctccaaactctttgggtggaggatgcatgaacgaaaacgcaattcaaggggctccgaaagtgggatcctctag

SEQ ID NO: 50424 - DNA, 543 bp, Glycine max
  Peptide Sequence Number=SeqID_142109
atgacttctcaacatataaattcaggaagatacacaatattcaattccaaactaatagagcacatctcggatgacactgatgacaaactcgatataacacagggagacattgttacagattattcacttgacgacataactgaggattttgctgataccgattacgatggcaatctagacgcaccatatgacaatgaaaataccggtttttacattcactgtccaaattatgttgtattgtccttcattacctttgacaatgtacacagtctaaatttttgcatttacatgttggtgcaagttacaaggatattggagatccaatttggcaatgcaagcaatgtaaagcgaatatgtggtatgatgagaggattaacaaagataaacatacaaaaaacccaaagttttcattatgttgtggtgatggaaaaatacaacggccaatactacatgatgcttcgcaacccttgcggcaactactctttgacagcagagactcacaagcaaagaaattctagcaaaacatacgtttatacaacctaa

SEQ ID NO: 50425 - DNA, 156 bp, Glycine max
  Peptide Sequence Number=SeqID_142110
atggaaatgttttggacgcgttacggaagtgcctcggaaaatgagggaggagcttgccacccagctcgcccaggcgtgcgaggttgcttccttcagaaggcacatcctggaaggcccaagtgggcctggttgctatttgcaccccctatttactaa

SEQ ID NO: 50426 - DNA, 450 bp, Glycine max
  Peptide Sequence Number=SeqID_142111
atggtgaaagttggaacctcttacgtgccgatcaacgtctcattttcgcaaaagttggccgacagcggctactcccgcgtacgggcagctgccctccgtggcgtatcatggtttctatcagctgtccttcctgttcagctactgacggaattggttatccgcgtcacaattcggcacacaagcatacacgccggacatagcgcggcaagtgtagccggggtgcagacgctgcagctaactcaccacccgccggttaattgcgttccgctcagggctgcccattcgccattcggtgcgcaactgttcgggaagggaccgatcggtgcagggcctcttgctattaatgatcgccaacgcggcgaggggaggcgcagtttgcgtaattgggtaacgctagcggagtgtttcccatactggttactatgttggcaactgagagggtgtcagtga

SEQ ID NO: 50427 - DNA, 243 bp, Glycine max
  Peptide Sequence Number=SeqID_142112
atgaccataatttgtctctgcgtgccatcggacacgactgtgtctgaatggcaaaaggtgtgtgaaatgaccataatttgtctccgcgtgccatcggacacgactatgtctgaatggaaaaaggtgtgcggaatgaccataatttgtctctgcgtgccatcgggcccgccgcctctggatgacaaaagggtgcagaatgaccataatttgtctctgcgtgccatcggacacgactgtgtctga

SEQ ID NO: 50428 - DNA, 819 bp, Glycine max
  Peptide Sequence Number=SeqID_142113
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacgatgtgccgccccagccaaactccccacctgacaatgtcttccgcccggatcgaccggccgaagccgaccttgggtcccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctc

SEQ ID NO: 50429 - DNA, 234 bp, Glycine max
  Peptide Sequence Number=SeqID_142114
atgtccaaatcttgtggatttgggatgaccggccctctcgatgagtcgatctcttgctttctcataagggtggacctttgggtacttgtacctatcacctttagaggactacacgtcctcgccttgagaggactacacgtcttcaccttcgtagggctacacgccctcacctttagaggactacacgtcctcgccaacagagggctgcacgccctcaccttgagaggactacac

SEQ ID NO: 50430 - DNA, 368 bp, Glycine max
  Peptide Sequence Number=SeqID_142115
atggcatcaagaaagagggctagaatcgatgacatcccttcatcatccatcccaggtcctcagtcagcagccataggaccagatcctgaagctcaacttccattggtgagacccaatgaggctgcttctcctgagcccgcaccagcacgggttgaaccaatgccagctgagtcacgatctccagtggtgaatccacctccttctcctgagcttcaagtagttcccccatctccacctctgattatcatctctgatgcatcatcggatgaaactgctacccctcctgattcaccagctggagaaacaactgatccccctgattcccagatgaaggaattgccaatctttctgattcgtcatctggagaa

SEQ ID NO: 50431 - DNA, 390 bp, Glycine max
  Peptide Sequence Number=SeqID_142116
atggtcatctgcgccctttccggagatgtcagcttagttttccgatggagaccttttcaagtctcacaagttatccagaactcggctgagcggaggatacaagcaagagcctcgcttttgtcgaccacaccgccttttgttgcacccatgatagctgccgcggagataccttacgagaccaagtttggtcattctgcacccatgatacgtggagataccttatggttattcgcacccttttgtcatccagaggcggcgtggcccgatgacaagcagagaccaaagaccaagtttggtcattctgcacccatgatacgcggagataccttatggttattcgcacccttttgtcatccagaggcggcgggcccgatgacaagcagagaccaa

SEQ ID NO: 50432 - DNA, 321 bp, Glycine max
  Peptide Sequence Number=SeqID_142117
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctacgaaagcttgtgcatccaataccctgatgaggat

SEQ ID NO: 50433 - DNA, 519 bp, Glycine max
  Peptide Sequence Number=SeqID_142118
atgacacgcggagataccttacggttatccgcacccttgtgtcatctagaggcggcgggcccgatgacatgtggagacaccttacggttatccgcacccttgtgtcatccagaggcggcgggcccgatgacacgcggagataccttacggttatccgcacccttttgtcatccagaggcggcgggcccgatgacacgcagagacaaaatttggtcattctgcacccttgtgtcatccaaaggcggcggggccgatgacacgcggagataccttacggttatccgcacccttgtgtcatctagaggcggcgggcccgatgacacgcggagataccttacggttatccgcatccttgtgtcatccagaggcggcgggcccgatgacacgcgaagataccttacggttatccgcacccttttttcatccagaggcggcgggcccgatgacacgcagagacaaaatttggtcattctacacccttgtgtcatccagaggcggcgggcccgatgggcccgatga

SEQ ID NO: 50434 - DNA, 282 bp, Glycine max
  Peptide Sequence Number=SeqID_142119
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggctgcgcaactgttgggaagggcgatcggtgcgggcctcttcgctattacgcagctggcgaaagggggatgtgctgcaaggcgattaagttgggtaacgccagggttttcccagtcacgacgttgtaa

SEQ ID NO: 50435 - DNA, 447 bp, Glycine max
  Peptide Sequence Number=SeqID_142120
atgtcaaaccataaaagcactgagttaacactaaagaaccttgaggtccaggtgagacaactggccaagcagatagctaacaagtcatccaacaattttgtggcaaatacagagcagaatcccaaggaggaatgcaaagatgtgatgacaaggagtaaaaggtttgtggaggctgaggatgaggatagtgttgtgcataagaaggaaactgctgacaagaaaggtaatgattgcaagaaaaatgaggtgagaggtgaaagtaatcaagaaaaagaggaacaaataatggtcaagaataaaaaattgaaggaccaagaaaaagaaaaagaagtagaaaaagaaatagaaaatggaaaaaatgaaaaagaagaaaaaaataataggaatgcaaagaagagtagaagtgaaaaagctgtggatgaagatgtggaagtaccatatcctgtg

SEQ ID NO: 50436 - DNA, 1104 bp, Glycine max
  Peptide Sequence Number=SeqID_142121
atggcgagccaagagaacaaggagagtccagtggtggctatcttggcggatttgtttgacacctttgaccgaaggtgtgagaaaaacagtgcacggattgtctgttgtttacccgctctctgtgtgtggttggtttcacacctattccaacaagacacaagacacccgtgtccgcttcaaagttatcgctcatgcgccgaaaaaggaagagtcgattgggaccaacatttggctgggatagggggcagcgcaatcaattggtttcctcgatggaaggaaggcaaggagggagtccttttctcaagtggggactaccctaatgttccgttgttagggacaaggggttgcattaactataatcccacacttgccataggacagttagggtaccccatgaggggagcgccaacagaggagagtctctcgcctctccttgtgagggatctaggtgcgcaaagtctcaaggttatacatagagtccacaaggcatggagaagtccgttgaggaaagacaaggagcttaggggcattcgtaatggcgtcatcggtggttatcatggatggctaagagttcacacgcgagggttagattggctctccaagttgaaagttatcgatgaggagaacttcgaagctccggaggaagatgaagaagtccgagctctaaaattagagctagggaaggcaagactcgccaaggagaagttcaaatcagccgttacacacatccggaaagagtgcaccgagttacaaaaggaaaacgcggccactgcaagagcccttgaacaagaaaccaaaagggcccacaaagaggaacatggccgagagaaattccgaggagcattgtggggtagcaacaatgagctcaagctccgaagagaggaaagagaccggtcacgggtgcatggcatgatcttaaaagaagagttagctgcttgcgcaaggtccaagaggagtttggctcaacacttggaagccacggagcaaagcatgctagctatcatagggcagtacaagggagacttgaaccagtctgtgacccatgaacaaaagctagtggaggattttgcacaagtgtacgccgaaaaagaagcaagagggagg

SEQ ID NO: 50437 - DNA, 231 bp, Glycine max
  Peptide Sequence Number=SeqID_142122
atggcagcggaatggagaaggaagagagagaggagacgccacttcaaggagaagatgagtctagaagaagctcaccaccataggaggccatggataagagcttggaggaagaaggaaatgaatgaagggagagggagagaagagcatgaaattttgtgctctaaaagagatctgaaatctgaaaccactaatccaagatcaattccaagattctccactaagtgtgcttaa

SEQ ID NO: 50438 - DNA, 1055 bp, Glycine max
  Peptide Sequence Number=SeqID_142123
ggcggttgatggaacctctccaaatgcaagccttccgcaagacttacggaaagatcttagagttgaccatagcagaggtatccatagaagccattgcatcactcacccaatactacgaccagcctttgagatgcttcacgttcgaagacttccaattggtaccgaccattgaagaatttgaggagattctaggatgtcctgtcgggggaagaaaaccatatcttttctccggttgtctcccctctttgagcagaattgcaactgtggtcaaggattcagcaagaggtttggactgcgtaaaacaaactcgaaacggcatagtgggcctaccacggaagtacctagaagacaaggcgagggatatggaaaatcaagaagattgggtcccgtttatggatgtgttagcattgctaatctttggggtcgtcctctttccaaatgtagatggtttggtggacctagccgcaatcgacgcgttccttgcataccgccatagcaaggaaagtccggcgatagctgtcttggcagatttatttgacacatttgaccgaaggtgcgaaaagagtagcgcacgaatcatctgttgcttgcccgctctctgtgtttgggttggtttcacacctgttccagcaaggcacgaggcatccatgtccgctccaaagccatcgctcgaaggaaaggagggagtccttttctcatgtggagggtacccaaacattccgctgataggaacgaggggttgtattaactacaatcccgtgctcgctataagacaactagggtaccctatgaggggagcaccgatggaagaaagcatgtctcctttccttgtgagagatttcggcgcgcaaaatttcaaggctatacaaagaatccataaggcatgggaaaccccgttaaggaaatatcaagaacttaggggcattcgtaatggcatcattggtggttatcatgaatggctgaaagttcatatacgaggtttagattggctcgccaagttaaaattcgtcagcgaagacagtttcgaagcaccggaagaagacgaagaagtctaa

SEQ ID NO: 50439 - DNA, 633 bp, Glycine max
  Peptide Sequence Number=SeqID_142124
atgggtcaggcttgcgtattcccattgaagaaacatcttatgaagttaattacatgggaaaccagcctagacaaaattttaatgcaggtggattttctggatttcaacaaggccaaccttaccaacagcataatcaatggagaactcaccctggtgtcattgacaaatcataagagcacagagtcagccataaaaaatctagaggttcaggtagggcagctagccaaacaacttgcagaaaaatcttctagtacttttggagctaacactaagcataatccaaaagaagaatgcaaggctgtgatggcccgaggaaggaagctagtaattgaaccagcacctgaactagtgcaacccttttgtgaacttatagaggaagaagaagaagaagaagaggatgaacagatgagagagacaccaataattttgagtgaaaaagaaataaatgaaaaagaaaaagaagaagaaaataaaaaaatgagaaaaatgaaaaagaaaaggagagaaaagaagagaagagaaaaagcaagagtgagtgtgctagagagaaaaagaaagaagcatcttcaggtgaagggagagaagtaccatatcctttggtaccttctaggaaagacaaagaaagacatctag

SEQ ID NO: 50440 - DNA, 132 bp, Glycine max
  Peptide Sequence Number=SeqID_142125
atggcttgcacccacattccagtggaagcaaagatgcttttcgctgcaaaattcatttcttggttggtgttttggtttgtgctaaaggtggtgttcgtcattggaagtgcgatagacaggctttgtggttga

SEQ ID NO: 50441 - DNA, 857 bp, Glycine max
  Peptide Sequence Number=SeqID_142126
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgccttcgtgctgacggaactcttccccgaagctttgctggatcggagcccggggatcgtcatcgagctgaacgtgtgctgaactcggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50442 - DNA, 438 bp, Glycine max
  Peptide Sequence Number=SeqID_142127
atgacgatccccgggctccgatccagcaaagcttcggggaagagttccgtcagcacgaaggcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 50443 - DNA, 201 bp, Glycine max
  Peptide Sequence Number=SeqID_142128
gaggaatatttgtacttgggggcatgtcactcggtttggaactcccttgagacccgggttgatcaccatgggggggaagttgcctatgcacgacaaggtgacctcgacacttactacctagttttcctaagtgagagtgtcgtgtggacacgcttaggctatttccttggggatggtaccatattgcatttgagagttgag

SEQ ID NO: 50444 - DNA, 270 bp, Glycine max
  Peptide Sequence Number=SeqID_142129
atgaaccacttcttccggaaagttcccgaaagaggtttttcgggagtcttccggaagaagggttcttccggaagacgtttggttacttccggaaactttccggaaaatgttctttcggaacttccggaagaacccctaacgggtcttccggaagaacccctaacgggtcttccggaagacttctccgtcagccttttccgccattttttccggcgtactctcgtcttctcccctctcgtcttctaccctaggtttcgtcttctaccctaa

SEQ ID NO: 50445 - DNA, 516 bp, Glycine max
  Peptide Sequence Number=SeqID_142130
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgcaaaggggtaaaagtttcttacccaccaggctcctggactctgtgcactctggtgggcagatg

SEQ ID NO: 50446 - DNA, 159 bp, Glycine max
  Peptide Sequence Number=SeqID_142131
atgtttgcttacaggaacttgcttaataatcttaacattggagcatatcagccttcctttgaatgtcctttcgctaagcgtctgcttctcgctaagcgcataatcactcatgcgctaagccacgagttcaagcgcttagcacaccaccctggcacctga

SEQ ID NO: 50447 - DNA, 400 bp, Glycine max
  Peptide Sequence Number=SeqID_142132
atggatagagctaggttggtctatggcttggtgactaacatggacatgaacatcggagcccttatctcaggtcagatttcttctattgctcagagtaactccgctaggctcggatctctagccttgatcactgccctatgcagagctagaggagttacctctaacagtctaacttatgagagcctaagcccggccattaacttggcctacataaagaaaaactgttggaatatggatgatctaacagttaactttagaggggcgaggaaggcaagggtgagaccagctgatgttccttcttcttctactctaccagctccttccacttctgctactcctacaccagctcctctaggctcatctactcaggactctcagcgctttgaagccatgcttcaga

SEQ ID NO: 50448 - DNA, 588 bp, Glycine max
  Peptide Sequence Number=SeqID_142133
atggccaagttcgatccagagatagtcctcgaattttatgccaatgcttggcctacagaggagggcgtgcgagatatgaggtcctgggtgaggggtcagtggatctcgttcgatgcagatgctatcggccagctcctgggatatcctttagtgctggaagagggtcaggagtgcgagtatggccagaggaggaaccggtccgatgggttcgatggggaggccatcgcccatttgctatgtatatcggggcaggattttggccggactgctgccgggagacgagtgcggatcatgcgcaccaacatgaccaccctgactcagatctggatgactttgctgctcaacaacatccagcacaacgatcataattccgacctccccctgccgaagtgtcagctggtgtacgccatcctgacgcggatgagcattcacgtggctcagttaatcgctaatgccatctatatatttgcaggtatggcgcctaccaggcaccctctggacccggataagtccaacagggccctaggatttcccgccttgatcccaggactctgccagtcgttcggcgtccccgtcgcacctagcaag

SEQ ID NO: 50449 - DNA, 513 bp, Glycine max
  Peptide Sequence Number=SeqID_142134
atgactggccccctcaatgagtcaatctcatgctttctcataagggtggacccttgggtactagaacctattgcctttagaggactacacgtcttaaccttcagagggctacacgccctcaccatcagagggctacacgtcctcgccttcagagggctacacgccctcaccatcagagggctacacgtcctcacgttcagagggctacacgccctcaccatcagaggactacacgtccacgccaacagagggctgcacgccctcaccttcagaggactacacgtcctcgccatcaaaggactacatgtcctcatcttcagagagctacacgtcctcgtcttcagagggctgctcaccctcgccttcaaaggactacacatcctcgccatcaaagggagacacgtcctcaacttcagagggctgcatgccctcgcctttagagggctatgcgtcctcactttcagtgggctccatatccataccttaagagaatttaaggtcctttgcccttaa

SEQ ID NO: 50450 - DNA, 585 bp, Glycine max
  Peptide Sequence Number=SeqID_142135
atggtttcaaggtatgctttaaatcatattgttgttgagtttaagtgtgtacattatgctggcaagaatccttccacttgtggttgtgtcatgagaatcacgcatagtcttccttatgcatgggagctatctaagtatgttgttggttgcatcccacttgattcaatccatatgttctggaggagactcagtttttcagaccaagggttatctgagcccgaagtaagcatcaaggaagagatggaaaccatatgtaaaagatttgaagaacttgatgtttgtgtgaggcgtagtgcatcatcttctgaccagcccaatccaagaaggatcatgcctatgttggatcaatttcagccatttatgcaagatttcattgacaacattgtggatgtcaaacctgacggaaactatggatatcagtcagttgccagtttattaggtgtgggtgaagactcttggtcgttggcccacaaccatctgcttaaagaacttgacaaattctcaaatgactatatcaagctcttcggtggcacaaacaaatttgaggaattaaggatgtcactacttgttgatgggttaaccaag

SEQ ID NO: 50451 - DNA, 612 bp, Glycine max
  Peptide Sequence Number=SeqID_142136
atgacccccttgactcagatgtggatgacgttgctgctcagcaacgtcctgcccagcgatcataactccgacctccctctgccgaagcgtcagctagtgtatgccatcctaacacggatgagcgtccatgtggctcagttgatcgctgacgccatttatttatttgcaggtatgccacctaccaggcaccctctagacccagataagtctaacagggccctaggttttccagcattgatcatgggtctctgccagtcatacctagctgcagacgcaccgccactacctcatcaggttgatccagctgggtcattcggcatggagcggtatttacagcacttggtttgccagcaggcggccaaccacaggggacaggtgcagacccatgagtgtctcaaccagctcagcctcagtctgcagagccaaggtttcgctccttttgcctgccctactccagatcagttcagggctgaggttgcatggcccggagattggcctgaggcccaggcaggggaggcgcccgcagaggctcccggcgacgtggaggaggctcgcatggatgagaagatgacagatttactcggtttcttgggagggagtggagccacatga

SEQ ID NO: 50452 - DNA, 802 bp, Glycine max
  Peptide Sequence Number=SeqID_142137
gtcgactctagaggatcccacccttgtgagagatttccgtgcgcaaagtttcaagattatacaaagagtccacaaggcgtgggaaagcccattaaggaaagataaagaacttaggggcatccgtaatggcatcatcggtggttatcatgaatggctgaaagttcgtacacgatggttagattggctctccaagttgaaaattatcaacgaggagaacattgaagctccggaagaggatgaagaagtccgagctctaaaaaccgaattaggaaaagcgagacatgccaaagaaaaaatcaagttagtcgctacagacgtccggaaagagtgtgtcgagttacgagaagaaaatgcagctaccgcaagagcccttgaacaagaaaccaagagggctcgcaaggaagagcatggccgagacaaattctgtggagctttgtggggcagcaatagtccaaaagaatcttgtctcagcgtttatgcgagacagaagaccaatatgtttgccatcgtcagcaagtaccaagaagaattaaatctagccacggcccacgagcacaaagtggcggacgagtatgcccgagtgtacgcggaaaaggaggctagaggaagggtgatcgactcgttacatcaagaggcaacaatgtggatggaccgatttgctcttactttgaacgggagtcaagaacttccccgattgctagccaaggccaaagcaatggcggacacctactccgcccccgaggagatccacagacttctcaactattgcatccctatcgcaccagatccaaatctaggatga

SEQ ID NO: 50453 - DNA, 396 bp, Glycine max
  Peptide Sequence Number=SeqID_142138
gatggacccttgggtactagtaccctcaccttcgtaggactacacgccctcaccttcaaagggctacacgccctagccttcagaggactacacgtcctcaccttcagagggctacacgccctcgtcttcagaggactaaacatcctcaccttcagagggctacacgccctcgcctttagaggactacacatcctcgccttcagagcactacacgtcctcgccatcagagggctacacgccctcgccttcagagggatacacgccctcgccttcagaggacaagacgtcctcgcatttagaggactagacgtcctcgccttcagagggctacacaccctccctttcagaggactacatttcctagcctatagagggctacaggccctcgccttctga

SEQ ID NO: 50454 - DNA, 456 bp, Glycine max
  Peptide Sequence Number=SeqID_142139
atggtgaaagttggaacctcttacgtgccgatcaacgtctcattttcgccaaaagttggcccagggcttcccggtgagctgatcaacagaggagcaccaggtgctccagtggcttctgtttctatcagctgtccctcctgttcagctactgaaattcggggtggtatcgcgtccaattcggcacacaagctaccgccggacatcaaagtggcgaaagggggagtgtataggcttactatgttggcactgataacgcagggtgtttcagtgaagtgcttcatgtggcaggagaaaaaaggctgcaccggtgccagcagaatatgtgatacgactcactattccgggcttcctcgaactgagctccaccgctcggtgatgcggcgagcggaaatggcttaccccacgggcgcaggaattcgtcctggaaggcctaaaggaagcttacagggaagctga

SEQ ID NO: 50455 - DNA, 423 bp, Glycine max
  Peptide Sequence Number=SeqID_142140
atgacaccggtaaaccgaaaggcaggaacaggagagcgcacgagggagccgccagggggaaacgcctggggggcggagcctatggaaaaacggctttgccgcggtccctgctcttccctgaattccgccccgttggggataagccactgttctagagcgtcgccgcatcgacgaccgagcggtagcgagctcacactgtctgactgggaacaccctggcgttatcagtgccaacatagtaatcgccagtatgcagcacatccgccctttagcgccagctggcgtaatacgcgaaaggcccgcactcgatcgcccgcgcgttggccgattcattaatgcagttgcgcagcctgacatggtttccgaatggaaagcgcgccctgtagcgcaagcgcaattaagcgcggcgggtgtggtgagttag

SEQ ID NO: 50456 - DNA, 91 bp, Glycine max
  Peptide Sequence Number=SeqID_142141
tggcatcatccgaatctctgtagcatgtatcaaacgttccgccttgtaaggttcacatcatctggtataagagctttggctcttgatatag

SEQ ID NO: 50457 - DNA, 297 bp, Glycine max
  Peptide Sequence Number=SeqID_142142
atggcgcctcctctcacctcttctcctttgtcttccgctgcatctccatggtggaaaatcaccattaaaggacctcatggaagctcaaagatccagcctccacagaagccccacaagcaagcttccatcaaaggggttcccacgaactttgagagaataaaggtcattcctaagtggcccactcccccaagtgttaagggaagaagcccagggtttcaagaacctctggatttgaggtcaaatccttttcaagggggagggaatgatgcaattgtaccccccaaggacattggataa

SEQ ID NO: 50458 - DNA, 435 bp, Glycine max
  Peptide Sequence Number=SeqID_142143
atggcagcgcagttgatccatgatcgagttgtgatggagtgcctagagggtgtttgggagaccctcaaaggcaatgagaggtgccgattccgtggcacaattcgactcactgctacttcattagtacatccggaggaacccacacgcacacttcagcaacctgtggagtggatattacctactcctactccatatcgactagtggagccagttcaagtgatagaggtgtcatcctctaaagaggatcttgaagaagacccagaggagttacctcctgaacttgatatggacgcccttgacttacctgaggatgatgaagacccactccctgatgttgattccccagaggatattatgtcagcatctgaggcagactctacagaggagagtggccctggagggacagtgaatagtgacgactcttcatcgtcgtag

SEQ ID NO: 50459 - DNA, 180 bp, Glycine max
  Peptide Sequence Number=SeqID_142144
atggagttcttggagctcaagcagggaaacatgactatggctgaatatgcagccaagtttgaggagctggtgagatactttcccattatcaagggagagatggtgaaagttccaaacaaagggggcatattcagagagattgtccacatcccaaaaaggagcagaatggtggaggtctaa

SEQ ID NO: 50460 - DNA, 588 bp, Glycine max
  Peptide Sequence Number=SeqID_142145
atggaaaaacggctttgccgcggccctctcacttccctgttaagtatcttcctggcatcttccaggaaatctccgcccgttcgtaagccatttccgctcgccgcagtcgaacgaccgagcgtagcgagtcactggcacgacaggtttcccgactggaaagcgggcagtgagcgcaacgcaattaatgtgaatttggttgaacgacaagcaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 50461 - DNA, 357 bp, Glycine max
  Peptide Sequence Number=SeqID_142146
atgttgctaagtagcaatgtcatctatgtaagagtggtcatgttggtgcgcatgatccgcactcgtctctttgcagcggcacgggtgaaatcttgccccagtatgcatagtagcagtgtgatagcctccctctctagttgtgctcgcacagttggccctcctccaatatcagggggtggcccaggaaccgttaaaaggaaactactggcgagggagtgtagtcctatgatggcaaggacgtgcaatcctctgaaggtgaggacgtgcagtcctctgaaggtgagggcatgtagccctacaaaggtgaaggcacatgaccttttgacggcgaggacgtgtagtcctctgaagttgaag

SEQ ID NO: 50462 - DNA, 285 bp, Glycine max
  Peptide Sequence Number=SeqID_142147
atgaaggccgacctatcggccttaaaagatcagatgacttctatcccagaggccatgctaaagcttcaaaaaactatagaagataatgccacggcggccgcttcgaatacagctagggaagcgaaaccggtgctacagcccgcaataaacttgggccgagacagaaacgtgacgggttttaatcggagacttcactccccgtaccgctccagacgatttgagccaagcccctaccttcgaggggcagctccctcctcatgccgactatcctctacaagaagatga

SEQ ID NO: 50463 - DNA, 468 bp, Glycine max
  Peptide Sequence Number=SeqID_142148
atgaaagttatgtcaagcaagccaacaagaacaggaaggaagtggaagtccaaacttcaacctagaggagacggacatttccaagcactagagaggatcaatgacaatgcttacaagatcgacattccaggtgatgattctgaacatttgaggataaatgctttccaagaaggaggaaatgatgagaatcctaaatctgtccaaatacagggacctatgaccaagagtaggaccaaacagttagtggataccctccaacaaatgatagcagacaaacttaacaaggcccaaacttatcaaggtaatccttgtggcgtctaccctgacttatcttccttcaccggaagtggcgtctaccctgacttatcttccttcattggaagtggcgtctaccctgacttatcttccttcaccggaagtggcgtcatccataccttcgtagcctgtatcaagcgatccgcctcgtaa

SEQ ID NO: 50464 - DNA, 379 bp, Glycine max
  Peptide Sequence Number=SeqID_142149
atggacccagagaagtccaacatggcactgggatttccagtattgatcacagatctctgccagttctacgaggtactggtctcgcccacaaagctcatctggcccctcattaataggtccttcattgagaagtactacatgccaaggcaggcacaacagctagggcaagaccagcagcagctggcgatgcacgcatacatgcaagatttggctgaccagcaggcggcaaaccataggggtcaggtgcagttgaacaataacttctatcagtatacacttcaccagcagcaccaggaccccaacccttacccgtggcctactcccaagcagttcggagccattatcgcatggcctggggacaggcctaattttcaaggag

SEQ ID NO: 50465 - DNA, 309 bp, Glycine max
  Peptide Sequence Number=SeqID_142150
atggtttcaaggaacgctttaaatgagattgctgctgaggttgagcgtctacgttatctcagcaacgatccctcttcttgtggttgtgtgatgagtgtagaagcaagcttcatgatgcccaagagaatgagttcaagattgggtcaagaacacttcaagaatcgagagaaagattcaagaatcaagtttcaagaatcaagaatcaagaataatcaagatcaagattcaagactcaagattcaagaattaagaaaagactcattaaagataagtactaaaaagtttttcaaaacattgagtagcacatga

SEQ ID NO: 50466 - DNA, 534 bp, Glycine max
  Peptide Sequence Number=SeqID_142151
atggggaaccatccaagaccaaaatttaatgcaggtggatattctggatttcaacatggccatcaatataatcagcaacagggacaatggagaactcaccttgataatcagttcaataaagacaagggtgggccacttaacaagccacaacaacaaggggctagtctctatgacagaacgacgaagctggaaaagactcttgctcagttcatgcaagtatccatatccaatcaaaagagcatagagtcagccatcaaaaatctagaagttcaggtgggacaattggcaaagcaactggcagaccgaccgtcaagcagctttggagccaacacagagaagaatcctaaggaggagtgcaaggctgttatgactagaagcaaaatggtgagcaagaatgaaggtgagaagaggataggtgaagaaaaacaacaactagtgactgaaccagaaattgacccaggggtggaacctttgagtgagattgaggaagaagtggaagcagaagatgatcagcagaaggagataccaataatt

SEQ ID NO: 50467 - DNA, 419 bp, Glycine max
  Peptide Sequence Number=SeqID_142152
gaaactacttcttgcccttcctctagtggaagtgaagatgaagtaaggggtgaagagtctagtgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50468 - DNA, 148 bp, Glycine max
  Peptide Sequence Number=SeqID_142153
atggcgcccagcagcaacgctagcgtccaaccgccccggctcacggcacaccgccgccgcactgcgggcaaaagcggctgcccggcggcagcggcgcggcgcactggccgcaggtggcgttcagcgcggcaagcggctgaccgcagcg

SEQ ID NO: 50469 - DNA, 432 bp, Glycine max
  Peptide Sequence Number=SeqID_142154
atgttggcactgatgagggtgtcagtgaggtgcttcatgtggcatgagaaaaaaggctgcaccggtgcgtcagcagaatatgtgatacaggatatattccgcttcctcctcactgactcgctacgctcggtcgctcaactgcggcgagcgcaaatggcttacgaacggggcggacatttcctggaaaatgccatgaagatacttaacagggaagtgagagggccgcgacaaagccgtttttccttaggctccgcccccctgacaagcatcacaaaatctgacgctcaaatcagtggtggcgaaacccgactggactataaagatactaagcgtttccccctggcggctccctcgtgcgctctcctgttcctgcctttcggtttacggtgtcactccgctgttatggccgcgtttgtctcattccacccctga

SEQ ID NO: 50470 - DNA, 225 bp, Glycine max
  Peptide Sequence Number=SeqID_142155
atgggctcaaaaatctaccctcagattcatgagaaccgtagggccttcttcagcagctctagcccaatcctcttggagcctcctgctcatggctctggggactggtcccttcatagggaggattacatcaagcttcaccaaggaaaatgtagaagcaagcttcatgatgatgaatcaagtatgattcaagtagttttgatgatgacaaaaagcccaaaagaatga

SEQ ID NO: 50471 - DNA, 427 bp, Glycine max
  Peptide Sequence Number=SeqID_142156
atcaaccagagtcgctgagagcattctgtggacccaaatttctgatcggcatttactgggacggtgccgagcgcggttggcacttctctggcgccttaactccgtcaaggaaggcgtggtggcgatggacgatcagggcgagcgtagtgagtaccgcgcgcattttgatgcctcggtgatcgaccagcatctgcaggaagtgcgcacagcggtcagtgcgcggcgcgatgaggagctcaacacgtcagatggtcgtctgctgctgagcaacatttttccagatgccggtcgcgcagccagggacgtattcatgggcagtggcgcgcacgctgggaaatcacccgaaattcagccaggcgctgcgcctgccgtcccgaccgggccaggtaaactatccagcgccatcgccaaagcggtgtcagaatag

SEQ ID NO: 50472 - DNA, 326 bp, Glycine max
  Peptide Sequence Number=SeqID_142157
ggccaaggggagctcaggctataaagattatcgggaggagtgcgtgggatgtctgcaaactcttggcattgtttgcacctcatgcgtccttcggtgtggaaaccacagatcccttcatgatgttctctcatgacgtagtctgcctgttgactggcttcgtcctcgtttggtggcagtaccccccgaattatgaagttcttgtatggggtcatccagtttgggtcctcctcttctccagacataatttcctcagcatctatggtggaagtttggagcgtctcttggatgatagtcatgaggtgctcggccttcttggtgttgactag

SEQ ID NO: 50473 - DNA, 189 bp, Glycine max
  Peptide Sequence Number=SeqID_142158
atgggggtgcaaatagcaaccaagcccacttgggccttcttgaatacggttgcttctggaggaagcaacttagctcgcctgggcgagctgggtgacaagcttctcccctattttcctataaatagggggagaagtgaagggaaaaaatgtttagccctcctgaaaatccaagccgaggcgcttctgtaa

SEQ ID NO: 50474 - DNA, 312 bp, Glycine max
  Peptide Sequence Number=SeqID_142159
atgtctcctccacctatagaacctcacaatcactcacaaactcatctcaatctctcaggacgacttcctcttcaagctccgttctctacaagtggccttgatggtgcttacgcgtttagcgcaactctggaccgcttagcgcgcattagtgaatttcggcttagcgcgcgtctgctcgctcaacggatggactcaagcggtgcgcttagtgggatgagccctcactcagtgaacacgcatagctcatccttcttccagattcttcctcgcgctcaaccaaaggagtggtgcgctcaacggatggctcgctaa

SEQ ID NO: 50475 - DNA, 315 bp, Glycine max
  Peptide Sequence Number=SeqID_142160
atgcgtttttgggatttgcgtgctccttggttagaacctctaaggggtccgaatggtttagacttgagtagactgaaaaaagatatacagccttggcaagaacgccgttctgcggaatatatgactcatgctcctttaggttccttaaattccgtgggtggcgtagctacagagattaatgcagtcaattatgtttctcctagaagttggccatttatggcacgcggggaagagctcgcgcagctgccgcaggatttgaaaaaggaattgatcgagattttgaaccagttcttttccatgactcctcttaattga

SEQ ID NO: 50476 - DNA, 942 bp, Glycine max
  Peptide Sequence Number=SeqID_142161
gttgagtttggcagctgaggtggccaataactacgtcaactaccgtgcttgccaggcatccgtgcaggccttaaagcaggcgtacgactcgcgtagtgaaaccgcacgtttgacaggcatatcagccaatgccggcttctctgccccgtctgatctggcgctggcagaggctgccactcgtgccagtgagtcgacactggatggccagcaggcagagtgtgatggcctggtgaaggcgctggtggagttaaccaacctgcccgaacctgagctacacaacctgctggctaaaggtcacggcatgccagagcctgccatgtttgatgtgagtgccatgccggcaaacttgctcacacgccgccccgatcttgccgtggatgaacgtaatctggccgaagccagcgccaatattggtgtatccaaagcgcaaatgtatcccagcctgaccctgacgggctcgattggttaccgccgtaccaactttaatggcgcggtgacccgcacagactcctggtcttatggtccttcgctcaaattgcccatcttcgatggcgggaccttgcgcgctgatctggcagaggcgcgtgccaattttgacagtttgctcgcaacctacaagcaagatgttcgtaaggccgtcaaagaggttgagcaggcgctggttaacctggatagcgcaacgcgacgggcacaatcagaacaagccagtgcacagcaataccagcaatactttaaagcggcggaaattaactggaagtctggcggcctggacttgttgtcgctggaagatgcacgccgtcaaaaaattaacgctgaactgaatgtgattacgcagcaaaagaaccgcgtattgcaatggattgccctatacaaggcatttggcggggactggcaggaaacacagcaaactgtgaaacctccattgaaacccatggaaaaaag

SEQ ID NO: 50477 - DNA, 174 bp, Glycine max
  Peptide Sequence Number=SeqID_142162
atgggtttgccaggcttaaaggagcactcaaacccggtgaccccgaaggcctacactctgaagagtccgttagagcctctccctcctgattcaggtccaacccctaaaataattttgcatgcagacactgctcatgaattatacaatacccatgaccttacactcgtgttttaa

SEQ ID NO: 50478 - DNA, 294 bp, Glycine max
  Peptide Sequence Number=SeqID_142163
atgggtatctccctccttcttcttgtctccacccgctccgaacctcctattgcttgtgcttatggaagcggcataatcgaactttccccttctcaagcctaccttaatcctctcgctcgcaaataccaaatctgcgaaactagagggcatattggtcgagcctgcctaatcctgatcaagcatcgtccttggattcctcttgttggactaaactcgaccagagctgcattaagacaaacatacaaacaactaggttaccataccccgatccctcgtgataatacgataaactag

SEQ ID NO: 50479 - DNA, 252 bp, Glycine max
  Peptide Sequence Number=SeqID_142164
atggctagatttcttagtggtttaaatagtgatattcatgatgttgttgagctgcaggaatttgttgaaatggaggatttgcttcacaaaacaatccgagtagagcaacaattgaagaggaaaggtgtggccaaaaggagttccactaattatggttcttctagttggaaggacaagagtaaaggggcttccacctctaatgcagcacctataccatcaaaaactcctccaaaattccaagaacaatcctaa

SEQ ID NO: 50480 - DNA, 129 bp, Glycine max
  Peptide Sequence Number=SeqID_142165
atgggtgccaagtacctcgaagtggtcaaacgaaagttgcatgccaccaaagaatggtccccggacaaaattagggattgttcttggaattttggaggagtttttgatggtataggtgctgcattagag

SEQ ID NO: 50481 - DNA, 105 bp, Glycine max
  Peptide Sequence Number=SeqID_142166
atggccaaccagcaggcgaccaagcccaaagccaaagctcaagacgttaatgaagcgctactaggaggcaacctagtaccttttaaatttctgcttgttatttga

SEQ ID NO: 50482 - DNA, 345 bp, Glycine max
  Peptide Sequence Number=SeqID_142167
atggataacgaagagggagtgcaagaacagatgaaggccgacatgtcggccttaaaagatcagatggcttctatcacggaagccatgctaaagattcaaaaatcaatagaagataatgctacagtggccgcttccaatacagctagggaagccgaaccggtgctacggcccgcaataaacttgggccgaaacagaaacgcgacgggtttcaatcggaggtatagtcctcaagcctacccttatggtttgcctccagacttcagtccccgtaccgctccagacgatttgagccaagcccctaccttcgaggggcagctccctcctggtgccaactatcctcagtag

SEQ ID NO: 50483 - DNA, 376 bp, Glycine max
  Peptide Sequence Number=SeqID_142168
gactaccaaactggaagaaactctagctcaattcatgcaagtgaccatgtccaaccataagagtactgagttagccctaaaaaaccttgagattcatgtgggtcaactggccaagcagttagctgagaagtcatccaacaactttggggaaaataatgagaagaatcccaaagaagagtgtaaagtttttgtaacaagaagcaggaaacttgtggtggctgaggatgatgatgttgttgctttgaaggagcaagttgctttgaaggacactactgttaaaaagaagaataaggtaacagatgcaatgattcagaggagggaaaaacaaataatggtcgaagagaaagaaataaaagaccaagaaagagaaatatag

SEQ ID NO: 50484 - DNA, 454 bp, Glycine max
  Peptide Sequence Number=SeqID_142169
cggcgccgatgcacgctacgagcgcgtcagtagcggacgtaccggtcacgcagaagcggtgaaaatcgactacgacccgcgccaggtcagctacgggcagctgatgcaggtgttcttctcggtagtgcacgacccgacccagctcaaccgccaggggccggaccacggcagccagtaccgatcggcgattttcactgacgacgcacgccagcaggctgccagccgcgcctacattgcccagctcggccagaccggcagctaccgtgcgccgatcgtcacccagctggtcagcggccagcacttctacccggccgagagctaccaccagaactacatgacgaactacccgcaggcggcctacatccgctactacgacgcaccgaagctggccgcgctgggcaagcagttcccggcgttgtaccggcgcgatgcggcgctggtgccgatgcgctga

SEQ ID NO: 50485 - DNA, 628 bp, Glycine max
  Peptide Sequence Number=SeqID_142170
aggactacacgtcctcaccttcggaggagtactcatcctcgcctttagaggactacacgtccttacctttagagggctacacgctctcacctttagaggactacacgtcctcgcctttagagggctacatgccctcgccttgccttcagaggactacacgtcctcggctttagagggctacactagtttccttttttcagttcctgggccaccctttgatcttggaggagggccaactgtgcgagcacaacctgaggaggaggctatcacgcagctactatgcatacatgggcaagatttcactcgtgccgctgcaaagagacgacaacattctgcccatgtggaagtatcagttggtctgtgccgtcatgacatagggatcgtgcctataagacacccagtggacctagaggagtccaacaagaccctggggtttccagctctggttacgggcctctgtcagtcctacaggatgcttgtcccccccagcaaggttatgcctagtgacatagggatcgcgcccgcaagacacccagtggacctggagaagtccaacagggtcctggggtttccagctctgattatggacctttttcagttctacagagtgcccgtcgcccccagcaaa

SEQ ID NO: 50486 - DNA, 960 bp, Glycine max
  Peptide Sequence Number=SeqID_142171
atggggataaatcaaaacggcaaatggttttatcaagtcaaggttaaaggtctagatgtcactagcctcaaggaattgggacgattaatgggacccctccaaaggcaagccttccgcaaagtgtacgggaagattctagatttggccgcagcggaggtatttacggaagctgtcgtatccctcgcccaatactatgaccagccgttgaggtgtttcacgtttggggacttccaaatggtaccaactattgaagagtttgaggagatattaggatgccctcttggggggagaaaaccgtatcttttctccggctttcttccttccttgagcaagattgcagctgtgattggagattcagcaaaagagttggatcgcatgaagcaaattcggaacggcgtagtaggcttgcctcggaaatacttggaaggcatggcaagggatatggcgagccaagagaagtggggcccgtttgcggatattttagctttgctgatttttggggttgtcctctttccgaacgttgacggtttggtagacttagccgccattgatgctttcctcgcatatcaccatagcaaggagagtccagtggtggctatcttggcagatttgtttgacacctttgactggaggtggactaggggttgtattaattataatcccgcactcgccataagaaagctagggtatcccatgaggggagcgccaaccgaagaaagtctctcgcctttccttgtgagggatctaggcgcgcaaggtctcaaggttatacaaagaatccacaaggcgtggaggagtccattgaagaaagacaaggagcttaggggcatccgaaatggcgtaatcggaggttatcatggatggctaagaattcttgcgcaagggttagattggctctccaaattgaaagttatcaatgaggagaacttcgaagctccggtagaagaagaagaagtctga

SEQ ID NO: 50487 - DNA, 707 bp, Glycine max
  Peptide Sequence Number=SeqID_142172
gacacgctttacggtgcccttaccgaactcgtgctagagctagagtaatgggtgaagcagaggaggtgcaagagaagatgaaggccgaaatggaggccgtgaaagagcaaatggccacaatgatggaggccatgatgagcatgaagaagataatggaagccaatgcggttatagttgccgctactagcgctgtcgctaaggaagtacggatgagcggaggatgtgcaaattcaaaacaagcacgccttcccgccatatggcttgcctcccaaactatacaccacccaatgtggcgtacattctcaatgaaaatctcaataactccactctcatactcattaagagccaacaacctcaatctgatcatgcacatgtctctcaacccatggaggagacacatggaattgccccaccacaatctagccgacttcgagccttgcctcggatatgccactgaagggcaagcagttggtggtatacccctgcaaaacactttggagggccctcagtatcacccacaaccacaaccctcacattccacagtggttaaaaaccctcatgctatggcagaaatgggaaagaggaaaggctcagggctattgaaggaggtgctggactttgacaagtacaaggggactactttccccaagaaccatccaaagatgtattgtcggaagataagggcatacgcaaagatgaggaattga

SEQ ID NO: 50488 - DNA, 237 bp, Glycine max
  Peptide Sequence Number=SeqID_142173
gcatttgctggttgtggaaagagcagtgcagaatgagttctggatgtttgctagtagatcccaacggggatggtgggtttatgcgcgcattgtggatgtggaaaacttgttgtgcaccatcgcccgaccgccacctagtaccacatgtgatggggtgaaacttcctgcttttattgttgaccacagagtggtacctggagatatgtcgcgggggtcaggagaccttggggacgtcag

SEQ ID NO: 50489 - DNA, 678 bp, Glycine max
  Peptide Sequence Number=SeqID_142174
cttggctaccccatgagaggagtgccatcagatgaaagcatcacgcctttcatcgcacggggtttcagggaggacaacgcgagggacagagagcttaggggaagccgtaatgggatcatcggcggctatcataagtggctgagagtccgaacacaaggattggattggctcccaaatctaaagactgtgagagacgatgaggttaaagctttggaagaaagtgatgaggtacaagccctaaaggcagagcttgaaagagcccgggctgaagccttggaacgagaaaccaagaaggcccgaaaggaagaacacgaccaagcaagttttgaggggctttatagggcagcaatagtgagctcaagatccgaagaggtgaaaggaatcatcacgggtcaaggcatgatcttgaaggacgagctaaaggtttgccttaggtcgaaaagaaatttgtcccaacagttaagcgagactgaagggaatatgtgggccatcatcgatgagtgcaaagagaagctaaatctagcggcgactcacgagcaaaggctagaggatgagtacgccaagatatcagcagaaagggaagcaagggaaagggtaattgattcattgcaccaagaggcaacaatgaggatggaccgatttgctcttactttgaacaggagtcaagaacttccctga

SEQ ID NO: 50490 - DNA, 183 bp, Glycine max
  Peptide Sequence Number=SeqID_142175
atgatgcaatcctaccccgcaaaggcattggatagaagactccaagaagattgggccagagatgcaagagaagaccctagggttctcattagccttagggtagatttcgggcccatcgggaaagtaaggtaccctagaaatgtaggatttttcagcccttgtattttagggcacctagactag

SEQ ID NO: 50491 - DNA, 435 bp, Glycine max
  Peptide Sequence Number=SeqID_142176
atgtaccctcccttgttctctttgaacctagtggatgtaccctccactagaattgatccacaagagatgtaccctctcttgttctcagtcaaacccaaggaaagggaagaatcaaaagaattctcagactgtgtcgttttgaattctttgacaagggagaagggatacacaaaagaattcaggcggttagtcctttgttcttttggaaaagggagaagagagacacaaaaagaattcaggcggttagtccttggcgaattctttttggcggagggagaagagaatggaaagatgaatagcacaagttttcaaggtttagaaaaccagaaaactttagaaagcttttggtacaaagaagaagaagaagttcaaagagattcaaggcttgtaaaggattgtaagagattgattggaaaagtattcaagatcatttga

SEQ ID NO: 50492 - DNA, 240 bp, Glycine max
  Peptide Sequence Number=SeqID_142177
atgacatggatatggcatggtgaattgatagacatgcagagggactcccaatctgaaccggttgatgtacaaatgggagatcgcttagaggaaatgattcatgatcttggacatgaatcttttcatctggttaatgtcaaggccaaatatgggtggagtgacaaaagcttcacttcacttcttcaggtggtgcaggatatgcttctagaggaaaacactttgccaaaaagttactgttag

SEQ ID NO: 50493 - DNA, 138 bp, Glycine max
  Peptide Sequence Number=SeqID_142178
atgtatttgatccttgagcttatctcttccaattcatccgatacaccatctagagagagaaagagagagaacttgaaagaaccaaaacaaggcaactctttcatgacaatggctggagtttgtaacatcacagattaa

SEQ ID NO: 50494 - DNA, 137 bp, Glycine max
  Peptide Sequence Number=SeqID_142179
atggctctgaaaaagctttccatgaagaggtctaggagagacgccgcggctaaagggaccaatgccgcccccgagtttgatagccaccgtttccggagcgccgagcaccagcagcgcttcgaggccatcaaaggatg

SEQ ID NO: 50495 - DNA, 174 bp, Glycine max
  Peptide Sequence Number=SeqID_142180
atgagagttgtgttgatccctcagggaacaatcccgacactgacacttaacaccttccttgcttggtcgacacatctgtcgcaacctacccttcggcgggagggcgacgcgagactcgcgggtgcgtcttccaaggaaggaaaacacgcagagtcgccaccaacatttatttga

SEQ ID NO: 50496 - DNA, 498 bp, Glycine max
  Peptide Sequence Number=SeqID_142181
atgatggatcaaggtcgactggaagtcggcaatgagggaagggaagagcagcatatatgtatgcagtccacggatgagagaagtttcggaaggcctaaacctttggtgatatacttcaccaagggcgcagcttcacaaaagccccaatacccctcggcagctaaacctgtccctttcccataccaaaacagtcatgcagtcccatggaggtacacacctccgaacaaaagggaagaagaagccaccgacatcatttcgttatcggccaaggtaaccaatatcacggggctgagcggtgtgacccgcagcggtcgcgtgtttgcgctccccaacctaccaattcaacccgcgaacgttaaggggaatgatgcaagctccattggagcttgtaggcctaggatcttcttcatcaatggattcctttgcttcttggaagataaatggcagcggaatggagaaggaagagagagaggagacgccacttcaaggagaagatga

SEQ ID NO: 50497 - DNA, 341 bp, Glycine max
  Peptide Sequence Number=SeqID_142182
atgggttttcgcttacctggcatcaggaagacatcaattgctgcaaaccaagcatcttccaaatctgtggaggtgccaaagggctaccttgtagtctatgttggagacaaaatgaggcggtttcttatccccgtatcatacttgaaccaaccatcctttcaagatttgttgaatcaagctgaggaagaattcgggtatgaccatccaatgggcggtctcacaataccatgcaaggaggatgagttcctaaccgtcacctctcacttgaatgacctggatttctattttctactgaagttgaaacctgtttccttaatgagaattaatgcagcacaggacac

SEQ ID NO: 50498 - DNA, 63 bp, Glycine max
  Peptide Sequence Number=SeqID_142183
atgaactcgctaagcaagaatgttgtgctaagcaagttcatcaatactcattggcgcacttag

SEQ ID NO: 50499 - DNA, 72 bp, Glycine max
  Peptide Sequence Number=SeqID_142184
atggtcgtgcggatgagggcacacacggcctacctacgtcaaatcacaaagcaaacggagaagaatgcaatg

SEQ ID NO: 50500 - DNA, 636 bp, Glycine max
  Peptide Sequence Number=SeqID_142185
atgtcagttctagaattgtacgtagaaaaggatgttgctggtggttctatgtttcattctacaaactctgttacatcatgtggacataatctatctcttaatgagtcggaactgccaagaaatataagcaatttacatgatgatgaagatgatgatgatgattatcttgcgtctaactcatacgttgaagagtctttgaatgaagatgatagtgttgatggaatatttgatacagacgatgaagtcaccgacatcattgaaccagtttcaattgttcacccaacagaaggtgcacaaggaattcaaaatccattttggaatgatgctttgcattataacaatatcaattggagtcatccggaagaggacatttgcggtttggagatgccatcgacttttaatgttggacaagaattatatgttggcatggattttgacagtaaagatgtggtaaaaaatgcactgaaacaatatgtgatgaaggtgcatcaaagttttaaggttgttgaaaccaaatcgcacaaatatatcgtttgttgccccaacaacagcgcagagtctccttgccctttttatatgagggaaattttatctaaaaaaattgatgcatggaaagtgacacaatggggtgtgtga

SEQ ID NO: 50501 - DNA, 282 bp, Glycine max
  Peptide Sequence Number=SeqID_142186
atgaattcaaaaagaaagggggagaaagagatgagtgaatggattgtcatcatcaaaaagggggagattgtggaagcaatgacttccaagattattttgacgatgccaaagaatcaagagtttagcaagtttcaaagaatcaagattcaagaacaatcaagtttcaagattcaatcaagtttcaagaatcaagattcaagaacaatcaagatcaagattcaagaatcaagagaagactcaatcaagataagtactaaaaaagtttttcaaaacattgagtag

SEQ ID NO: 50502 - DNA, 579 bp, Glycine max
  Peptide Sequence Number=SeqID_142187
atgatacgcggggataccttacggttatccgcacccctttgctatttagacacagttgttgtccgatggcacgcagagaccaagtttggtcattctgcacacatgatacgcggggataccttacggttatccgcacccctttgctatttagacacagttgttgtccgatggcacgcagagaccaagtttggtcattctgcacacatgatacgcggggataccttacggttatccgcacccctttgctatttagacacagttgttgtccgatggcacgcagagaccaagtttggtcattctgcacacatgatacgcggggataccttacggttatccgcacccctttgctatttagacacagttgttgtccgatggcacgcagagaccaagtttggtcattctgcacacatgatacgcggggataccttacggttatccgcacccctttgctatttagacacagttgttgtccgatggcacgcagagaccaagtttggtcattctgcacccatgatacgcggagataccttatggttattcgcacccattcttttgctatctgtaagacagaacgcttga

SEQ ID NO: 50503 - DNA, 156 bp, Glycine max
  Peptide Sequence Number=SeqID_142188
atgttcctcgtattcaacagtgctttgaaaggacttgatgatactccgcaacctaaatccaaggctgttgctaggtggattgttgttaagaccattggtagcagagagattgaaggcgcttcacatccagtgggcacagtattatctaaaagttag

SEQ ID NO: 50504 - DNA, 1068 bp, Glycine max
  Peptide Sequence Number=SeqID_142189
atgggatcaagtcaaatgccttcgcttaaaaagagattctatcaagtcaaggtcaagagcctagggatcactagtctaaaagaattagggcagttgatgggtcagctccagcggcaagcttttcgcaaagcttacggtaaaatctgggacctagccatgatagaagtctctacagaggccattgcatccctcgcccagtattatgatcagccgttgaggtgcttcacctttggggacttccagctatcacccatggtggaagaatttgaagagatcctaggatgccctataggggggaggaaaccatacctcttcacagggttctatccctcattagctagaatttccaagatagtccaaatctcggcgcaggaattagaccacaggaagcaagtcgaaaatggggtggtcggaataccgagaaaatatttggaggaaagcccggttgtcgctatgctagccgatctatacgacaccttcgaccgaagatgtgaaaagagcaatacaaggattgtttgctgtaccccagctctttatgtatggttagtttcgcacctttttcgccaagaagtgaggcatgcttgcccattagaaagccaccgttcatgcacagagaaaggaagggcgaattgggatcaactcttagcaagcaaagaaggagcatctgtcaactggttccctcgatggaaggaaggaagaaccggagttcttatctcgtgcggaggatttctgaatgttcccttgatggggacaaggggttgcatcaattacaatcccgttcttgcgataaggcaacttggctacccgatgaaaggggcaccactagaggaagagctcgcacctgtcatttcacgaggcttcaataagaccaacatggagacacttcagaaggtctgcaaggcatgggaggtggtacaaaagaaggacaacgagctcagaggcagtgggcccattggtggctaccgtgagtggttgaaagcccacgtgcaaggtttggattggctcccaagtttgagaaccgctaaaagggaggaagttgaggcagcggaggaagacgaagaggtgtag

SEQ ID NO: 50505 - DNA, 243 bp, Glycine max
  Peptide Sequence Number=SeqID_142190
atgccagtgtcggccgaaacacaacttcggttgagcttgcacgaaaaaactgagccgacctacattacttatcaaggtaatccttgtggcgtctacccagacttatcttccttcattggaagtggcgtctacccagacttatcttccttaaccggaagtggcgtctacccagacttatcttccttcactggaagtggcgtcatccaaaccttcgtagcctgtatcaaacgatccgccccgtaa

SEQ ID NO: 50506 - DNA, 154 bp, Glycine max
  Peptide Sequence Number=SeqID_142191
atggtgaaagttggaacctcttacgtgccgatcaacgtctcattttcgccaaaagttggcccagggcttcccggtatcaacagggacaccaggatttatttattctgcgaagtgatcttccgtcacaggtattattcggcgcaaagtgcgtcgg

SEQ ID NO: 50507 - DNA, 429 bp, Glycine max
  Peptide Sequence Number=SeqID_142192
atggatatgaatcttggatctttcatttctagtcagattacactcatggcccagcacgactccttgaggctcgactttcttgccctaatcactgctttatgtaaaacccaaggagtccactctgattccttgacccatgagagattaagtcctgccattaatttggcatatattaagaaaaaatgctggaacctagatgatctctcagtaactttcagagggtcgcacaaggccaaagggaagagcgcaatggagaaggagaaagatgattggagatgtcactacaaggagaagatgagtctagaagaagctcaccaccataggaggccatggataagagcttggaggaagaagaagatgaatgaagggagaggaagagaaaagcacgaaattttgtgctttaaaagaactctgaaatttgaagtttaa

SEQ ID NO: 50508 - DNA, 312 bp, Glycine max
  Peptide Sequence Number=SeqID_142193
atgaaacaaaaaggaaaaagaaagaaagaccgcgaaggtcgacatgttatagttaagaagtataaatcattcgtaaaaagcaaacgtatcttctggaaacaaaggactgatgctaagagtttattttccggaataaccgagataagaatggatgaattcattgaactgatgaaagaacataacttggaaacgttggtcatgcgtgccttatggagtgatatgggagtttggcccgagaccgacaccttgacacccaaatttgttttgccccagatatcaagattgggttcccacgataaaagaccccattga

SEQ ID NO: 50509 - DNA, 358 bp, Glycine max
  Peptide Sequence Number=SeqID_142194
gcatcattttgtaccttttgatcatcctgagcattccattactggtgagtctgtgcattctgttattggtgattttgaacatcctgattttgagcattataattttgagcattctgagaacatggcacaacctccaccccgtgagaggactctaagggaaatggctgcacctgatttcacctacgaaagcttgtgcatccaataccctgatgaggatgtcccatatgttcttaaaactggactgatccatttgcttccaaagtttcatggccttgcaggcttttcctcattctttagagggagtaccaaaggactgactgtattaccttgctccaaggtccatcacgagctgggatga

SEQ ID NO: 50510 - DNA, 213 bp, Glycine max
  Peptide Sequence Number=SeqID_142195
atgtctagtagccaatcagaaaactgtttgagttcatggattgcaaccgcatgcactagtatagcaaacttagaatgtgttgttctacctccaggcaacaataatgaagcaatcccactggaagccactgttaaaacaatgcctccattggatcgtacaacagatgataaagttttccacataaaggtcttgccggtcccaccatatccatag

SEQ ID NO: 50511 - DNA, 374 bp, Glycine max
  Peptide Sequence Number=SeqID_142196
atgaaggagccttggatttaaggacaaatccttttcaagaaggagggagtgatgaggacacaactaagggcaagaaccatgaagcacttgaagggcccattaccagaggcatacttaaaagggctcaacacagtgatgaggacacaactaagggcaaggatcatgaagcacttgaagggcccatgaccaaagcttttctcagggttcctgttgaaccaaattctgacttatcaaggttgattccttatggcgtcaccgtgacttatcttccatctctggaagtggcgtccctctccatcaacaatccagtatcaaacgttgcgcctcgtaagattcacgtcaccctcaaagagattggaaggaataacacctga

SEQ ID NO: 50512 - DNA, 749 bp, Glycine max
  Peptide Sequence Number=SeqID_142197
gaagacatatactgcctgagaggaaggtagaaatacaccatactgaactgaacgagtttaaggatgaattggagaggcgtaacttccataaacgcctcaccaatttagttggcagcaacatagatttagctttggtgaaggagttttatgccaacctttacagctccgaaggaccttcaccaaagcaagtcagggtcagaggccacgtggtgaagattaatgcagacaacctcaacacctttatggagacacctgtggtactagctgagggccaccctgggaagattctcaggaaagatttaacaactcttgctcagatggacatgaatttgggagccctcatctctggtcagattacatctatggcccagtctaactcttctagacttgggttccttgctcttatcatcgctttatgtaagtccagaggggttacttctgacagtctggtcttcgaacgcctgagctcggtcattaacttggcctatatcaagaaaaattgttggaaccctgatgatcggaccgttactatcagaggggccagtagagcgaggacaaggccagctgaggccccttccacatctacagctcctcctccagcacgtaccccagcagctccttctgccacagctcctgcagattttcagcgtcttgaagccatgcttcaaagcatccatcaggggcaaattatcttattacaaaggacccaaccttctcttcacagggaagatgaaggtcccatagcccag

SEQ ID NO: 50513 - DNA, 933 bp, Glycine max
  Peptide Sequence Number=SeqID_142198
atggccaagtttgatccagaaatagtccttgagttttatgccaatgcttggccaacagaggagggcgtgcgtgacatgagatcctgggttaggggtcagtggatcccgtttgatgccgacgctatcagccagctcctgggatatccgatggtgttggaagaaggccaggaatgcgagtatggccagaggaggaaccggtctgatgggttcgatgaggaggccatcgcccagctgttatgtataccggggcaggattttgcccggactgctacagggaggcgagtgcgaatcatgcacactaacatgaccactctgacccaaatatggatgacgttgctcctcagcaacatcctgcccagcgatcataattctgacctccccctgccgaagtgtatggcgcctaccaggcatcctttggatccagataagtccaacagggccctgggatttcccgcactaatcacaggactctgccagtcattcggagtccccgttgcacctaccaaggtaattcggccgcccatcacccgggcttttattgagaagtactgtacccagagacaggctcagggtgatgctccacaggccgcaggcgcgccaccaccacctcatcaggctggccaggctggggcatttgatatggagcagtatttacggcatttggttcgccagcaggcggccaaccaccgagcacatgtacagacccatgattgtctgtaccagatgagccttagcatgcagagccagggcttcgcttctttttcatgccctactctagaccagttcagggcagaggttgcatggcccagagattggcccgaggcccaagcaggagaggcacccccagaagctcccagcgatggagaagaggcccacgaggacgaggagatggccgatttgcttgacttcttgggagggagtggagatacgtga

SEQ ID NO: 50514 - DNA, 483 bp, Glycine max
  Peptide Sequence Number=SeqID_142199
aatgtgttgatgcaattcatggaaacatctgaagctaatcaacacacaattcaaaatctggaaattcaagttggtaagctagcaaaagaagtggctaaattaccctttttgaccacaagggaagaaaactttgtaaaggttgaagctcatgaggaaagtcttgtagaagagcatgattcaagagaaaaagatgtagaaaaaagtgaggagagaacacaacaacaactggagaagtgctcacaagtagaaattcaacaagaaagtattctccaagtcaatactccttctcatcaactgattggcaaggaagaaaggcatggagaacatgatatatctttaagtgtcattctctccttgatcaccagcacttctcttgcaatgatatggaaggcattttcgagatacataagtttcatggagtttctaactaagaggcaaaagtgcaaggaagatatgttctatgtgaccttcatgccaccttga

SEQ ID NO: 50515 - DNA, 461 bp, Glycine max
  Peptide Sequence Number=SeqID_142200
gttttgattttatggtaaactttgtgaagtcaagcaagttggagacccagcatgatattcacaaaatttactcacactttattgaaacactaccaaacaagtcggagacccagcatggagtgcgtgcaacattgagggattatttatttgagaatgttaccatttttagaaaagactttagttttgtgataatctttgtgaactcaagtaagtcggagacccagcatgtcattcacaaaatttactcacacgttattgaaacaccaccaaagacaatacaaaaatacaataaaataaagaattattcactagcggcgcggccaaaggggaaccaccacagagggtggcgcgctgcccccgacatcgctagtactaggcccgacaatacaagaccaccacaggggcaacaacggcgtgacggtggcagaggttttgcggtggtacaaacaaaaaagagataa

SEQ ID NO: 50516 - DNA, 255 bp, Glycine max
  Peptide Sequence Number=SeqID_142201
caaaagaaagtttatacggataaccactcgggtatttccgcccgtcagcgtgactcaaatgtcagtatgacagatcttgtgagcgcggaagatgaccaaaagaaagtttatacggataaccactcgggtattttcgcccgtcaacgtgactcaaatgtcagtatgacagatcttgtgagggtggccgacaaaagcaaggctcttgctcctacgtatcctcaaatgaggaactcaaacctacgtagttctggataa

SEQ ID NO: 50517 - DNA, 401 bp, Glycine max
  Peptide Sequence Number=SeqID_142202
agccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggaccgggaaggacgcacctctggtgtgccagttatcgtgcccacggtaaacgctggagcctccggtagcacagccgagacagcgatgggttctctgccccagcggggatggagcgaaagaagttttgagaattcaagagag

SEQ ID NO: 50518 - DNA, 871 bp, Glycine max
  Peptide Sequence Number=SeqID_142203
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgacacgcgctggacaccggctgaaaccgatgtccagcgaggccgcgccttgctgctggaagccttcaaccagccggacaacctgccgcctgccgagttcgccaagctggcggacaagtcgcgccagcaaatctatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50519 - DNA, 330 bp, Glycine max
  Peptide Sequence Number=SeqID_142204
ggacgataaaacgtgcagaagatgattttagtctctgggcgtataatgggctcatttgcccctggttgacgaaaggtgcgggtaaccataatgtaaccccaggtcacctgacttccaccggtaaccccgcatgtcacctgacttcacgggtcaagatgacaaaaggtgcagaagacgatgttggtctccgcgcgtcaaccggctcgtttgcccctggtaaccccgcatgtcatcctgacttcacgggtcaggacgatcaaaaggtgcagaagacgatgtttagtctccgggcgtccaaacgggctcgtttgccccttgagttgacgaaag

SEQ ID NO: 50520 - DNA, 354 bp, Glycine max
  Peptide Sequence Number=SeqID_142205
atggtggaagcctctggtaatcgattaccagactgtgtaatcgattacacagaggaatgggtcactggtaatcgattacctgagatgaaaagccttaagatacccttttacttgcatgtagtgatcgtgatggcggcgcagctaatccgtgatcgagtagagatggagtgcctagagggagcttgggagaccctcgaaggcaacacgaggtgccgattttggggcaccattcgattcacggctacttctttggtgcatccagatgaacatgcacggacgcttcagcgcacggtggagtggatactacccacgcctacaccatatcgtctagtggagcccgtccaagtgatcgag

SEQ ID NO: 50521 - DNA, 435 bp, Glycine max
  Peptide Sequence Number=SeqID_142206
atggggacaaatcaaaacggcaaaaggttttatcaagtcaaggttaaggagtttgaggagatattaggatgccctcttgggggaaggaaaccgtatcttttctccgagtttcttccctccttgagtaagattgcagctgtggtcggagattcggcaaaagagttggatcgcatgaagcaaactcggaacgacgtagtgggcctgccacggaaatacttggaaggcaaggcaagggatatggcaagccaagagaagtgggtcccgtttgcagatatactagctttgctggtctttggggttgtcctctttccgaacatagacagtttggtggacctagccgcaattgatgctttccttgcatatcaccatagcaaggagagtctagtggtggctatcttggcggacttatttgatacctttgaccgaaggtgctag

SEQ ID NO: 50522 - DNA, 222 bp, Glycine max
  Peptide Sequence Number=SeqID_142207
atgagtctcagcctgcagagccagggctttacttctttttcgtgccctactccagaccagttcagggcagaggtcgcatggcctggagattggcctgaggcccaggcaggagaggaaccagcaggggcacccgcagaggctcccgacgaggcagatgaggcccgcgaggatgaagagatgactgatttacttgatttcttaggagggagcggtgccacatga

SEQ ID NO: 50523 - DNA, 294 bp, Glycine max
  Peptide Sequence Number=SeqID_142208
gtgctccagtggcttctgtttctatcagctgtccctccctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagaattcgatcaatcagtgttattaaacttggctcagcccggctggttgaatcggaaaccagaccctaagcagagctga

SEQ ID NO: 50524 - DNA, 291 bp, Glycine max
  Peptide Sequence Number=SeqID_142209
atgtgggccatcattgaccaatacaaggagaagctaagtctagcagcaacccatgaacaaaggctagaggacgagtatgcaaaggtgtcagtcttgcaagcagaaagggaagcgagagaaagagtaattgattcattacacagagaagcaatgatatggatgcataggttcattttcaccttgaatggaagtcaagagcttccaagattgctagccaaagctaaggcaatggcggacgtgtactcggccccgaggaagttcatgggctccttgattattgtcagcacatga

SEQ ID NO: 50525 - DNA, 210 bp, Glycine max
  Peptide Sequence Number=SeqID_142210
atgcaaaaggtgattaaggattggtctttcctcaaagaaagacgggcccagctagcagagggagagtatgcgaaattccaagccgaagttgccaggaggcgttggacacagctgacaaagcctatggcgaagtatgatcccgaagtagtcatggagttttacgcaaacgcctggcccactgaagaaggagtcatggacaagtgcttctgg

SEQ ID NO: 50526 - DNA, 567 bp, Glycine max
  Peptide Sequence Number=SeqID_142211
aaatgtcctgaattgaagttattctcccatgggagcaaggtgcagaaatttggtaggtctgctcctgaaattgagggcctagttgctgccacgagactaagtcctttgatttcgtgttcaatagatactggcaatcggggacttatatccacattcgtggagaggtggcacaaggaaactagcagtttccatcttcttgtgggggaggttagcatcaccctggatgatttggcatctctgcttcatcttcctactgttggcgccttccataccttcgagcctctgcatgtcgacgaggtcgtgttgatgttggttgagttactagaggtctacggagaggcagccagggatgagacagcacagtgtcatggaccatacatacacctatcttggctacgagatatatatcagagtagatgtcaagctagacattggaatcctgcagctcgtgcctatgttcttcatcttttaggttgcactctttttgctaacaagagtgcaacccatgttcatgttgtcttcttagacgctctacgtgacttgagtcagagtgggagctatgcatag

SEQ ID NO: 50527 - DNA, 205 bp, Glycine max
  Peptide Sequence Number=SeqID_142212
atgcttgatctggatcagcttatcgataccgtgcgcctcgagctgttccctcctgttcagctactgacggggaatggtgatccgtccaattcggcacacaagcataccagccggagcatcagcgctggcaatcggaacgctgtcgtgccattcgctgcattcaaggctgaatcgccaactgttgcgcgaagggcgatcggtgcgg

SEQ ID NO: 50528 - DNA, 162 bp, Glycine max
  Peptide Sequence Number=SeqID_142213
atggctaccattgaatatcaagtagatatgggatcaagtttagcatatgacaacggaatttgggggatggcctttgtggataactgggtggtgggtaaggaggaggtttgttattggctgagtaatgacattgttgggttggtgggaaacttggccgtatag

SEQ ID NO: 50529 - DNA, 582 bp, Glycine max
  Peptide Sequence Number=SeqID_142214
atggccccgaggaagcttgcctcaaagaggtccaggaaggacaaggcggccgaaggaactagttccgctccggagtacgacagtcaccgctttaggagcgctgtacaccagcagcgctttcaaagggcatcaaggggatggtcgtttctccgggagcgacgcgtccagctcaaggacaacgagtatactgatttccaggaggaaataagggcgccggcggtggcatcactggttactcccatggccaagttcgatccagaaatagtccttgagttttatgccaatgcttggccaacagaggagggcgtgcgtgacatgagatcctgggtaaggggtatggcgcctaccaggcaccctttggatccagataagtccaacagggccctgggatttcccgcactgatcacaggactctgccagtcgttcggagtccccgtagcacctaccaaggtgattcggtcgcccatcacccgagcttttattgagaagtactgtacccagagacaggctcagggtgatgctccacaggccgcaggcgcgccaccaccacctcatcaggctggccaggctgggggcatttga

SEQ ID NO: 50530 - DNA, 416 bp, Glycine max
  Peptide Sequence Number=SeqID_142215
atgtcaccagaacccccaattggttttctatacgatgtcattggggggcgtgaggaaggcgttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50531 - DNA, 237 bp, Glycine max
  Peptide Sequence Number=SeqID_142216
atgacttccaagattattttgatgctgccaaagaatcaagagttaagcaagttccaaagaatcaggagtcaaaaagcttcaagaatcaagcttcaagaatcaagtttcaaagaatcaagattcaagaacaatcaagtttcacgaatcaagattcaagaacaatcaagatcaagattcaagactcaagattcaagaatcaagagaagtactaaacttttttttcaaaacattgagtag

SEQ ID NO: 50532 - DNA, 334 bp, Glycine max
  Peptide Sequence Number=SeqID_142217
gatacgtaggagcaaaagcctcgcttttgtcgaccgcaccgctttctgttaccatgacccaagagctgaggccaatatggtcatctgcgccctttccggagatgtaggcatcttctggtggagactttttcaagtctcgcaagttatccagaactacgtaggtcatgtgacatgcacccttgtgtcatccagaggcggcgggcccgatgatacgcagagataccttacggttatccgcacccttttgtcatccagaggcggcgggcccgatgacaagcagagaacaaatttggtcattctgcacccttgtgtcatccagaggcggcgggcctga

SEQ ID NO: 50533 - DNA, 477 bp, Glycine max
  Peptide Sequence Number=SeqID_142218
atgactccctacagcataggagctgcagccggatttgcagcaatgccagatgaaataagggatgtgattgaagagcagttctcgattgcccggcgcgcaaagtctgatgaagagtgcatggcctgcgtaaaaaatctcagggcagagaccgaaaatcttgcagagcaggggcaaatgctgcgcatgaatactgcgaaactttacgccaaagtggagttcgtccgggaaaataacaaaattgtcggttatgtgatttctgctgttcatattgtggtatcaggtgcagcgctgtttggcggaatgatcatgatgtcgacaatgactcctttgggaatacttgccggggcgatactttttgttgatggtattaatgggatcacaaaagaggccagccatcttcgttatggcgatcaatccaaatcagagggaatattcgcagacagttctatggaggctgctaattaccttgagtgctag

SEQ ID NO: 50534 - DNA, 765 bp, Glycine max
  Peptide Sequence Number=SeqID_142219
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgtcctccacctacagtttcactgtagtcatgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50535 - DNA, 831 bp, Glycine max
  Peptide Sequence Number=SeqID_142220
atggcccggctgcgctcgctcctgtatttcctgttcctggccatcacggtcatcccctatgccttcgcttgcgtgctgtgggcgccgctgccgctgcacctgcgctacaagctcacggtgggctggccgcgcctggccatctggggcgccaaggtgttctgcggcatccactggcaggtcaagggctgggaaaacctgcccgacggcccggcggtgctgctgtccaagcaccagtcggcctgggaaacgctgttcttcccggcctacatgccgcgcgaagtgtgcttcgtctacaagaaggaactgcacatggtgccgttcttcggctggggcctggcgttgctgcgcatgatcgccatcgaccgctccaagggccgcgacgccttcgaacaggtggtcaagcagggacaggtccggctggacgaaggccgctggccgctgctgttcccggaaggcacccgcgtgccgcccggcaagaccgcgcgcttcaagatgggcggcgcgttgctggcctcgcgcaccggcgcggtggtcatcccggtggcgcacaacgccggcgaatgctggcgccgcaatgccttcgtcaaatatccaggcctggttacgctgtccatcggtcccgcgatagaatcgaagggaatctcccccgaggaactgaaccagaaagtgcaggactggatcgaaggggaaatgcggcgtctcaatgcagaaagactccgacgcgtccacggacgcgtcgccgctgaccgcgtcccccgcggcgcgcccggcacccgtgccacgccgcccgccccgctgttccctccccccgctccatccgggatcgtctag

SEQ ID NO: 50536 - DNA, 515 bp, Glycine max
  Peptide Sequence Number=SeqID_142221
atggcggattgccttgagggtccgcaattaggcaatcatgaaacacagctccaaactggaaagcgaaggacccgggaaccaaaacgcaattcatggagctccggaaaagggggagaatggaggattgccttgagggtccgcagtggagaatggaggattgccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50537 - DNA, 627 bp, Glycine max
  Peptide Sequence Number=SeqID_142222
atgactactccacctgcctcgcctcctcctcctcttcctcctcctcctacagacgcatcagcgtctccatctacgttgaagcggacacgcaaggcgacacgactacgatcattggccactagaccacctggggcagaaagacctctagtcaacgtcgatcctgctaccggcaaggccgacggtccccataagaagaaattaagaacatatttggagattgtcactcgtgataaggttgacgtgacatacgacacctggaaggaagtccctgctgctcagaaggatttgatatgggaggatattcatactgtcagcgagtgctggaggcagtttaaatctgacttgactaggaaatggacacttgcagccgacaaggacggtgtggatgacattgtctgtgaaaaatacggcattagcaaggagaaatgggcccagttttgtcagacccgcagagacccctcgtgggaggatgtgtggaaaaaggcacaggccatccagaagcaaaacactgcccccccccccacgtgttggtctcgtgggggttatgaatatttagaacaaaagctcatggctgagaagacaaagaaaagactggaagaagctgcccagtctggaagcactgagggc

SEQ ID NO: 50538 - DNA, 216 bp, Glycine max
  Peptide Sequence Number=SeqID_142223
atggcttgcagcgtgtccgctctgtgcccctattcaagggacctatatgggagggagctatcaaggattttagtgataattcccaaggtggtcatatctctcttgatggtctctagaggtatcattcccttcgaaggacatattgcagcagtagggactactagcaacaatatgttatcaaagagaaaaaaaactctagatgagggttcattgtaa

SEQ ID NO: 50539 - DNA, 258 bp, Glycine max
  Peptide Sequence Number=SeqID_142224
atgcctttcatccagtgcaatgcccccggtaccttccagcgaaaattgcatagaggtgtttatggatgtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaaggtattag

SEQ ID NO: 50540 - DNA, 252 bp, Glycine max
  Peptide Sequence Number=SeqID_142225
atggattgtcatcatcaaaaagggggagattatggaagcaatgatttcctagattattttgatgatgccaaacaatcaagagttaagaaagttccaaagaatcaggcttcaagaatcaagtctcaaagaatcaagattcaagaacaattaagtttcaagattcaatattcaagaacaatcaagatcaagattcaagaacaatcaaaatcaagattcaagactcaagattcaagattcaagagaagaaattga

SEQ ID NO: 50541 - DNA, 192 bp, Glycine max
  Peptide Sequence Number=SeqID_142226
atggcccagaagaaaagcactccaatcactcctaccacatccagacggagtttcaaagtggaaatctcgtgttcaacggagactttccccttggaaagagaactgggaagagctgccttggattgcaaggagatttacatggacctcaaaggctgctggactgctgaagcactgtcaccaagagattgctag

SEQ ID NO: 50542 - DNA, 438 bp, Glycine max
  Peptide Sequence Number=SeqID_142227
atgcggggcgaggaggacacctgcttaatacactcgggggcagcacatgatgtagaggtatgccctgtggcagaggacttgctacaagggataatggaccaaggctatgacaaggaagtcccatggaagtacgcccctcaaaaacccgacggaaggaaggatgaattcgctgaagatgacctatcctctgccaaagttactaacatctctggcataagccatgtgacctgtagcgggcgaatcttcgtagcaccagactcgttggtatggctcaaggacacgaagggaaaggcgaaggtgggcacgaaagaaaacgataaagcaagcctgattctcgatgaggagatcccggctaggagatttgctaaaggagaggaagacttcggcagaaagaagatatccaacaaaaaggaaaatgagttccttcggatcatctag

SEQ ID NO: 50543 - DNA, 447 bp, Glycine max
  Peptide Sequence Number=SeqID_142228
atggtgattgctcctttagttattgttgcaaacaataatgaagaagcacaacacaataatgagcccatgatacataatgaacctattgtggaagaaccgcaagaactagcattaaggaggtctcaaagagaaaggagaccagctatttcaaatggctatgttgtagaagcaagattcatgatgatgaacaatgcaattttcatgatgtcaaaagcccaagtaattgattcaagattgattcaagacttcaagatcaagcatcaagaatccaatccaaaattcaagattcaggagaagaaatcaagaatccaatccaagattcaagattcaagagaagaaatcaagaagcaacaagtcaagacttcatataggataagtattaaatattttttcaaaaaccaaatagcacagttttgttttacaaaagaattttctcaaattttctaa

SEQ ID NO: 50544 - DNA, 648 bp, Glycine max
  Peptide Sequence Number=SeqID_142229
atggctacctcaccaaaagaaactgcagcttctggttcacccgctgtaccatcatctccgcaccaggaacaaccagagttcaacatccaacccatacaaataattcctggtcaagcttcagtccctgagaaactggttcccagaagacaacagggagtgaagattgctgaaaaccctagccctgcaacaattcctagggaagtagacacggagatggacaagaaaatccgcagtattgtgagtagcattctgaaagatgcttctgtgcctgaagctgatgaagatgtcccaacatcgtccaccccaaatgtttctgtgcctgatgtcaataaagatgttccaacatcctccgctccaaatgctgaagccctcccttcacccagtgaagaggaatcaacagaagaagaggatcaagcctcagaggagactcctgcaccacgggcaccagaacctgctccaggtgacctcattgacctggaagaagtcgaatctgatgaagaacccattgccaacaggttggcacctggcattgcggaaagacttcaaagcagaaagggaaaaaccccccttaagaggtctggacgaatcaagactatggcacaaaagaagagtactccaatcactcctgccacatccagaagaagcaag

SEQ ID NO: 50545 - DNA, 333 bp, Glycine max
  Peptide Sequence Number=SeqID_142230
gaatttaaagatgtctttcccaagaaaatctctcatggactgccaccttcaagaagcatagaccatcaagtgcaaattgcaaagaagaatgaaagttatgtcaagcaagccaacaagaaaaggaaggaagtggtacttgaacccggtgatgatcctggacatttgagggcaaatgttttccaagaaggagggaatgatgagaatcctaaaactgatcaaatacaggctaaaggcccaagtggaaaaggacaaagcccccgagtggagaaggatgaaggcccaaagacagagacactatcaagactattaattgttgctaaaggtccagattaa

SEQ ID NO: 50546 - DNA, 312 bp, Glycine max
  Peptide Sequence Number=SeqID_142231
atgaccggccctctcgatgagtcgatctcttgctttctcataaagaggactacacgtcctcgccaacagagggctacacgccctcaccttggaggactacacgtcctcgccgtcaaagggtcatgtgccttcacctttgtagggctacacgccctcaccttcagaggactacacgtcttcaccttcagagggctgcacgccctcacctcgagaggactacacatccttgccttaaaagggctgcacgccctcacctttagaggactacgtgtcctcactttcagtgggctccatatccccaccttcagataa

SEQ ID NO: 50547 - DNA, 282 bp, Glycine max
  Peptide Sequence Number=SeqID_142232
atggctataaataaaagaagtttaaagaagagaggaatggccaaacttgagtttcatactggttcggccacttcccgcgcctacgtccagtcctcaacaacccactatgagatctttccgactctctttgtaaaactcgcttttacaaagtctgaaccacacatggacaacccttcccttgtgttcaggaatcctctacagacaagagacccacgatctcttagatcccttttcagaaataagaagaagcaaagtctcttcttaaaacaatcttccccatag

SEQ ID NO: 50548 - DNA, 806 bp, Glycine max
  Peptide Sequence Number=SeqID_142233
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50549 - DNA, 713 bp, Glycine max
  Peptide Sequence Number=SeqID_142234
ggcagcagatggatcaagtccgacgtcaagccttccgcaaaacatatgggaagatctgggatttggctatgatagaaattccgttgaagccatcacgtccctcactcaatattatgaccagtcgctaagatgcttcacgtttggggactttcagttggtaccaaccatagaagagtttgaagcaatcttgggatgcccgctaggagggaggaagtcgtatctgttttccggattatacccctccatggcaagagtatcgaaagtggtcaaaatcgcggcccaagaattggaccgagtgaagcaaaacataaatgggttggtagagataccaatgaagcacttagaggggaaggcgaaagctttggcagatcaaggagaatggacttcatttgttgatgttttagcactgtcggtatttgggatcgtgctctttcagaatgttgatgagctagtggatttagcagtgaccggcgcttttcttgcttatcaccacaacaaggaaagcctggtcattgctgttttggatgatgcttatgacactttcgacctaagatgcgaaaagagtagtgctagaatcgtctgttgtacacccgctctttatgtatggctggtctcccacatttttcgtcatgaaagtagacctgtctgtcccctacaaggtcatcgcatgtgtgccgagaaagggaaaacaaattgggaggaacttttggcag

SEQ ID NO: 50550 - DNA, 594 bp, Glycine max
  Peptide Sequence Number=SeqID_142235
atgaatttattgcctagcgcttttcatgtgtcctccaccaacgagtctagagccccgcgaattgattgtctagcgctgttcgccaattctccattctccacttttattcggagccccatgaattcattgccttgcgcggttcatgtgtcctccaccttcgagactggagccccgcgaattgattgcctagcgctgttccccagttctccattctccacttttattcagagccccatgaatttattgcctagcgctgttcatgtgtcctccaccttcgagtctggagccccgcgaattgattgcctagcgctattcgccaattctccattctccacttttattcggagccccatgaattcattggatagtgctgttcatgtgtcctacaccatcgagtctggagcccctcgaattgactgcctagcgctgttcgcgaattctccattctccactttttttcggagccccatgaattcattgcctagcgctgttcgccaattctccattctccacttttattcggagccccatgaattcatagccaagcgctgttcatgcatcctccaccaacgagtcaggaggctcgcgaattga

SEQ ID NO: 50551 - DNA, 261 bp, Glycine max
  Peptide Sequence Number=SeqID_142236
atgacaccggtaaaccgaaaggcaggaacaggagagcgcacgagggagccgccagggggaaacgcctgctttttttcccacaacgcttctgactggaacaccctggcatcgttacccaacatagtaatgcctatacacatccccctttcgccagctggcgtaatagcaaaggcccgcactcatcgcccttcgcgcaacagttggccgattcaccttaatggcgaatggcgacaggttccgactgtgaagcggcgcatgtaa

SEQ ID NO: 50552 - DNA, 910 bp, Glycine max
  Peptide Sequence Number=SeqID_142237
atggcaccggtggcggccacgcttcagataactgcagtgaatcccgcgaagaaccagctcacggcgcatataatccggacaggtgaccgctacgtctttccaccgttgtttgtcacgctgcgtaatgtcagcgatgaggtcgcctggtgtgccggacagcgctggcagatgcagctgcggctacgcgcggtgcacgcccggctcaacgagggcgaatttgatctgcaacgttttgccattgctaaccacagcgcgctgcaggggcgtattgtcagccagcaggctgagtctctgcgctgcagctggcggacgcgttttatcgatcatcacctggcgcgtttcaccgggttaacgcagcccgcaataatacaggcactggcctttggcgtgcgtgatgcgatgaccccggcccagcgagccttgctgcgcgaaaccggtaccgcacacctgatggccatctccggcatgcatatcgcgctggcggccagcgtaggctggctactggcgcgcgtcattcagttagtgttacctgccaggcaaatcggctatctgatgccgctgctgatcagcgggttaacagcggcagcctattgctggatctccggcagtcatccgccggcacagcgcgcgatgctggcgttaacactgtggctggcgacgcgtatatctggctggcagctgagcaactggcaggtagagcttctggctgtcggcgctggccgtggcgatgctgatactgtggtttcagtggtttcctctgccgccacgtttccgtcagccgcgtcgctggctaatgctgcgactgctgcacctgcaattgggcatgatgattctgatggcgccgctgcagatctttctgttccacgggctcagcctgagcgcgctagtggccaacctgctggcggtgccg

SEQ ID NO: 50553 - DNA, 537 bp, Glycine max
  Peptide Sequence Number=SeqID_142238
atgacaactgattcattagaagatataaattctgaatctccacaagcatctgattttaattctttgtctgacgatgaaaattgtgaatccaatagtaatgaacctgcaatcgatactgaaggctattctgacttgggtgatcaggccatggaatgtagacattgcaatgcaaaaatgttgtatgatgaaagaatttcaaaagatagaaatacaacaagtccaaaattcagcttatgttgtggagatgggaaagttgagctttcgttattacaaagtccaccgaaatatcttgaacgacttatgtttgatggtaaaacaagtgatagtaaaaattatcagtgtaacatacagacatacaacatgatttttgcctttaagtctgctggtattaagctagacaaatcaattaatgaaagtagaggacctcctacaattagaattcagggtcaaccatgccatcaaataggcaacttattaccaatgcttggaaagcaaccaaaattttcacaattgtatatctttgatacgcagaatgaa

SEQ ID NO: 50554 - DNA, 453 bp, Glycine max
  Peptide Sequence Number=SeqID_142239
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgccggatgtgtgtctggcaagacatgcaattgtggggcttggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 50555 - DNA, 369 bp, Glycine max
  misc_feature (177)..(177): n is a, c, g, or t
  Peptide Sequence Number=SeqID_142240
atgccgggagcagacaagcccgtcagggcgcgtcagcgggtgttgtcggttgtcggggctggcttaactatgcggcatcagagcagattgttactgagagtgcaccatatgcggtgtgaaataccgcacagatgcgtaaggagaaaataccgcatcaggcgccattcgccattcagnctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccaaacactga

SEQ ID NO: 50556 - DNA, 258 bp, Glycine max
  Peptide Sequence Number=SeqID_142241
atgaatatagggaataacaccaacggcggatgggagtggaagctatcttggaggacgactcttttttatagtgaaattcaaatggcagataatttccttggagaactatcacagcagcagattcagccaaatagggaggataggtgcaactggaagcatgatcaaactggatactactcaacaaaaagcggatatgacttgatatgggaagcacagatgggagctaatcagaatttggaagctcaaaataccaattaa

SEQ ID NO: 50557 - DNA, 426 bp, Glycine max
  Peptide Sequence Number=SeqID_142242
atgaccggccctctcgccatcagaggactgcacatcctcgcctgcagagggctgcacgccctcgcctttagagggctacgcgtcctcattgtcagtgtgcttcatatccatgccttaagagaatataagcaacattctgcccagcgaccacaatgccaatctccccctgcagatgtatcaattggtctgtgccgtcatgacatagggatcgcgcccacaagacacccagtggacccgaagaagtccaacagggccctggggtttccagctttggttacgggcctctgtcagtcctacagggtgcccgttcccccagcgaggtcatgccatcgtgacataggaatcgcacccacaaagacacccagtggacctggaaaagtccaacagggccctagggtttccagctctggttacgggcctctgtag

SEQ ID NO: 50558 - DNA, 183 bp, Glycine max
  Peptide Sequence Number=SeqID_142243
atgactaaagcacgtcaaaagggggtacggaaagtaaatgaaatgaaaataaaagggaggagcttgccacccagcttgcccaggcgagctaggttgcttcctccagaagcaaccgccttctggaggaacatcctggatggcccaagtgggcctggttgctatttgcacccccatttttactaa

SEQ ID NO: 50559 - DNA, 390 bp, Glycine max
  Peptide Sequence Number=SeqID_142244
atgttggtgcgcatgatccatactcgtctctttgcagcggcccgggtgaaatcttgccccggtatgcatagtagctgcgtgatagcctccctctctagttgtgcttgcacagttggtcgctctccaatattagggggtggcccaggaaccgtgcggatgtggagcacactgaaaatgaggacacgtagccctctaaaggtgagggcgtgcagccctctcaaggcgaggatgtgtagtcctctggaggtgagggcatgtagtcctctcaaggtgagggcgtacaaacctctattggcgaggacgtgtagtcctctcaaggtgagggcgtgcagccctctcaaggcgaggatgtgtagtcctctggaggtgagggcgtgtagtcctctcaag

SEQ ID NO: 50560 - DNA, 552 bp, Glycine max
  Peptide Sequence Number=SeqID_142245
atgacgttgctgctcagcaacatccagcccagcgatcataattccgacctccccctgccgaagtgtatggtgccgaccaggcaccctttggacctggataagtccaacagggccctgggatttcccgcattgatcacaggactttgtcagtcattcagagtccccgtcgcatctagcaagagaccggcccagggtaatgcaccacaggccgcagacgcgccgccacctcatcaggctggcccagctgggtcatttgattcggagcagtatttacggcatgtggttcgccagcaggcggccaaccaccgggcgcacgtgcagacccatgactgtctttaccagctgagcctcaacctgcagagccagggttttacttcttttccatgccctactccggatcaattcagggcagaggtcgcatggcccggagattggcctgaggcccaggcaggggaggcacccgtagaggctcccggcgaggcaggtgaggcccgcgaggacgaggaaatgaccgatttgcttgatttcttgggggggagcggagccacatga

SEQ ID NO: 50561 - DNA, 457 bp, Glycine max
  Peptide Sequence Number=SeqID_142246
gtatatcatgaattcaattattacagtgttgtatttcaacggaagagtatatgaagacaatgatggtgtaatatttgaaggcagtaaaaaggcgattcagattaaacgcggaattagtttcaatgctttgaaaaaaaaaattggagataagtcggaactgccaataaatataagcaatttacatgatgatgatgatgattatcttgcatctaactcatacgttgaagagtctttcgatgaagatgatagtgatgatggaatatctgatacagatgatgaagtcactgacatcgttgaaccagtttcaaatgttcacccaaccgaaggtgtaccagaaattgaaaatccattttggaatgatgctatgcattataataatatcaattggagtcatccggacgaggaggacatttgtggtctggacatgccaacgacttttaatgtaggacaagaataa

SEQ ID NO: 50562 - DNA, 366 bp, Glycine max
  Peptide Sequence Number=SeqID_142247
atgcctcctaaggtgtctagttcctccggcagaggaggaagatccagtacaaaaggtaaagaagttctattggctctaccagagccaataaccaaaaaggcaactacaacatcttctgggtcacctacccagactgggtcatcgacccataaaggaaaacttgaagggtcattgacccagacaactaccatcaaatctgagtcatcaactcaggaatctccaaaaccaacaacaagcaaacagactgtggctgactatgcctggtcaatacaaactctcttggcccttagaagatataggcctcaccaaaataccaaaattagcaaaaaagacctgggcagaaatggcctcagaatcagacgatga

SEQ ID NO: 50563 - DNA, 213 bp, Glycine max
  Peptide Sequence Number=SeqID_142248
atgggcccaaactacgaagggccttttgttgtgaagagggctttttcggaggagccctggtgcttaccaacatggatggggcaggatcatcttgagctaccttctggggtagagacaaaactagaacagcagaaaccaatcaaggtacatagggacggatgcaagtggggatggggtcacgaccgaccgatcgttgccccttctctgcgctaa

SEQ ID NO: 50564 - DNA, 294 bp, Glycine max
  Peptide Sequence Number=SeqID_142249
atgtctaaaaaagaagatcaacacaaaaccacggcaatgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaattggcgcctgatgcggtattttctccttacgcatctgtgcggtatttcacaccggatatggtgcactctcagtacaatctgctctga

SEQ ID NO: 50565 - DNA, 414 bp, Glycine max
  Peptide Sequence Number=SeqID_142250
gtgcaaccttcagtggctaagcgcgagaaagaatctagaagaagatgagctgtcaagtgcaccgcttcaggtcatcaagtgcaccgcttcagctcatccgctaagcaaaacaaatcctagaggtgaagaagacatcctcaccacttgtgtttttgcagcctttcattttgttcttctctttgttgtaaaggaggtttctagactatggaaagctaaatcctctgttggatcttccattgggaactggtctgattctaaagtccttgatagtacgtgtcataccctaattttgtccggggatcatttgtttagtggatgcaaccttcgtttgaccgcttcgaggtacttaacacccatcgttaggcaaaccgtgaagtttcgcgacatttcggaactcaagaagagccttgttgc

SEQ ID NO: 50566 - DNA, 556 bp, Glycine max
  Peptide Sequence Number=SeqID_142251
agggctgcacgccctcacctccagaggactacaagtcctcgccttgagagggctacacgccttcaccttgggtactagttaccttcaccttcagaggactagacgtcctcgccttcaaagggtcatgtaccttcaacttcagaggactacacgtcctcgcctgtcaaagggctcatgtgccttcacctttgagaggactacatgccctcaccttcagaggactacacgtcctcaccttgagaggactacacgtcctcaccatcagagggctgcatgccctcacctccagaggactacatgtcctcgccttgagagggctacacgccctcaccttggaggactacacgtcctcaccatcagagggctgcacgccctcacctccagaggactacatgtcctcgccttgagagggctacacgccctcaccttggagggctacacgccctcaccttgggtactagttaccctcaccgttgagaggactacacgtcctcgccttgagaggactacatgtcctcgccttgagagggctacacaccctcaccttgggtactag

SEQ ID NO: 50567 - DNA, 72 bp, Glycine max
  Peptide Sequence Number=SeqID_142252
atgaagaagatcctaggcctacaagctccaatggagcttacatcaagatccaggtcccttgcagtcaactaa

SEQ ID NO: 50568 - DNA, 372 bp, Glycine max
  Peptide Sequence Number=SeqID_142253
atgtccaaatcttgtggatttgggatgaccggccctcttgatgagtcgatctcttgctttctcataagggtggacccttggaggactccatgtcctcaacttgagaggactacatgtcctcgccatcaggggacctcatgtcctcgccttgagagggctgcacgccctcacctccagaggactacatttaccctcaccgttgagaggactacacgtccttgccttgagaggactacacgtcctcaccatcagagggctgcacgccctcaccatcagaggactacatgtcctcgccttgagaggactacacgtcctcaccatcagagggctgcacgccctcaccatcagaggactaaacgtcctcgcccttga

SEQ ID NO: 50569 - DNA, 273 bp, Glycine max
  Peptide Sequence Number=SeqID_142254
atggatccagaagaacaagtcaataagtcaaatcaagatgtgcatgtgtggcgaatgaatggtgtatggggaaaaacagaaatatttttgactattctctcccggattatgagtagaatatttttgggtgattctgtagatggaaatggatatatgtggatgcgtacttccggagtagaagcagcatgtataaaattctccagaattctagcatctctaagaacagataaacagcagctcaaccttcccatatcatatctgttaacgacttag

SEQ ID NO: 50570 - DNA, 521 bp, Glycine max
  Peptide Sequence Number=SeqID_142255
catggtgtgcggtggtgccactcatttgtttccatgttgttgagcggcaccaatccgatagagtgttacgacaatttggaatgcaacaacctattcccgagtgtcctttgcaaccattgaatatccatggcctaacactgaaaggcaaacaagatgaaaattggttccagttattggccccaatgatcagtcaatggaacaatcgacctgagtttagggtcgacgtttatcctcgacaggagggcctattgagttttaactctgactacatggctggagttgcggagacattacagtatatggtgtcaccacaagggaggaacacatggacagctgatgatctcgtgccttatgtggagaagataatgattttatccaaagagcaagaaaagatcactgagcctgtggcacatggtccagtattagagcgtcgatttccaccacaagagttttacatgcttcagtcaagtgttgaaactcggggttttggaagacgaagggaggttgttgaagcagaataa

SEQ ID NO: 50571 - DNA, 378 bp, Glycine max
  Peptide Sequence Number=SeqID_142256
atgggaggggatacttgcgactgccaagtccctccaatgctgagcatactctttaaaggactcgctttcccttttaaccatgttctgcagctgagtccggtcgggagccatatcagagttgtattgatactgcctaaggaaggcggtaataagatccttccaagtacggatgcgggaagcttccagattagtgtaccagatgactgcggccccagccaagctatcttggaagaagtgcatcaacaacttctcatccctggaatacgtccccatcttgcgacaatacattttgagatggttcttaggacaagtcgtccctttgtacctatcgaaatcaggtaccttgaatttcggggggatgacgacgtacaacactaa

SEQ ID NO: 50572 - DNA, 776 bp, Glycine max
  Peptide Sequence Number=SeqID_142257
atggcgcttgacttgaccgttctatcttttaactgctcaagacacaaggggttatcaggacatacagaagaaaggcccacacgtcgggttgacacagagatattaacgtgccacgcaattttacgtcatctagaagactccagaagccacgggaacgaacgggaaggcgaacaggcccgggggcagggcgcccgcccaccccccttgggcgcccgcccaggagttgtggtcaaacacgtccaactttgcggaccaagctccaccgacctaaaggatcaaggaaaaccggagagagaagaggagagcggaggaggagccggatctgtcggatcttcctcaacattgtacttttgcagcaacaggggcttgaccgccggcgacggtgtcttgagtttcgtcggtggtttctaccgccccgtcgatgtggagcattccctagagaaatccggcagttcggacgcttgttgccgtgctcctgcgtcgcgtgggaggaccattggtcgctctacgtacgtctgggcatttggacatattgtcctggcaagcgatgccacggcgttgttcagaccgaacgatagcgctcttcttggggcgaacaacccgtgcgggagtagcgtcgtggaggacgagagcgcgcaaggcgcgccatctcccaacgttgtcgcgcgatcctcgtggcgtcgagccgtcatacccgcggtttcggcgcgcagggctgtcggctcctgcgtcaccacccgcctggcacgaactgccgatcgtgaggaggcaaagga

SEQ ID NO: 50573 - DNA, 835 bp, Glycine max
  Peptide Sequence Number=SeqID_142258
agtcgattgggaccaacatttggctgggatagggggcagcgcgatcaattggtttcctcgttggaaggaaggcaaggaaggagttcttttctcgtgtggggactatcctaatgttccactgatagggactaggggttgtattaattataatcccgcactcgccataagacagctagggtatcccatgaggggagcgccaaccgaagaaagtctctcgcctttccttgtgagggatctaggtgtgcaaggtctcaaggttatacaaagaatccacaaggcgtggagaagtccgttgaggaaagacaaggagcttaggggcatccgaaatggtgtcatcggaggttatcatgaatggctaagaattcacacgcgggggttagattggctctccaaggcaagactcgccaaggagaagttcaagtcagctgctacacacatccggaaggagtgcaccgagttacaagaggaaaacacggccactgcaagagcccttgaacaagaaaccaaaagggcccgcaaggaggaatatggccgagagaaattccgaggagcattgtggggtagcaacaatgagctcaagctccgaagagaggagagagatcggtcacgggtgcatggcatgatcttaaaagaagaattagttgcttgcgcgaggtccaaaaggagtttggctcaacacttggaagccacggagcaaagcatgctagctatcatagggcaatacaaggaagaattgaaccagtccatggcccatgaacaaaagctagtggaggattttgcacaagtgtatgccgaaaaagaagcaagagggagggtgattgatgcgttgcattaa

SEQ ID NO: 50574 - DNA, 213 bp, Glycine max
  Peptide Sequence Number=SeqID_142259
atgacggagagagagatgataatagtgataatggacacatcgtcgatgttctactatgagaaaatggtaggttatatgccttcgagttttgcaaatctagtgtttgtaggcgagagaattgaagcaggagacccgggaggaatgacgagaggaagaaggagggagaacctcattttgtggctgcagttcccgcgtgaccaaaattttcactag

SEQ ID NO: 50575 - DNA, 901 bp, Glycine max
  Peptide Sequence Number=SeqID_142260
gtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcggttgactgaagacccacccttgagcagggacgtaatagctcgactgatcgagcgctcttgcgccgaagtgaacggggctaagcgatctgccgaagctagggaaggaccgcgcgagcagtgctggacgaagcggaagcgagatgtcggcttgagtaacgcaaacgttggggtgagatcatgcctcgaaaacccaagggttcgggctccagttggtcccgagggacggaggaggtctaggttagccgaaagaggttatcggttcaaggacgcaaggtgcccctgctttttcagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctcgcaaagtcgtagaccatgtatgggggctgacgccttgcccagtgccggaag

SEQ ID NO: 50576 - DNA, 387 bp, Glycine max
  Peptide Sequence Number=SeqID_142261
atgaatgttttgagtggtgcaaccctcttttgtaaaatcactcatgcacccaacatcttcatgatttgtgtacatggggactcattaggtagtgatcaaggggttcccatgaaccctaagagaataaaggtcattcctaagtggcccactccaccaactataagaaaaatttggggcttccatgacttaacaaacttttacaaaaggtgttggggaaaaaagcccagagtttcaagaacctcgggatttgacgtcaaatttgatgcaatcctaccactaaatctcaaagctcatttagagcacaaaatttcgtgctcatctctccctctcccttcattcatctccttcttcctccaagctcttatccatggcctcctatggtggtga

SEQ ID NO: 50577 - DNA, 301 bp, Glycine max
  Peptide Sequence Number=SeqID_142262
tttctcaggaacagggcctggaccaggaatcatttgtatgggttggatattgaattcgggttgttcctggtttgatggagttttggtggatgatggagatgatggtacagagggtgaaacaggggatgaggtctcttttggtgaggtagccatggagaagcaaagcttttggagtgtagtgaacgtgctattgacgtttgagcacgttcagatagaagtaattgctataactcctctagcagacaaatgcccagcttgcccctcagtttttcaaactgatttgcatccaatgcctttgtga

SEQ ID NO: 50578 - DNA, 306 bp, Glycine max
  Peptide Sequence Number=SeqID_142263
atgcagctcccggagacggttcacagcttgtctgtaagcggatgccgggagcagacaagcccgtcagggcggcgtcaacgggttttggcgggttgtcggggctggcttaactatgcggcatcagagcagattatgcgtaaggagaaaataccgcatcaggcgccattcgccattcagactgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 50579 - DNA, 510 bp, Glycine max
  Peptide Sequence Number=SeqID_142264
atgaacaacgtcacaaattcatccattgattttaccccactggtcaacgagccgttcgtgctggcctgtcggcgtgaccatccattggccaaaaagcagcttgtagaatggcaggagttagtgggttacaaaatgattggcgtacgctcctccagcggcaaccgactgttgatagaacaacagctggccgacaagccctggaagctggactggttttacgaagtgcgtcatctttcgacgtcattaggactggtggaggcgggactggggatttcggcgcttcctggcctggcaatgcctcatgcgccctattcttcgattattggtatcccattggtggaacccgttatacgtcgaacattgggaataattcgccgtaaagatgccgtactttctccagcagcagaacgcttttttgccttgctgattaatttatggactgacgataaagacaatttgtggaccaatatcgtcgaacgccagagacacgcgttacaggagataggttaa

SEQ ID NO: 50580 - DNA, 537 bp, Glycine max
  Peptide Sequence Number=SeqID_142265
atcgtgatggcgtcgcagctaatccatgatcgagtggagatggagtgcctagagggagcttgggagaccctcgaaggcaacacgaggtgccgatttcggggcacgatccgattcacgactacttcattggtgcatccagatgaacccgcgcgtacgcatcagcgcactgtggagtggatactacccacgcctacaccatatcgtctattggagccagtccaagtgatcgaggtaacgtcgtccgaggaagaccctgaggaggatcttgaggagctacctcctgagcctgttgtggatgctcttgacttcctagagggtgatgaggatccccttcctgaggtggattctcccgaggaagtcacgtcggcatctgaggcagactctacggaggatagtggcctgggagagatggcgatcaaaatgaaaaagaaaaagaagaatcggggaatcatggcttttcgtaagaaccacctgccaaagttcagtggagactatgatccagaaggtgctaggttgtggttagctgagacggaatag

SEQ ID NO: 50581 - DNA, 699 bp, Glycine max
  Peptide Sequence Number=SeqID_142266
atgtctcctttccttgtgagggattttggcgcacaaaatttcaaggctatacaagcaatccataaggcatgggaaaccccgttaaggaaagatcaagaacttaggggcattcgtaatggcatcattggtgggtaccatgaatggctgaaagttcatatacgaggtttagattggctcgccaagttaaaagtcgtcagcgaagagagttttgaagcaccggaagaggacgaagaagtccaagctctcaaaagcgagttaagaaaggcgaaacttgccaaagagaagttcaagttggccgctacacacatccggaaggagtgtgccggattacgggaagagaatgcaactaccacacgagcccttgaacaagagaccaagagggctcgcaaggaagagtatggtcggaacaaattttgtggagctctgtggggtagcaacaatgaactcaagctgcgaagggaagagagggaccaatcgcgagcacatagcatggttttgaaagaggagttagttgcctgttcaaggtccaaaagaagcttgtctcagcgtttatgcgagacggagaccaacatgctagctatcatcgccaagtaccaagaagagttaggtctagccacggcccacgagcataggatcgcggtcgagtatgcccaagtatacgcggaaaaagaggctagaggaagggtgatcgactcttaa

SEQ ID NO: 50582 - DNA, 189 bp, Glycine max
  Peptide Sequence Number=SeqID_142267
atgactaaagcacgtcaaaagggggtacgaaaagaaaatgagagagaagcttgccacccagctcgcccaagcgagctcagctcgcccaggcgagctaggttgcttcctccagaaggcaccaccttctgggggaacttccttgaaggcccaagtgggcgtggttactattttcacccccctgtttactaa

SEQ ID NO: 50583 - DNA, 197 bp, Glycine max
  misc_feature (1)..(1): n is a, c, g, or t
  Peptide Sequence Number=SeqID_142268
naacgcgttcgacaagaaggtacgcccgcgcaagttcaacgagggggacctcgtgctgaagaagatgtcccacgctgttaaagataatcgaggcaagtacataggaacggatgcaagtcgggatggggtcacgaccgaccaatcgttgccctttcccggcgctaaacgagcagagaacttcgctgcaaggcagccca

SEQ ID NO: 50584 - DNA, 168 bp, Glycine max
  Peptide Sequence Number=SeqID_142269
atggtgattttccaccatggagatgcagcggaagacaaaggagaagaggtgagaggaggcgcctatccactagggaataagccatggaagaaggtagcttccttgagaagctttcttgagaaaacttccttgagaagcttctttgagaaaacttccttgagaagctag

SEQ ID NO: 50585 - DNA, 357 bp, Glycine max
  Peptide Sequence Number=SeqID_142270
atgtccaggaaggatcacatatttctgaaggcctttcctcattttttagagggagtggcaaaggactggctatattaccttgctccaagagcagtgcatgaagtagccacaaattcatcttcatcaaccgagactaagaagcttgaaggtaaactagatgccttggttaacctggtaacccaactggccatgaatcaaaaatttgcacctatcgccagactctatggtttatgctcctctgtcgaccaccacacagacctttgcccctctgtgcaacaatctgaagcaattgaacagcctgaagcttatgctgcaaacatctacaacagacctcctcaacctcagcagcaaaattag

SEQ ID NO: 50586 - DNA, 171 bp, Glycine max
  Peptide Sequence Number=SeqID_142271
atggggggagattgtggaagcaatgtcttccaaggttattttgatgatgccaaagaatcaagagttaagcaaattccaaagattcaagaatcaagtttcaagaatcaagattcaagaataatcaagatcgagattcaagactcaagattcaaaaatcaagagaagacttaa

SEQ ID NO: 50587 - DNA, 642 bp, Glycine max
  Peptide Sequence Number=SeqID_142272
atgtcaaatgtctcaaaaagttcctttgcatctgataaatatgaaagagtaggacctgattactttgggtattactcttctgaagtagtaaatttattgtcacaagatgaggatgtttttcctgtttctacccaaacacctgagctacctgaaaccaaatatgaagagggaggaaagaagaatttagtcaatcagactgataactgttctggtccgttgtatagtaatgctgttggagctggcctttcagagtttaaaaaggacagatttaaatcactgctcagacagagtgtcattgctctttcgtccgaagttgatgaggtggtagaccctgtttttgcggcatatcatttgcaatccaagctaaaaagtaaatcacaatcattgaatgatacagcgactgcatctgacaatgtaatgcaagttccttgtaaaaagctaaagatctcctcatcttcaacttcagccaggtttcttgaacgaactactaatgtcaatccccaatgcagtaggaaggtatacattttatcaaggatagcttggaaagggacagcagagaagccagatcccgtccctaaagacgcactcacgcattctcatgcgtgtgttcttgactggccaaacaacagcccttgttcctag

SEQ ID NO: 50588 - DNA, 996 bp, Glycine max
  Peptide Sequence Number=SeqID_142273
atggcatccttcagccacatgcagtcccaacttcagttgcagatgcaatctcagggacttgtagtgcctcctgaccctctggttggtccctccggtcctcgagatcctgcccgcctagttgccatggggagagtttatgagggatccactgttgttcataacactcctttgttgcctggccaagtaaaggtgagtgtggaggaggttacagatgcagatgctccagttcctgtacccactaatgaggttttcttagtggggcagacacttcacaccttccttgcttggccgacacatctggtcaagtctttatcacaacaggtagctgtgtctctggcaaaaccacctccaaagtccgatccagaggttgatgatccgctttatctgatggcattgaccatcccagagcttttcttgaggccttatcaggttagatgggatgccaccgtgttcggggtctttaatctagatttccccctctacataaagcacaaagacctctctgaaatcgcacacggtggtcaatgtctcagcatatcagtgttacagttgtggattctacatctaactaaaacatgtatacgagtggggaattcttatatctatggattcctcgagccacagtccattcagaggtctaggcaatcgcagtttgagtctgaaagttacataaagagttggatgcagagttcacaacgcgatgtctatcttggagcctacctaaatgggttccactgcagtggacactggcagatgggggtcatcctgcccaaggaacacctagttgtctggttttgttcattgcataacaggccaaacaactaccttaaggggattattaatagcctaaatcaaaggcttctgctaggtggattgtcgtcaaggaataattgggaagcgtattttaacgatcctagaccattggagccagagagattaaaggcattgcaaatccaatgggcacagttttatctccgagttagagatcaggcctag

SEQ ID NO: 50589 - DNA, 609 bp, Glycine max
  Peptide Sequence Number=SeqID_142274
atggatacactcaccaacctgacgttgcatttaattcactcaacagcttctccagacactctcccttcttccaacccaccattgcgctttcaccctgtcaatatcattcttcacaatttagaaaaccaactactaaaaaaaaagcaaaccctcccaagagaagataaacaccagctagcacattctctctctcataattctcttctctctttagtttttgttgtcctaatgagttgttttactcctgaaaaacccaccatgtctactctccaaatggttcctcttggcaagcttcgttaccaaaggctaaggcatgaaaaagggtgggatggtgaaagggaaaggaggccaaggagctggtttaggttcagaagggttcccattaggagaaggctcagactcaaaatttcaagcttgagaagactttggaggaaaagggctaggctggtttcttccatgagaatttcatatgccaaagtgttgaaaagattcaaggaaggtcaagtccattttggtgacctttttgctgggaactacttgttcatgcatgtcaaccctgcctcactcaagtgccttgaaagggatttgtccctctcaaaaattgcatag

SEQ ID NO: 50590 - DNA, 204 bp, Glycine max
  Peptide Sequence Number=SeqID_142275
atggcttcgctttttcggcgagctttgggaggaacctggacagggatgctagtcttccattcaacctctagacttcttggagttgtgcatttgttggggttggcttctattccctggtgtgtgatcacaaagtctaggaacttgcctccatcgaccctgaagagcatgcatcctaatctggttgtatccagagtaagcgtctag

SEQ ID NO: 50591 - DNA, 320 bp, Glycine max
  Peptide Sequence Number=SeqID_142276
tccatgggctcgaaatctaccctaaggctcatgagaaccctagggccttcccttggatctctggaccaatctacttggagtcttctatccaatgcccttgcggggtaggattgcatcatgtgtggaacatctgcaaactcttggcatcgtctacactttttggtgaagttgagggtgtcgactgtgagtgttggccagtagtagccaactcataccactttggtagcaatagagtgaccctaggtgtgaaggctgcagatcccttcatgaagttctctcatgacataatctacttattggctgttatagcatttgagtaa

SEQ ID NO: 50592 - DNA, 159 bp, Glycine max
  Peptide Sequence Number=SeqID_142277
atggcggtccgtggcggctactggtggttatgggtggtgaagaagaagcttgggacattggggaagggagggcgcttttaccgagacagctcagacaacttccttgagaagctttctcgtgaggcttccttgagaagcttctttgagaggcttctttga

SEQ ID NO: 50593 - DNA, 1494 bp, Glycine max
  Peptide Sequence Number=SeqID_142278
atgtcttcatttatgtctaatttcgccatcgacatgggtggcaatgattctgagggttcgattcagcaacccccgaggaccatgagggctttgtgtcatactggtggagccacctctcacctccatgggagggcgcgaccttccattgcttccctgaccaaggagcttgtcccggtcatgatgattctccccccttttgcttctggggaggaaggagaagtgatagggatgttagggcatctccttgcgtgcatagtagccataacgttgggtcatcatcgtccctacctaccattactagctgtgagtggggcagcgtcaggcagtctgcccttattctttatgtacaaatgtctgtttgaggccttgggtcttgtaatctgcacccccacaatgaatcagcatcattcttcagcacttgaacgtgacccctacccaaatccacccgaacacatgtccaagaagttgtttgagtttgactcaaacgtctttcgttgcttcaaggattatttcttcaaggtcttagctactaatgtcgcggctgatggatctgttgacccttgtggaactgcgccacagtccattgtgtcctctgttgctggagaagggggtcaacctactattgaggttggccctgttgttagtgctgctgagattgcttgcagtgtccattcctctattttgactgagaggaagcaagctgcaaggttgacccccgatgcgggtcgcccttcaagtttgcaagacctgcctccagctccgtcagtcgttgaggctcctgcttcttctattgttgttgctgctactcctgcttctctacctcctcttgccactcctgctgctgaagttgatgcaccagccacttcaactgatcttgttgtgattccatcgcccaccatcactgcacccttattaagtgcgggtgtgacaactataagtgctcccgagatgccgcctcctccttcttcaaatgctacggattctgccaaggtcttccttcaaaggagtttggcgattctagggagaatggacaatgacaccaagaggttctgcacaaggaggcgtccttggaggcagagtcaaaccgctagctgccttcgaaggttggtggtgctcttgccaagttgctacgcaccagaatggatgatgatgagctatttgagcactgtaagggcttgtagcgggagaaaattgacttggttggcaaggatggaggagtctgagctacgagcagctaaggagaaagaggccaacaatgagcttgaagaagagttgataatgtacaagaaggaggctgtagagcagcatgagaaaggctttaacaaggccattaggcaggtcggatgctttgccaaggaccttgacttgggtctttttgaccatttcaagaatgtgaaggacggtgttctgctagacaacgaaggtattgctactaaggaaaaggttggtgaggagcaaggtgctgaggagcaaggccatgatgccattatttag

SEQ ID NO: 50594 - DNA, 123 bp, Glycine max
  Peptide Sequence Number=SeqID_142279
atgagaggcaccatgcatgagcctcaagagaacctaggggcagatcaaaagttctcacccggaattaatgaaacattgggcttaatccggattttggttatggacttgaagagggcaaattaa

SEQ ID NO: 50595 - DNA, 411 bp, Glycine max
  Peptide Sequence Number=SeqID_142280
atggaagcagaatggagaaggaagagagagaggagacgccacttcaacaagaagatgagtctagaagaagctcaacaccataggaggccatggataagagcttggagaaagaaggagatgaatgaagggagaggaagaaaagagcacaaaattttgtgctctaaaagagctctaaaatatgaaggtacatcctttgtggtacaagtagagggtacatctatttgggttgttgtgactgagaacaagagagggtacatctcttgtggattagttctagtggagggtacatccactaggttgttcaaagagaacaagggagggtacatcccttgtggatctttgcttgtaaaggattttacaaggttgaaaagaaatctcaggaactgcaagtcgcttggggactggatgtag

SEQ ID NO: 50596 - DNA, 597 bp, Glycine max
  Peptide Sequence Number=SeqID_142281
atgggcccgaaatctaccctaaggctcatgagaaccctaaggcattctcttgcatctctagcccaatcttcttggagtcttctatccaatgccctttcgggagacacatcattttggtcattagcatacaaagacggtcttgtgggaagacccgtctttgtatcgttggtggtttcacgtggcggacacgtgattttcccgtttaaaatacaaagacggtcttatcctgagacacgtctttgtatgtttactggtcacacatggtggacacctgatgttccactttattgccatacaaagacggtcttgactgaggcccgtctttgtatcctaaatcgtttcacgtggcgggcacgtgattttacctttctaaccctttggcgcctacgatctcgagcagctagcacagaagtcacaactacgcgccctagctacatagcatcgtctccgacaaagtcagtgccggttaaatcccgcttggtccgagctccggcgttgcttcttcttccgtctgcagtcgccaccgacaaagctgaggccacatttaggcagttagttcttgttggtggtctactactccgccacagattgtcgtga

SEQ ID NO: 50597 - DNA, 434 bp, Glycine max
  Peptide Sequence Number=SeqID_142282
atgaagttcctttatgtcttcagggcccattggcaacttcttgttatgtatccaggtgacaatatagtgctttggttttgttctttgcgaaagaagcctgatgctgccatcaaggctgcagtgaatagtgcaatgaaatcactaagcaaaagtgaagagggaaagccagctcaacccgtgcctcagtggattgaagcaaagagtcatgttcaaatgggaaactacgagtgtggatactatgtcatgcactgcgcatatagcacaaaatttcgtgctcttctctccctctcccctcattcatctccttcttcctccaagctcttatccatggcctcctatggtgaagcaaaggaatctattgatgaagaagatcctaggcctacaagctccaatggagccttacatcatgtggtatcaagagtatcttcatctag

SEQ ID NO: 50598 - DNA, 171 bp, Glycine max
  Peptide Sequence Number=SeqID_142283
atgcccatggttcatgccacatatgacacgggaaatagtataaactgtggcagaaactcctttgtggcccaggctgatcaccaaggaggtggggagttacggtgtacgactgggtggcctcaacaaatactgcatggtttcctaagtgaggtgtcgagtggacatgcttag

SEQ ID NO: 50599 - DNA, 531 bp, Glycine max
  Peptide Sequence Number=SeqID_142284
atggagtactcactcccttattaccataatcaaggccagatgacgagactaatgttgcatccctcattctacattgatgttatcgagaccaagtggaaacactatgacgtgctccatcctacaccgtcctactaccactttgcggcatccatgtctaagtttgtcattccattcgagtcgcattcgccatttactgacattacaatgttttatgctggatctgactcctcatccaaggatactaatgccacctctccttctctaatgtatccccatttggtgttgccaaaagcttgggtaccacccggggtggatatggtggatctcgtgtgggaggatgagggagagaaccgggggaggactgggggaggacatgtgtatgaggagaagatgtctgatgtagctctatgtggagcttgttcaatggcagaggaatggagaaggaagaaagatgattggagatgccacttcaaggagaaaatgagtcaagaagaagctcaccaccataggaagccatggataagagcttga

SEQ ID NO: 50600 - DNA, 207 bp, Glycine max
  Peptide Sequence Number=SeqID_142285
atggcactttttgatgataaagctaataacgtagttggtgatggcagacttggtgtcaaggatcaagtggcagtggtacagagaacgacgatgataaggatgactctattgagggtttttcaccagtcatcgatgtgggtcaatggaggggggcatggtgatggtggttatgtggaagtgatggttaggattttcttgggtatttag

SEQ ID NO: 50601 - DNA, 441 bp, Glycine max
  Peptide Sequence Number=SeqID_142286
atggtaaggactcgattcgtatctaaggaagcaggttcaaattccattatcgatctaaaaaatttattggtgaaccatctcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 50602 - DNA, 201 bp, Glycine max
  Peptide Sequence Number=SeqID_142287
atgtatgcaaccattatgggaatcatgtctttctttttgctttctaatttgcagcttaagagagcattgagaggaatcaagctaaaatatcatggcacatgtagagaatcatgtgttgaacccaaagcgggtcaatggaatatgattgataaggtgaatggatctgtcatacatatgtcagatatgggtagtgtgctataa

SEQ ID NO: 50603 - DNA, 288 bp, Glycine max
  Peptide Sequence Number=SeqID_142288
atggattacattccacctagtcctctgaacatggactatgctccaccaattgtccaagttgatgaattcatgagcaatgaaacattatggcacgctagcatcagctctattttcgggcaagatgtcctggacatcgtatccgacatcgtggatcctgcagcttcaatgcttttagcaactccagatgtcctggacattgtatccgacatcgtgaatcctgcagcttcaattcttcatttgacatttcatcttgccttgtgcattgtgcagcccgatcttattctttga

SEQ ID NO: 50604 - DNA, 332 bp, Glycine max
  Peptide Sequence Number=SeqID_142289
ctttcgaagaagttacgaaaactcacggattgcgaaaaatacctcctttcgatttccgtcacatcacggaattttcacggatcgcggatcgactttctaaagccaattttgttaatagtttgcatgagaagagggaagcacaaattgagaaaaagattaaacaatatgctagatattccaataagaagagaaagaaaatggttatcaaactgggtacctttgacatcaattcgagggcgaattctttccaagaaggagggtatgatagaggactattcaaggaggaagagtttgacataggtgggttcaacatggatggaccaatcacttga

SEQ ID NO: 50605 - DNA, 156 bp, Glycine max
  Peptide Sequence Number=SeqID_142290
atggagggctctaggccaatccttgcttcttctaccaatttgcatgcaatggcttcaaagaagcttctcactaaaagggcaaggaaggacgccgtaggggagggatccagtgcaaccccacaagcagaaattgaatttgacggatttcgtttctaa

SEQ ID NO: 50606 - DNA, 180 bp, Glycine max
  Peptide Sequence Number=SeqID_142291
atggtggcattgatgaagaaagttgaagaattggagttgagggaaaaagatttgcaaagcaggatcagggacatgaagaggaaggaaaaaattttagggattcttttggttgtgtgttgggtctgtctttgcttgttagtgtgtgcattatgtatccgaggtacattgttaaggttgtag

SEQ ID NO: 50607 - DNA, 303 bp, Glycine max
  Peptide Sequence Number=SeqID_142292
atggttgttgaggtggatcttggtgtggtggtgattttgggtgtggatgttatggcagttcagatcggtcgtggattgcaggatttgttgagcaagaagctgagaccactgcgtgaattgttgtgcaatggtgttgagcttcaagtctttgttgctcagcaaaagctctcatatcagcttgatatttctcataatgtctttaaagcacttgagacaacatctttgtcgatttctacaccctctatggtagcagccgattcttcaatagatttggattgtgctacctcaatttgtgttgtagaa

SEQ ID NO: 50608 - DNA, 496 bp, Glycine max
  Peptide Sequence Number=SeqID_142293
atggttaaaggattagccaacccaaatcagcatgaaaagctgatattggatgcgattcaggcctctatcatgcctgctatgacagttcaattttcacatgtttatagagagtgcaacaaggttgcagacctgttagctaagaaaggtctctccctagatgagggaatagtttattttttagatatacttggctttgtggtatctgcctttcatgctgatattgttagccttgggctccctcggaagccctccaaatcgggggaaagtcgtgaaggaggggcgatattgactccctcttcaactccttcgacaagtgcaaggagcagcgatgcagcaggctacagccatggaaatgcaactgcttcacctctttcaggcactgctgattctaatttggttcctggattaaatcatggtgacaggattgtccaagctatgaactcaaaactgaatctgaatgggagttttccagttacggcctatgaagccttgccaa

SEQ ID NO: 50609 - DNA, 303 bp, Glycine max
  Peptide Sequence Number=SeqID_142294
atggataatgcatcttcatgctctgatatccatgaagtcttaaaaggcataggaccacctcttatccatttgctccccacatatgtcaaatacagaatcatcataggcacgaacaacacatgcaataaggcaaggggtacatcctttgtggtacaagtagagggtacatctacttgggttgttgtaactgagaataagagagggtacatctcttgtagatcagttcaagtggagggtacatccatttggttgttcaaagagaacaagggagggtacatcccttgtgaatctttgcttgtaaag

SEQ ID NO: 50610 - DNA, 234 bp, Glycine max
  Peptide Sequence Number=SeqID_142295
atggctaagggagaaaggcttagaagtgaagattacctcaaagaagctacgaaagaaaggattgaggaatttttctccatcgaatccatgaggtgtattctgaggatttcactccgattaagaggttcctcttggtgtggtggttcggcggcaagcaacagcggctcatggtggccaccggtggtcgtggatggtggaggaggagtttctagggtggtttggatggagttttga

SEQ ID NO: 50611 - DNA, 324 bp, Glycine max
  Peptide Sequence Number=SeqID_142296
atggattttacgacaattggtgttaagcagctcaactcggtaggcaaaaatccacatgttgacaaacaatcgtccccgaacgaaattaggctttttggaattcttaaagtcgatgagcaagaacttgctcaagaagaagaaacaaagaaatggaagtcattagcccttacggttcaaagaccaaaatgcaactctgcctccaaagagtcatcgcccaaggcccttgctattaatgatgcttcagaagaagaatttgatgataatgactctgatgaagaagatgacgagctgattctaatcaccaggaagattagaaagatgtga

SEQ ID NO: 50612 - DNA, 1201 bp, Glycine max
  Peptide Sequence Number=SeqID_142297
gattctcaaacgtcccctgatgggaacgaggggttgtatcaattataaccccgtcctcgccataagacaacttggctaccccatgagaggaacatcttcggaggaaagcatcacgcctttcatcgcacgaggtttcagggaccccaatgtgaagatacttcaaggagtccgcaaggcatggggtgcagtgcaaaggaaagataaaaagcttaggggaagcaacaatgggatcatcgacgactatcataagtggctgaaggctcgaacgcaagagttggattggctcctaaagctaaaggtttcaagcgaggaagaggctgaaacccctgaggagagtgaggaggtccggaaagagtacgacaaactgagggacatcaatgtggccaccgccgaagcattggaacgggaaacaaagagggcccgaaaggaagagtacggccgaaacaagttccggggggctttgtggggtagcaacaacgagcttaagcttcgaagagctgagagagaccagtcaagagtcgaaggcatggtattgggagacaagttggaggcttgccaaaggtccaaaaggagtttgtccgaacaattgggcaagaccgaagaaaacatgtgggccatcatcgaccaatacaaagagaagctaagtctagcggcaacccatgaacaaaggctagaggacgagtatgcaaaggtatcagtcctgcaagcagagagggaagcaagggaaagagtaatcaattcattgcacaaagaagcaataatgtggatggattggttcattttcaccttgaataggagtcaagagcttccgagattgctagccaaagccaaggcgatggtggatgtatactcggcccccgaggaagttcacgggctcctcgattactttctttgtctcattactcactgcatttttgtccttttaggagaaaacgccataactacacacgctctaaggcacccctatcaaacccgttctaagactagagtcatgggtgatgtagaagaggtgcaagaacagatgaaggccgatatggtggccttgaaggatcaaatggcttccttgatggaagtcatgttaagcatgaaaaaactgatagaaagtaacacggccacgactgctgccgccaccgaggcagatcctactcatccatctgccacgaatcaagcacatcaactcgccccggacatggcgggataa

SEQ ID NO: 50613 - DNA, 390 bp, Glycine max
  Peptide Sequence Number=SeqID_142298
atggcggaggagctgctacaaggaatgatgaacagggggaagattaaggtctacagtgcgaagagaggagaaggagatcccttcataatcaagtcgcctgcgcccttcccttataaaagtgataaggcggtgccatggaaatatgtcgcacaagggtccgacaaaagaaaggacgcgtccgtcgtgcgggttaaagaggacttgccatcccctaaagacaaagggaaggaaaaggcggatgtaggcaaaagagataaggcgggcctgaccccgaatgacgaggtcctggttggaaagatcacagaggaaggggacgacttcagcaagaaagagatatcaactgaggaggcaaccgagttcctaaggatcattcaacaaagtgaattcaag

SEQ ID NO: 50614 - DNA, 198 bp, Glycine max
  Peptide Sequence Number=SeqID_142299
atgaccacagattcacctccacttcctatgttcccatggacccggtggagtcgccaactgtcgcaacctacccttcggcgagagggcgacgcgaggctcatgggtgcgtcttccaaggaaggaaaacgtgtggagttgccaccgatgtttattcgaggaaaacgtcagaaaaaccaagaacaggtctacgacttttaa

SEQ ID NO: 50615 - DNA, 351 bp, Glycine max
  Peptide Sequence Number=SeqID_142300
atgggaacgaggggttgtatcaattataaccccgtcctcgccataagacaacttggctaccccatgagaggaacatcttcggaggaaagcatcacgcctttcatcgcacgaggtttcagggaccccaatgtgaagatacttcaaggagtccgcaaggcatggggtgcagtgcaaaggaaagataaaaagcttaggggaagcaacaatgggatcatcgacgactatcataagtggctgaaggctcgaacgcaagagttggattggctcctaaagctaaaggtttcaagcgaggaagaggctgaaacccctgaggagagtgaggaggtgcaagccctaaaaaatggaacttga

SEQ ID NO: 50616 - DNA, 330 bp, Glycine max
  Peptide Sequence Number=SeqID_142301
atggctgatgcgcttaatactctagcatctatagaagcaaagcttcatggtgaatcaagtgtgattcaaagatgttttgatgataacaatgatgataaaaaaaagatgatgacaaaggtgatgacaaaaacctcaaaggtcaatcaaaggatgagttcaagatattcaagaaggaatcaagaacaattcaagactcaagaggaaaggttgaaggacacttcaagattcaagaggaaagttgaattcaagaatcaagattcaaggatcaagcttcaagaatcaagatcaagattcaagattcaaggttcaagaactcaagagaagacttaa

SEQ ID NO: 50617 - DNA, 507 bp, Glycine max
  Peptide Sequence Number=SeqID_142302
atggttcttccggaacaatttcggaagaaccacttcttccggaaatttgaaaggtcatccggaagagcccttcttccggaagaactacttcttccagaaagtatccggaagaggtgttccgggagacttccggaagaagacgtttggttacttccggaagaacacttcttccagaaactttccggaacaggttcttccagaacttccggaacaacccctaacgggtcttccggaagcctccgccgtcagccattttccccatttttttcggcgtctcctgctctcgtcttctaccctaagtgcataataaaagcagagggaaggttagggacacctacctcgaacggaaatggcgtccaaccgaaagaagcagcagctgggctcgcggtggaggagaaggcttgcggaagagggaagaaaaggaagagaagcagaagcaagaagaagaggctgagtgattccgggagaggagagggaaagctatttaaatgttttaaacttttttaa

SEQ ID NO: 50618 - DNA, 342 bp, Glycine max
  Peptide Sequence Number=SeqID_142303
atgtatcagtatccattcgaaggtcatgaaagtgatacctctgcaaccgaattaagtggtgttgcggaaacatatctcaatttttcatggcctactatgactccttcacagcaacatgatgctccaattctaacacctaatgccccattagctactcaatggaatgtacccggaacaatacctgatatgggtgaattattaggtgttgatttacgtcaccgattttctgttgaggctgaccaagttgaagaagggagacatcatggcagaaaaaatcttgatagacaagcgcagagatgggaacgcccatgcggcacatcctcacgtcatcacggacattga

SEQ ID NO: 50619 - DNA, 897 bp, Glycine max
  Peptide Sequence Number=SeqID_142304
atggatgaaaagaaaaagaaacaactggaggaagcttctcaatccagaagcactgacactatgattgatcctccatctcccatcaaacgacacgtgaaatggaagatggcccgcaccaagaaaactaggcaaatgacgtctaaggcaacaaaggaaattgttggcaagattataagatttgttggaggagcaggcctcacaaggttcctttgtcgcccatgggcgttaggatgtactgactgctgccattgggcgactagaacaccctggtcgtggaatgacccagacatgagtgactcaaagaaatgtgggttgtacgttgaagaaaatccttcctgcctggttgccctaggaagactttatgaagggtccacaaccgttcacaacatgcctttgcgccatgatcaactcaaggttgatgttgaggaagttaaagatatttttgtacccactcaagaggttcagctagtggggcagacacttaatacctttgttacttggccgatacatcttgtaaagcgtttactggaacaagttatgtgggatgctaccatgtttgggaagtttaatgacgacttccacttgtatataaagcatgaagatctgtccgaaatagcacacggtggtcgatgtctcaacatctctgttatacaattattgatttttgcacattggcaaatggtcgtcattttgcctaaggaaaatgttgtcatctggttttgttcgtttcataataggccagacaactacctcaagggaattattaacagtgctttgaaaggacttgacgatactccacaaagtaaatccaagactgctactaagtggattgttgttaaagacaaaaaggaagcactgaatgtgggtattacgtcatgcactggatgtcaactataa

SEQ ID NO: 50620 - DNA, 558 bp, Glycine max
  Peptide Sequence Number=SeqID_142305
atgattagaaacgatcaagctgaggctacagaagaggagcaggtcacttgttctattaatgatcaaaccgagaagagggaaaaggaagagcaagaggaggttaagctaattagcaacataatcaatcaaactgatgattttgaagatgatattctaccagaatttgaaaaacttctatttgaggagattgattttctatcgcttgatgagaagactgatgaggataagaaatggagagtttatgcaattgaaatggctaatagtgccagtgaattagaatggttgcataatcaagtgaaggaattggaggagagggaagtgaaacttgacggatcaggaagaagactttgtggagttacaaaggcagttgaaattggaaagaaattgaaagctctaaatgacttggaggttgaagttgtggagcttaagagagaaaataaagaacttcaacacaaaaagcgagaaatgacattaaactcaatgctgctgaatctaaaattacagaactctccaatgtcacagaggtcacagtcattgagtagatctatttttctttag

SEQ ID NO: 50621 - DNA, 447 bp, Glycine max
  Peptide Sequence Number=SeqID_142306
atgagggttagggctaggctttggggtttgcggaggggctttgaaccccgcgagggatggtggcttcgaggagtggatgctgaagaggtagatgatggcgaggactaccagcgtaaggttgacttgtttcaagcaagtcttgccaagatagaatatgaagatggtaacaggctgaaattgaagcttagagggcattgggatggtgtggagtatgagggtctccatagaatttgctcaacctatggatgctatggacacctcacaagatactgcaaaattcaaactattgttgctttttccaagtctatgagtgtccaaaaaggggctaatatggaaccgtctactatggctcaaagagtctcaaccaatattaaaaaagttgcaaaaatgattgatgaaggtactgccatggaggttaccacagaactatcaagctccgtaatttag

SEQ ID NO: 50622 - DNA, 918 bp, Glycine max
  Peptide Sequence Number=SeqID_142307
atggttctaggaaaggtgattgataattgtcaaagtgccttccttggtgagaggaaacttttatatagagtacgtgtggctaatgcgtttacatggacttcggtattggtgaatggaagtccttcacaagagttcaaatgtcacaagggacttcgtcaaggataccccttggctcctttcctctttttagtggtgaccgaagagggaagtttgtggagtgaggtgttaataccaaagtatgatggttggaaaggtctagtgagggagggtgagcttttgcgggaatcattgtggtggaaggacttgaaaagaatttgtggaggaaatagtagagagaaatggttcgatgaggggattgagtggaaaacagggcaagaggatgtggtttgtgagatgggttgttggaggttggatagatgggtttggaagttaaattggagaagagagacttttgagtgggaacttctcgagcaattgcaaatactcttaaattctgtacagatacttagtaatgagttggattcatgggtttggcaaaattgcaattctggaaaatactctacaaactgggcttataaactgttgttggaagatgatgacagctcaacatatctttctgacatgccctatgatttggcagctatggcttcaatgccattcttggatgcttccttcaatgtcaacaatactttcagcatctttggagagccatttcaatcagttttcgggtttgggaagtgtggtgaggcgaggggcgacaatggtgtgtcaccttctttggctctttcgaccaacagggctacgatactaggacgttgttgtgaccggatggtgagtgcgacgaggtggaagggtttgggggtgcacaactacgttttgagaaaggagatgcaggaaccaaaaaatggggtgccttaa

SEQ ID NO: 50623 - DNA, 93 bp, Glycine max
  Peptide Sequence Number=SeqID_142308
atggaggaatctcaggaacttgctagagatgctgctatcgctgtcggaagacagatgtgtattgagatgtctgtattgagctgtgagctatga

SEQ ID NO: 50624 - DNA, 267 bp, Glycine max
  Peptide Sequence Number=SeqID_142309
atggatgactcaattagtaatcccctttgtgacgtcaatgatgatgaaattgaggttgaggatgtcgaaaaagaatataagtttgttgaacctgataagaaaaagaccaagtccacaacattcgattgttggaaatttttcactaagattggtgtggcattacaccgaccctctgctcccctaggaaaggtcaaagtaatgcaaaaaaatggagggatatcgggtgcattagaagcatacctcataggggggatccgtgtaatttag

SEQ ID NO: 50625 - DNA, 351 bp, Glycine max
  Peptide Sequence Number=SeqID_142310
atgtggatgtactacgaggatcatatcgtacctgcaggtcacgcattagatcctctgcctcatggtcacgccccgcagtcccgagtcgtccctcaggccccgcagacggatatccctcgcgtgccggagccaggagcatcgtcgacatctgcggaggagcccaaacatgcagtggaagtttgtgatgacattgctgagaggttggagcgtcatctgagtctaggggtggtcacgcctggctcatcgacacatgaggtggtcgaagaatgccttagattggccaggagtgtgatacaggaccatctagtatacgttaggtgtagacgcagacggcgcactgatcaggcgtag

SEQ ID NO: 50626 - DNA, 247 bp, Glycine max
  Peptide Sequence Number=SeqID_142311
atggccttggcaaatcaaggcgaatgggcttctttttttgacatcttggcacttttgatctttggagttatcctctttccaaatgtgaaagggttagtggacctagcagcgattgacgctttcctcgcctttcatcatggcaaggaaagcccggtcgtcgccattttggccgacatgtatgacacgttcgactggagatgtgaaaagagcagcacaaggaattgtttgctgtacactggatctctat

SEQ ID NO: 50627 - DNA, 108 bp, Glycine max
  Peptide Sequence Number=SeqID_142312
atggcaaggacgtgcaatcctctgaaggtgagggcatgccctacaaaggcgaggacgtgtagtcctctgaaggtgaaggtaactagtacccaaggtgagggcgtgtag

SEQ ID NO: 50628 - DNA, 162 bp, Glycine max
  Peptide Sequence Number=SeqID_142313
atggttaaagcacgtcaaaagggggggaaaagagggaggtggttgccgcccagctcgcccaggcgagctgggttgcttccaccagaaggcaccaccttctgttggaacaccctggaaggtccaagtgggcttggttgctatttgcacatccctttttactaa

SEQ ID NO: 50629 - DNA, 507 bp, Glycine max
  Peptide Sequence Number=SeqID_142314
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggattcaacaagcgattctcctcaaatttcagccagcccgtatcaattaggccttgcaccttacgcttcagagccctacaatgctcaatggaacgccccggggcttctccgtgacaagcacacgtcgcgttcgagtcgtattctcggagaaacggaggttgatgaaccttggctagggttatggctaccattgaattatcaagtagatatgggatcaagtttagcatatgacaacggaatttggggtgaaccctacaggctttttgctgcaaaattcctttttgttggtgttttttttttgtttgtgctaaaagtggtcttcgtcattggaagtgcggtagacagactttgtggttga

SEQ ID NO: 50630 - DNA, 216 bp, Glycine max
  Peptide Sequence Number=SeqID_142315
atgcgcggagtcgccaccaacgtttattcgtggaaaacgtcgggaaaaccgaaggaaaccggtcaaaatgaaaattctaagttcgggagttgtgacttgtatttacgcttgaggaaggtcgacaaaagcggggcttttgctcctacgtaccctcctttggagaggaaatcagacctacgtagttcttccttacgcgtgaatcaagtgactctttga

SEQ ID NO: 50631 - DNA, 356 bp, Glycine max
  Peptide Sequence Number=SeqID_142316
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtatatcgacggccagtgccaagcttgcatgcctgcagtcgggaaacctgtcgtgccagctgcattaatgaatcggccaacgcgcggggagaggcggtttgcgtattgggcgctcttccgcttcctcgctcactga

SEQ ID NO: 50632 - DNA, 228 bp, Glycine max
  Peptide Sequence Number=SeqID_142317
atgtcagtctctgcctgctatcaagcgttctgtcttacagatagcaaaagaatgtttatacggataaccactccggtatttccgcccgtcagcgtgactcaaaagtcagggtgcggaatgaccataatttgtctccgcatgtcatcgggcccgccgcctctggatgacaaaagggtgcagaatgaccataatttgtctctgcgtgccatcgggcacgactgtgtctga

SEQ ID NO: 50633 - DNA, 351 bp, Glycine max
  Peptide Sequence Number=SeqID_142318
atgtcaggatttacacgcgattctcctcaaatttcagccagcccgcatcaattagaccttgcaccttacgcttcaggcccctacaatgctcaatggaatgccccggggcttctccatgacaagcacacgttccgttcgagtcgtattcttggagaaatggaggttgatgaaccttggttggggttatggctaccattgaattatcaaatagatatgggagcaatgcggacgatagactttgtggttattttagggatggcctttgtggataactgggcggtgggtaaggagaaggttggttattggctgagtaatgacatcgttgggttgatgggaaacttggctgtatag

SEQ ID NO: 50634 - DNA, 379 bp, Glycine max
  Peptide Sequence Number=SeqID_142319
cttgcggaacggtgggaacgagatcgagctctttcttcacctcttcgaacggttcaaaaatcactcccggtcagggcgcggtggtttcgtggatcctttcgctgcgcgaaccaccaatccacgagcgggaaccgaacggggaggttcggcgttcgggctgaagagggagagggacgaagcagaagcagcagcggttcggagaagcatggtttctggttcgggatttccacgaagcggggatttgaaagaaagaaaaaccaacagaggaaaacggaacggaacggtgacagtgtgttattgtgagcgtgtggatagagatgtggggcttggcgcgtggcgtgctcgtggtctagctgtccttgtcccttcaaatatctag

SEQ ID NO: 50635 - DNA, 393 bp, Glycine max
  Peptide Sequence Number=SeqID_142320
gcatatgctgctctaatcagttggaatatttgtctctttgctaaagcatgtttgcgttttagtggagaaaacaccgagactttttcaagtctcacaagttatccagaactacgtaggtctgagttcctcattagaggatacgtaggagcaagagcctcgcttttgtcgaccacaccgccttttgttgccatgacccaagagctggtagcccgcggagacaccttacggttatccgcacctcgtcattcagtgaccccaagtgtgattgatgagcagaggccaatgtggtcatctgcgcctttttcggagatgtcagcattttccgatgaagacttttcaagtctcacaagttatccagaactacgtaggtctgagttcctcattggaggatac

SEQ ID NO: 50636 - DNA, 867 bp, Glycine max
  Peptide Sequence Number=SeqID_142321
atgtcgacaagcgcaatgagcgtggtgatccttgccgctggcaaaggcacccgcatgtattccgatctgccgaaggtgctgcacagcctggcaggtaaaccgatggtgcaacacgttattgatgccgctaccggcctcggcgcacagcatgtgcatctggtctacggccacggcggtgagttgctgcaggagaaactggcgcataacccgctgaactgggtgttgcaggcggaacagctcggcaccggccatgccatgcagcaggcggcaccgttcttcgctgatgacgaagatatcctgatgctgtacggcgatgtcccgctgatcgccgaagaaaccctgcagcgtctgcgcgacgcgaaacccgctggaggcatcgggctgctcactgtggtgctggataaccccaccggctacggacgcatcgtgcgtgaaaacggcaccatcaccggcatcgtggagcaaaaagatgcatcagccgaacagctaaagattcaggagatcaacaccggcatcctgattgccaacggtgccgacctgaagcgctggctggcgcagctcaacaaccacaatgcgcagggcgaattttacatcaccgatatcatcgccatggcgcatcaggaaggtcgcgtgatcaacgcagtgcacccggcgcgcatcagcgaaaccgacggcgtgaacaatcgtctgcagctatccactctggagcgcacttatcaacgtgagcaggcagaaaagctgctgctggctggcgtcatgctgcgcgatccggcgcgcttcgatctgcgcggtacgctgcagcacggtcgtgatgtcgagatcgataccaacgtgatcattgaaggcaacgtcacgctgggccatcgg

SEQ ID NO: 50637 - DNA, 471 bp, Glycine max
  Peptide Sequence Number=SeqID_142322
atgactcaattgatttctgatgtcatctattgtttgctgggatcgcgcccacaagacacccagtggacccgaagaagtcaaacagggccctggggtttccagctctggttaggggcctctgtcagtcctaccgggtgctcgttcccccaacaaggaatggcacccacaaagacacccaatggacccggagaagtccaacagggccctggggtttccagctctgggatcgcgcctgcaagacacccagtggacccgaagaagtccaacagggtcttggagttgtcaagctctaattatgggtctctgtcagttctacgaagtacctgtcacctcccagcaagggcatcaggccccctactaatcgagctttcatcaagaagtactgcgcccccaggcaagcgcagggcgaaacaccacagcagcctggggatggccggtagcgggcaacagacgcaccgccatcacctctag

SEQ ID NO: 50638 - DNA, 1128 bp, Glycine max
  Peptide Sequence Number=SeqID_142323
atgtctgtggttaacactcaatcagctgcagtttactttctctatggatatggtggaactggcaaaacatttgtttggacaaccttatcatctggtatacgctccaatggtggaattgtttgtacaattgcttcaagtggaattgcttcattactattgcctggtggtcggaccgcacattccaaatttgctataccagtccctgcaacagaaaattcaacatgcaatattcatcaaggcagtgagttagctgaattattaaaggttacaaaactaatagtctgggatgaagctccaatgtgtcacaaatttgcatttgaggcactagataaaagtcttaaagacatgcaaaacaatctgccttttggagggaaaattatggtttttggtggagattttcgacagatcttgccaattgttccaaaaggtaatcgctcagacatcgtccatgcaactataaatgcatcatacatttgggaccattgccaaattcttaaacttacaaaaaacatgagattgctatcaaatgctcccgaacagcccaacaatgaagaactcaaacaattttcacattggctacttgacatacgagatggaaaaattggacaatataatgacgaattttcagaaatcactattccagatgagtttctcataaaaaattatgatgatcctatccatgctattgttgaagccacctatcccagcttgatagataactacagtgacataaattacttgcaaaaaagagttgttcttgcctctaaaaaagaaattgttgacaaaataaatgattatgtcctatcacttatacccaatcacgaaaaagagtattgcagcgcagatagtattgataaatcagatgaattgctcaatcctgcttttgcattattgccacctgaattcctatattcattgcaaacatcaggtatacctaatcataaattaaaacttaaggttggaactccaatcatgctattacgaaatctcgaccagactgatggcctgtgcaatggaactaggctcattatcaccaaactcggatctaatgtgattgaggctgaagtaattactgggcctaattcaggaaataggacatacatacccagaataaatgtctccttttga

SEQ ID NO: 50639 - DNA, 750 bp, Glycine max
  Peptide Sequence Number=SeqID_142324
atgaaagatgtcccaacatcgtccaacccaaatgtttctgtgcctgatgtcaagaaagatgttccaacatctccgctccaaatgctgaagcactcccttcacccagtgaagagggatcaactgaggaagatgatcaagccgcagaggagactctgcaccaagggcaccagaactgctccaggtaacctcattgaccttgaagaagtagaatctgatgaagaacccattgccaacaggttggcaccgggcattgcagaaaggttacaaagcagaaagggaaaaactcccctaaagaggtctggacgaatcaagactatggcccagaagaagagtactccaatcactcctgccacatccagaagaagcaagacatctaagaaggccaagacttcagggaagaaggtgcctggaaatgttcctgatgcaccattggacaacatttcattccactccattggcaatgctgaaaggtggaaattcgtgtatcaacgaagactggccttggaaagagaactgggaagagctgccttggattgcaaggagatcatggacctcatcaaggctgctggactgctgaagactgtcagcaaacctactgatggagtgatagatattgatgtttctgagcatcaaattgccaaggaaatcactgccaaacgagtccagcattggccaaggaaagggaagctttcagcagggaagctaagtgtgaagtatgcaattctgcacaggattggagctgcaaactgg

SEQ ID NO: 50640 - DNA, 348 bp, Glycine max
  Peptide Sequence Number=SeqID_142325
atgatcgtcattgtcaatgcggaagcttgtggttacgtgagcatgaactactaccaatatatagatgttgtttatacaaacgagcacatcttaaaagcttactccgcacaatggtggcctcttgggaatgaagcggctattcctccttctgatgacgcatggacacttatccctgacccaactacaattcgtgcgaaaggtcggccaaaatcaacaaggataagaaatgagatggattgggtcgaaccatctgagcaccgaacaaaatgtagtagatgtggagccgaagggcataacaggcgtcgctgtccaatgcaatctgagcgtgggagttgttcaaatcgttga

SEQ ID NO: 50641 - DNA, 123 bp, Glycine max
  Peptide Sequence Number=SeqID_142326
atgaaaattctaagttcgggagttgaatttacgtttgaggaaggggaggagcttgccacccagctcgcccaggcgacgtcagctcgcccaggcgagcaaggttgcttcctccagaagcaatag

SEQ ID NO: 50642 - DNA, 399 bp, Glycine max
  Peptide Sequence Number=SeqID_142327
atgcaatcacaaagacttgcactgcctccagagcctgaggttggtccctcagctgcttgtgtcaacacaaaggggagttgtgttgatccctcagcggtcgatccagacacgggtgactcagacaaatacgggttgtacattaaagaaaatcctccccacctagttgccctaggaagagtttatgagggatccacaatcgttcaaaccatccctttgttgcatgatcaagtgaaggttggtgttgaggaggttaaagatgcagatgctctcgttcctgtacccactgacgaggctattttagtgggacaggcacttaacaccttccttgcttggccgacacatctcataaagcgtttatcagaacatggagttgtgtctccagcaaaaccctgcagatag

SEQ ID NO: 50643 - DNA, 456 bp, Glycine max
  Peptide Sequence Number=SeqID_142328
atgacattcttgggagaaacaagcagtcagacaattgtgaactccacattagcttttattttttcaaatggttccattgttcacaaggacaatggtgcttattttcaaacctccactccagtaccttttcgagtacctaacgtttgtgatttccaaacgttaaaaaccataatacacaatacctttcagctaaccaacgaacaatatttggatgaaatttactaccggcaaccattcacaaatacagccactatgacccctactcatgatgccctactttattacaatgggaggtggaacatgccacaccaaaatgagtttgttggttactcgttcacaggaaaaaatcccaaaaagtttgacattccttccggatgtaccatggatgaactgaaggatttgatcaagcaagttgcgtctcatgagattcccccttatggtgttagtgcattctaa

SEQ ID NO: 50644 - DNA, 300 bp, Glycine max
  Peptide Sequence Number=SeqID_142329
atgggtgaccaagaggaaatacaggaacagatgaaagccgacatgtcggctttgaaagagcaaatggcttccatgatggatgccatgctaggaatgaggcaactaatggagaataacgcggccaccgctgccgctgttagttcggctgccgaagcagacccaactctcccaactacctcgccttcgcagaagagcaaatccctgccgaggggagagggcataacagggctttgcatgtgtcagtcaaatgcatggaccacgtcgtggccaaagtacacatcgataacggctccagtttga

SEQ ID NO: 50645 - DNA, 159 bp, Glycine max
  Peptide Sequence Number=SeqID_142330
atggctttcatccaacaactagaagctgtgggaactttcttacttcctttcttttctcatcctgcaagttctgaaggactacatgtttggttcttctttatggagggaagattgttgcttggaagaatcatcgaaaggaaaaactttttttatgagtag

SEQ ID NO: 50646 - DNA, 237 bp, Glycine max
  Peptide Sequence Number=SeqID_142331
atgaagaagatcctaggcctacaagctccaatggagcttgcatcaagcttgccacccagctcgcccaggcgagccaggttgcttcctccagaagcaaccgccttctggaggaagaatctagaaggcccaaattgcgtaacaatgttttcttttgatttccggcatgtctcgaaacttcatgtatggtgcgacaaagggtgccaagtacctcgaagcggtcacacggggatcctctag

SEQ ID NO: 50647 - DNA, 801 bp, Glycine max
  Peptide Sequence Number=SeqID_142332
atgaaatacaagaagttagtagcagggttgttcttactggcggcgggccaactggcgcacgccgagcaaatcggctccgtcgatacggtatttaaatggctggggccggatcacaaaatcgtggtcgaagccttcgacgatcccgatgtacagaacgtcacctgctatatcagccgggcgaaaaccggcggtattaaaggcgggttggggctggcggaagatacctcagacgccgccatctcctgtcagcaggtcgggccgattgagctgacggataaaatcaaaaacggcaaaagccagggcgatgttgtgttccagaaacgtacctcgctagtgttcaaaaaactgcaggtcgttcgcttttatgatgccaaacgcaacgcgctgccacggatttggttagttgaggatgaacagagtatcgccgatacccttgtttacatgctgcagcaggagggattcgacgtgaccgttttcgggcgcgggttgcccgcgcttgatgcggcgctgcatcagatcccggatttagcgatcctcgacgttggtttgccggatattagcggctttgaactatgccgacgactgctggcgcgccatccggcattgccgctattgtttcttaccgcacgcagcgaagaggttgataagctgctgggactggaaattggcgctgatgactacatcgccaaaccattttcgccgcgcgaagtttgcgcgcgggtgcgtaccgttttgcgtcggctacagaaattttcagctccttcgccaggtggtgcgcgttggcgagttcgtgctggatga

SEQ ID NO: 50648 - DNA, 294 bp, Glycine max
  Peptide Sequence Number=SeqID_142333
atgtcaggatttacacgtgattctcctcaaatttcagccaacctgcatcaattagaccttgcaccttacgcttcaggcccctacaatgctcaatggaatgccccggggcttttccatgacaagcaccacgttgcgttcgagtcgtattctcggagaaatggagggatggcctttgtggataactgggtggtgggtaaggaggagccgtataggaatggcagtcacagcatgggtttctccctctttctcaccctcttcatttgcccagttttctcagtcgtcctagtaggatga

SEQ ID NO: 50649 - DNA, 762 bp, Glycine max
  Peptide Sequence Number=SeqID_142334
atgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaaaaagacgtatattccttgctaattatcagacaattacttattcacaacccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggat

SEQ ID NO: 50650 - DNA, 1327 bp, Glycine max
  Peptide Sequence Number=SeqID_142335
atgaaaccgcatccggactatcgcccgccgctgaaatgggtctcgctggatatcgaaaccagccgccacggcgagctctactgcatcggcctggaaggctgtggccagcgggtggtctacatgctgggccccgagcccgctacgccgccggatgtgggcttcagcctggtctacgttgccagccgtccgctgctgctggaaaagctcaacgcctggtttgccgaacacgatcccgacgtgctgatcggctggaacgtggtgcagttcgatctgcgggtcctgcaaaaacacgccgagcgctaccgcatcccgctgctgctcggccgcggcaatagcgagctggagtggcgcgagcacggttttaagaacggcgtctttttcgcccaggccaacggccggctgattatcgacggcatcgaagcgctaaaatcggcgttctggaacttctcctcattttcactcgaggtcgtcgcccgcgagctgctgggcgaaggtaaagctatcgacaacccgtgggatcggatggacgaaatcgatcgccgctttcatgaagataaaccggcgctggccacctataacctacaggattgcgagctggtgacacggatctttcacaagacggagatcatgccgtttctgctcgaacgggcgacggtcaacggtctgcccgccgatcgccacggcggatcggtcgccgccttcagccatctctatttcccacgcatgcaccggctgggctacgtggcgccgaatctcggcgaaattcccccgcaggccagtcccggcggctacgtcatggactcccgccccggcctgtatgactcggtactggtgctggactacaaaagcctgtatccgtcgatcatccgcacctttttaatcgatccggtcggcctggttgaagggctggcgcagcccgatgaccgccacagcaccgaaggatttctcggcgcccgcttctcgcgtgaaaagcactgcctgccaggcatcgtcgggcagatctggcacggccgcgatgaagccaagcgtcagcataataagccgctgtcgcaggcgctgaagatcatcatgaacgccttttacggcgtgctggggaccagcgcctgccgctttttcgatccacggctggcgtcgtcgatcaccatgcgcggccacgcgatcatgcgccagaccaaagcgctgattgaagcccagggctatgacgttatctacggcgataccgactccaccttcgtctggctcaaacgcccgcatagcgaagcgcaggcggcggaaatcggccgcaagctggttgcctatgtcaacgactggtgggcgcaggaattgg

SEQ ID NO: 50651 - DNA, 207 bp, Glycine max
  Peptide Sequence Number=SeqID_142336
atgacggaagggtgtggtgaagggttttgccttgcaaaccttcccggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 50652 - DNA, 772 bp, Glycine max
  Peptide Sequence Number=SeqID_142337
gaaatggccccgaggaaacttgcctcaaagagatccaggaaggataaagcggccgaaggaactagttccactcccgagtatgatagtcactgctttaggacgcgctgaacaccagcagcgcttcgaggccatcaagggatggtcatttctccgggagcgacgcgtccagctcagggacgatgagtataccgatttccaggagggcatagttcgccggcggtgggcatcactagttacctccatggccaagggtcagtggatcccgtttgatgcagatgctatcgaccagctcctgggatatcctttagtgctggaggagggtcaggagtgcgagtatggccagaggaggaaccggagacgggtgcggatcatgcgcaccaacatgaccaccctgactcagatctggatgactttgctgctcagcaacatccagcccagcgaccataattctgacctccccctgccgaagtgtcagctggtgtacgccatcctgacacggatgagcattcacgtggctcagctaatcgctgatgccatctatatatttgaaggtatggcgcctaccaggcaccctctggacccggataagtccaacagggccctgggattttccgccttgatcacaggactctgccagtcgttcggagtccctgtcgcacctagcaaggtgattcagccgcccatcacccgagattttattgagaagtattgcatgcagagacaggtccagggggatgctccgcaggccgtagacgcgccgccacctcattag

SEQ ID NO: 50653 - DNA, 198 bp, Glycine max
  Peptide Sequence Number=SeqID_142338
atggaaaaatccataaatgatctgtcaacaagtgaagaaattgagatagaggaagcaaaagaacatcatctagatgaagatgctctgataccacatgtagctccaggtagagcttgtaggccttggatcttcttcatcaatggagtcctttgcttcttaaagatcaatgtcagcagaatggagaaggaggaaaggtga

SEQ ID NO: 50654 - DNA, 360 bp, Glycine max
  Peptide Sequence Number=SeqID_142339
atggccaccgatgaagccttggaacgagaaaccaagaaggcccgaaaggaagaacacgaccaaaacaaagtcgaaaagaaatttgtcccaacagttaaagtgagactgaagggaatatgtgggccatcatcgatgagtgcaaagagaagcttaaatctagcggcgactcacgagcaaaggctagaggatgagtacgccaagatatcagcagaaagcgaagcaagggagagggagtcaagaacttccccgattgctagccaaggccaaagcaatggcggacacctactccgcccccaagaagatccacggacttctcagctattgtcaacatatgatagacttaatggaccatatgattag

SEQ ID NO: 50655 - DNA, 582 bp, Glycine max
  Peptide Sequence Number=SeqID_142340
atgccgatctccccctgcgaaagtatcggttggtctgtgccatcccgacataggggtagcgcccacaagacacccggtggacccagaggaacccaacagggccctggggtttccagctctggttacgagcctctgtcagtcctacagggtgcctgtcctccccagcaagaatcgcacccacaaagacacctagtggacccggagaagtccaacagggccctggggtttccagctcgggttacgggcctttttcagttctacggagcgcttgtccccccagcaagttcatgccattgtgacatagggatcgtgcccgcaagacacccagtggacccgaagaagtccaacagggtcttggagttgccagctctgattacaggcctctgtcagttctatggagtgcttgtcgcccccagcaaggtcatcaggccccctactaatcgagctttcatcaagaagtactgcgtccccaggcaagcgcagggcgaaacaccacaacaacctagggatggccggcagcgggcaacaaatgcactgccaccacctctagagttcacctcagctgatccacaaaaaggttag

SEQ ID NO: 50656 - DNA, 316 bp, Glycine max
  Peptide Sequence Number=SeqID_142341
gatgttcctccagaaggaggttgcttctggaggaagcaacctggctcgcctgggtggcaagctcctcccctattttcctataaatagggggaggagtgaaggagaaaggggttcagcccttctgattttcaaccgttcttcgtcgttcgtcattcgttcttcgtcgttcttcggtctacaaccggttgcgacattaggcaagtttggaagtgatgattttcaccctctcgctaagctaatctgctggcttagcgagccatccgctgagcgtaacattcctcgactaagcgcgaggaagaatctggaagaaggataa

SEQ ID NO: 50657 - DNA, 411 bp, Glycine max
  Peptide Sequence Number=SeqID_142342
atggcctcttcaaattctctgtttcctgaaggaaattccatccattggccacctatcttcaatggtgagggttaccactattggaaaacccatatgcagtttttcattcaagccatagatttaaacatctgggaagcaatagaaataggaccctacatacccatcgtagtcgatgcaagtactagcaccacaacacaaaaacctagatgtagaagcaagcttcatgatgttgaatcaagattcattcaaggagttttgatgataacaaagatgatgacaaaaaccctaagagaatacaagagaatgatttcaagaacaagattcaagaatcaagagaagtttgatttcaagattcaagaaaagatgaattcaagattcaagaaaagaaatcaagaagacttcacaagggaa

SEQ ID NO: 50658 - DNA, 456 bp, Glycine max
  Peptide Sequence Number=SeqID_142343
atgctggtgcgcatgatccgcactcgtctctttgcagtggcacgggtgaaatcttgccttggtatgcatagtagctgcgtgatagcctccctctctggttgtgctcgcacaattggtcgcccttcaatatcaggggggcggaggaccttgagttctctgaaagtgaggatgcgtagccctctaaaagtgaggacacgtagccctctaaaggcgagggcgtgtagccctctgaagtttaggacatgtcgccctttgaaggcgagggtgtgcagccctctaaaggagaaggtgtgcagccctctgaaggtgaggacgtgcagccctctgaaggcaaggatgtgtagtcctctgaagtggaggacgtgcagtcctctaaaggcgaggacgtgtagtcctcagaaggtgagggcgaggacgtgttgtcctctgaaggccaggacgtgtagtcctttgaag

SEQ ID NO: 50659 - DNA, 450 bp, Glycine max
  Peptide Sequence Number=SeqID_142344
atgcctgagcggggcgaagctgaggaaactctgctggttccctccgaagtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggacgtggcggctga

SEQ ID NO: 50660 - DNA, 345 bp, Glycine max
  Peptide Sequence Number=SeqID_142345
ggtgagaatgtcaatccttaccctcggaagcaaaaaaagaagagaaggaaaatttccaatcaacgaaaaagagaaggaaaatttccaatcaaaggaaaaaagaaaggaaagaaaattcccaatcaaagagtgggagaaagcgaaaagaaaggaaataaaattccaagtcaaagaaaaaagagtgggagaaagcgaaaagaaaggaaagaaaattccaagtcaaagaaaaaagaatgggagaaagtaaaaaagaagaaagctcctggtcaaagaaaccagaagaaatgtgcagagaggtctttggaccggacaatgtctgaacaatacagaattgtcaccaaatga

SEQ ID NO: 50661 - DNA, 750 bp, Glycine max
  Peptide Sequence Number=SeqID_142346
atggctgagaagacaaagaaaaaactggaggaagctgctcaaaccagaagcactgcggccgtgattgaccctccatctcccatcagacagcacgtgaagtggaagatggcccgcaccaagaaaactggtcagatgacatctgaggcagcaaaggaaattgctgagaagattgcatcacagggctcctttgtcccccatggacgtcaggatgtccttactgctgccattgggcgaccaaaacaccctggtcgtgtgcgtgctgttggagccggtgtgaccatcaagaaatactttggattggcttcacagacctcacgcacttcttcctccatggctcccaaagaactagagcaactgactcaacaaatttgggaccagctggaggagtcgatcacagaaaaagtgactcagcagctgatgttatccttcagccagatgcagtcccagcttcagtcacagatgcaatcacagggacttgcactgcctccagagcctgaggttggtccctcaactgctcgtgtcagcacaaaggatagttgtgttgatccctcagggaacgatccagacacaggtgactcagacaaatgtgggttgtacatcaaagaaaatcctccctgcctagttgccctaggaagagtttatgagggatccataatcgttcacaacatacctttgctgcatgatcaagtgaaggtcgatgttgaggaggttaaagatgcagatgctcccgttcctgtacccactgacaag

SEQ ID NO: 50662 - DNA, 49 bp, Glycine max
  Peptide Sequence Number=SeqID_142347
atgcgtccagctcaagacgttaaagaagcgctactaggaggcaacccta

SEQ ID NO: 50663 - DNA, 219 bp, Glycine max
  Peptide Sequence Number=SeqID_142348
atgttaaccgataaaagcaaagaggaccgtttaaggcattggaccttgtcgcaatgtgcccttttgcgggtgagcgaggcgaggctcaccggtgtgctttccaaaggaggaaagatgcgcggagtcggcaccaacgtttatttgtggaaaacgtcagaaaaaccgaaggaaaccggtcaaaatgaaaattctaagttcgggagttgtatttatgcttga

SEQ ID NO: 50664 - DNA, 645 bp, Glycine max
  Peptide Sequence Number=SeqID_142349
gtactcatcaataatggttccaacttaaacgtgatgcccaaaagcactttggagaaattaccatttaatgcttcgtatctaaagccaagttccatggtagttcgtgccttcgacggcgcccgccgagagctgcctgttgggacgcccatggatccattcagtggaagtcgttccctctacactccatcagaaattgaagttcgtagtggaagggcatttggtcatcgtatcgggcgaggaagacatcttggtgagttgcccatgcccatcctctatgccatatatggaggccgcagaggagtcgttagaaaccgccttccaatctttcgaggtggtaagcatttcctccgtggactccttctctgggcaaccttgcctcccggaatgggcttaggcaaggacaacggcggcataactagcctgataagcgccaaaggaaatcatgggaagtttgggttaggctacaaacccacacaggcatatataaggaaaagcattgcgggaaggaaaaacggaggtcaaggctcgcgattaagacaagaagccaaaggaagcccgccctgccacataagtaggagctttataagcacgggtctaggggacgaaggccaagtcgttgcaatatgcgaagatgatgctccagtg

SEQ ID NO: 50665 - DNA, 243 bp, Glycine max
  Peptide Sequence Number=SeqID_142350
atggtccgcaaccatctgcttaaagaacttgccaatttctcagaagactatatcaagctctttggtggcacagaaatatttgaggaattaaggatgtcactacttgttgatgggttaatcaaggtgacaacggatgagtggatggatataacggacatgggacatgtttatttaaaagaacgttgtcccttaccgtctgcatcattgttatggtctagcaattgtcatccgcatgcgaagtag

SEQ ID NO: 50666 - DNA, 477 bp, Glycine max
  Peptide Sequence Number=SeqID_142351
atggaggactgcaaatctgttagcacaccaatgaatcaaaaggagaagttcagcaaggaagaagatgttgataacattgatgaaggatattgtgggagcttgattgaatgtctaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 50667 - DNA, 627 bp, Glycine max
  Peptide Sequence Number=SeqID_142352
atgggtgaagtagaggaggtgcaagagaagatgaaggctgacatggaggccatgaaagagcaaatggccacaatgatggaggccatgatgagcatgaagaagataatggaagccaatgcggttatagttgccgctactagcgctgtcgctaaggtgaacccgatgctcccatctggccttaagcaaatgaatcatccaacctcaaatatggtaggcaaagatttaggaagtacggatgaccccatgatgtgcaaattcaaaacaagcacgccttcccgccatatggcttgcctcccaaactatacaccacccaatgtggcgtacattcccaatgaggatgtcaataactccactcccatactcattaagagccaacaacctcaatctgatcatgcacatgtctctcgacccatgttggagacacatggaatgccccaccacaatctagccgacttcgagccttgcctcggatatgccactgaagggcaagcagttggtggtatacccttgaaaaacactttggagggccctcagtgtcacccacaaccacaaccctcacattccatagtggttaaaaaccctcatgctatggcagaaatgggaaagaggaaaggctcagggccatga

SEQ ID NO: 50668 - DNA, 141 bp, Glycine max
  Peptide Sequence Number=SeqID_142353
atggacacccgttttcgtgagattggtgatcctataaatggagttcaacgagggtggggtcaagaaccagtctttaaggattcacctagtgagtgtggtggtgggaccgccactgtgagatatgggctaatctctaagtga

SEQ ID NO: 50669 - DNA, 174 bp, Glycine max
  Peptide Sequence Number=SeqID_142354
atgatttcctttagaacatatgaaacgttcatgaaattccaagagggaaatgataaagggaaatcaatgaagatcctccagaagaagtcaaatccaatgatacttccaagagaatggaaagcttcaaagagggagatcatccccgatcgacaacattattggttatctcgataa

SEQ ID NO: 50670 - DNA, 354 bp, Glycine max
  Peptide Sequence Number=SeqID_142355
atgggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcacattctccataagtatgccaatgaggatgtctcactaggactagatgtggaccacataatgatggaagactctattgtg

SEQ ID NO: 50671 - DNA, 228 bp, Glycine max
  Peptide Sequence Number=SeqID_142356
atggaaagggaagaaagagagagggtgatagaatcattgcatgcagaagccatgaaatggatggataggttcgctttcactctgaatgggagtcaagagcttccgaggttgttagccagagccaaggcaatggcggatgtatattcagctcccgatgaagttcatgggcttttcgattattgccaacacatggtcaaactgatgtcccacacaattaggagccgttga

SEQ ID NO: 50672 - DNA, 274 bp, Glycine max
  Peptide Sequence Number=SeqID_142357
gtcgactctagaggatcccacctaaatgaccaagcagaggaaacactgggtccaacaaagataggagaaaatcactcaaagtgtatcaatctcacacaggactttttcttgggaatgaaagtcgctagcgcacaggattttgtcggcaatcaaagggagaggaccactttaggttgtgggcgaggattgacattctcaccctgggtcaaggtttatgataagttgggattttggctcaaggcttgtagaacggctggtcatgatatatgtcaag

SEQ ID NO: 50673 - DNA, 486 bp, Glycine max
  Peptide Sequence Number=SeqID_142358
atggcgcccactaggcaccctttggcccctgataagtccaacagggccctgggattccccgcactgatcacaggactctgccagtcgttcggagtccccgttgcacctaccaaggtgattcggccgcccatcacccgggcttttattgagaagtactgtacccagagacaggctcaaggtgatgctccacaggccgcaggcgcgcccccaccacctcatcaggctggccaggctggggcatttgacatggagcagtatttacgacatttgtaccagatgagccttagcatgcagagccagggcttcgcttctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttaggagggagtggagatacgtga

SEQ ID NO: 50674 - DNA, 1338 bp, Glycine max
  Peptide Sequence Number=SeqID_142359
atggatgtgttagctttgttaatttttggggtcgtcctctttccaaacgtggatggtttggtagacctagcagcaatcgacgctttccttgcctaccaccatagcaaggaaagtccggtggtagctgtcttggcagatctatttgacacatttgaccgaaggtgcgaaaagagtagcgcacggatcatctgttgcttacccgccctctgtgtttggttggtttcacacttgttccaacaagacacaagacatccatgtccgctcctgagccatcgctcgtgtactgaaaagaggagaatagattgggaccagctcttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccttgtgagggatttcggcgcacaaaattccaagactatacaaagaatccataaggtgtgggaaaccccgttaaagaaagatcaagagcttagaggcattcgtaatggcatcattggtgggtaccacgaatggctgaaagttcatatacgaggtttagattggctcgccaagttaaaagtcgtcagcaaagagagttttgaaagcaccggaagaggacgaggaagtccaagctctcaaaagcgaaaggagtgtgccggattacgggaagagaatgaaactaccgcaagagcccttgaacaagagaccaagaaggctcgcaaggaagagtatggccgtaacaaatttcgcggagctctatggggtagcaacaatgaactcaagcttcgaagggaagagagggaccagtcgcgagcacatagcatggttttgaaagaggagttagttgcctgttcaaggtccaaaagaagcttgtctcagcatttatgcgagacggagaccaacatgctagctatcatcgccaagtaccaagaagagttaggtctagccacggcccacgagcataggatcgcggacgagtatgcccaagtatacacggaaaaagaggctagaggaagggtgatcgactctttacaccaagaggcaaccatgtggatggatcagtttgctcttaccttgaacgggagtcaggaacttccccgattgttagccaaggccaaggcaatggcgaacacctactccaccccagaagaaattcatgggcttctcggctattgtcagcatatgatagacttaatggcccacataattagaaatcgctag

SEQ ID NO: 50675 - DNA, 522 bp, Glycine max
  Peptide Sequence Number=SeqID_142360
atgccaaaggtgaagctttttagaaatccaaaaaaatcagcacctcaaccacaatgtcatggacctctaacacaagctccaacacattttgttccagcaattaatcctaaaatttcttccccaccaagtgattccacacaagctcctgaagtcctaactggtaatgtccctctttctcatgtatcaacatctgaagttccacaagaagatgaaacaactagacgtcatgttgggcgtgagtctacacaatgttggactgttgaggcaatagactctgaagaaacgatcaagaagattaaggtgaaagttaggggagtcaatagcttacctagggagttacgcatcattgtgaattttgatgaccaaggccaagcaattggtgaagcacaagccttgcttgcaggatttcttggaacactagcagctgattgcaaattatttcctatggattatgatagatggtctggaccttcaggcgtacctaaagcttattttgatgattgctttgaaacaattttaaag

SEQ ID NO: 50676 - DNA, 831 bp, Glycine max
  Peptide Sequence Number=SeqID_142361
atggaggtacttatggcagaacgggccaatctagtctttcacaataaagtgataggtggaactgccattaaacgacttattagcagattaatagatcactttggaatggcatatacatcacatatcctggatcaagtaaagactctgggattccgtcaagctacggatacatccatttcattaggaattgatgaccttttaacaataccttctaaaggatggctagtccaagatgctgaacaacaaagttttattttggaacaacatcatcattatgggaatgtacatgcagtagaaaaattacgccaatccattgagatatggtatgctacaagtgaatattttcgacaagaaatgaatcctaattttaggatgaccgacccctttaatccagtccatataatgtccttttcgggagctagaggaaatgcgtctcaaatactgctgtacgaacatcagatgctggatatcttacacgcagacttgttgaagttggttcaacacattgtgtacgtcgaacggattgtgacgatatatacagaggttcacgatgcatttgccgttagaaatcaagatattggaattggacttatcaatcgatttaaaacccttcaaacccaaccaatatctatccgaactccctttacctgtaggaatacatcttggatctgtcgattgtgttatggccaaagtcctactcatggtcacttggtggaattaggagaagctgtaggtattattgcgggccaatccattggagaaccgggcactcaactaacattaagaacttttcatactggcggagtcttcactggaggtactgcagaacag

SEQ ID NO: 50677 - DNA, 537 bp, Glycine max
  Peptide Sequence Number=SeqID_142362
atgagtcatcattcatctaatgttaatggcgagggtactagtcataaagaccctttatctagaatcttagatgagttgagttccctcaagttatggaaagaaaaacaagagagaaaagaaaaagcaaaaaaaagagtggaagaaataagtcaagatgaaagaaagaaaataagagaggaagaaagaagaaaaataatgaaagaaatgaaaagagaaaaacatgcctcctatagtagtcataactcttgcaagagcgtaagtgaagaacacgtgactattacgaaggaaggcatatgtcacatcttagacctcactcccatagaagagaaaaggaaagaaagcctcaagaggctaacattaacggggtcgtacttccatgggaaggacaatgtcgaggctaacttagattgggaaataagggtagagcaacaacttaaaaagaagtctacttcaaaatcttatggctctcactcttatccaaagaaagaccaaggtcaaggcatcttaggggtgacaccttctaagcccaaaagatga

SEQ ID NO: 50678 - DNA, 303 bp, Glycine max
  Peptide Sequence Number=SeqID_142363
atgtggtcatctgcgccctttccggagatgtcatcatcttccgatggagacttttcaagtctcacaagttatctagaactacgtagaggcggcaggcccgatgatacgcggagataccttacggttatccgcacccttttgtcatccagaggcggcgggcccgatgacagcagagacacaaatttggtcttctgcacccttgtgtcatccagaggcggcgggcccgatgatacgcggagtcatttacggtatccgcaattttgtcatcccgcgactctcgtcaaccgagaggaacgaaattag

SEQ ID NO: 50679 - DNA, 140 bp, Glycine max
  Peptide Sequence Number=SeqID_142364
aactttacggattgcgcaataatgttctttcaactcctaacatgtcgcgaaacttcacggattgcctaacgatgagcgtcaaggatctcgaagtgatcaagagagggtcgcatcccaacaaacagatggtccccgaatga

SEQ ID NO: 50680 - DNA, 570 bp, Glycine max
  Peptide Sequence Number=SeqID_142365
atgagtcatcattcatctagtgttaatggcaagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaaataagagaggaagaaagaagaaaaataatgaaagaaatgaaaagagaaaaacatgcctactatagtagtcataactcttgcaaaagcctaagtgaagaacttcgtgactattacgaaggaaggcataggtcacatcttagacctcactcccatagaagagaaaaggaaagaaagcctcaagaggctaacattaaactctcatacttccatgggaaggacaatgtagaggctaacttagattgggaaataagggtagagcaacaacttaaaaagaagtctacttcaaaatcttatggctctcactcttatccaaagaaagaccaaggtcaagacatcttaggggtgacaccttctaagcctaaagatgataaggggaagacaatagaaaagcaagctctctaa

SEQ ID NO: 50681 - DNA, 366 bp, Glycine max
  Peptide Sequence Number=SeqID_142366
atggcagaacaagcgaaacaagtatttgatgtcgaagacccttgtgatcaaaggtgccaaatgggtacacaaccaaactctcctccgcctcctcctccttctactggtgtagcatcgcattcgtcgtcaccaccattgaagcggactagaaaggcctcatgcctaagatcattggcgactagaccaattggggcagagggaccccttgtccatgtggatcctgttactggcaaagtagatgttctccacaacaagaaatttagaacatatttagggatcgttgctcgtgataaggtggatgtcacatacgaaaattggaagcatgtccctattactcagaaggatttgatatgggaggatattcag

SEQ ID NO: 50682 - DNA, 261 bp, Glycine max
  Peptide Sequence Number=SeqID_142367
atgaccataatttgtctccgcaggtcatcgggctctccacctatggaggataaaaaggcacaaaatgaccacaatttgtctctgcgtgccatcggacacgatcgtctccggatggcaaaaaggtgcagaataaccataatttgtcttcgcatgtcatcggggttaccgcctctggatgacaaaatgcgtacaattaccataatttgtctctgcgtgccatcggacttgatcgtctccggatggcgaaaaggtgcggaatga

SEQ ID NO: 50683 - DNA, 207 bp, Glycine max
  Peptide Sequence Number=SeqID_142368
atgggtgaagtagaggaggtacaagggaagatgaaggccgacatggaggccatgaaagagaaaatggccacgatgatggccatgatgagcatgaggaagataatggaagccaatgcggttacatttgccgctaccagcactgttgctaaggtgaacccgataaccccatctggcctcaaccaaatgaatcatccaaccttagatatg

SEQ ID NO: 50684 - DNA, 420 bp, Glycine max
  Peptide Sequence Number=SeqID_142369
atggggtcctatggtggtcacagctcgaccggagagggtgctacgacagtttggttacatttagagcatccctctgccgcctatgacaggtggatgcatttcgcggaccacgtactagctgtgggtgagctttgtctagtgcctgggcaggtatctgcggattacatggagtggttttttcggatatctcacccattcgtgataccgacccaggcaggtgaccagcccagagatgcacctgccgcagaccctgaggagtacatgcagccgcccagcccccaggttccagtggcatttgacccccctccacatgcagtggatgattacgacggctatgaggcgattgcacagaggttggagcgtgtgcttaaccttaggatagtcactgcaggcacagagttatatgatattatccattag

SEQ ID NO: 50685 - DNA, 447 bp, Glycine max
  Peptide Sequence Number=SeqID_142370
atgccgtatacccggaagggcatcacggcaacgccttttttactgtcgcgttatcccattgaacattatgagaatcggggggggggggtcgatggtgcggaaaagcgcggcgtgctctactgccgcattgtgccgccgatgaccggaaaagcgattcatgtgatgtgcgtacatctgggcctgcgtgaggcgcaccgtcaggcgcagcttgcgatgctcgccgaatgggtgaatgagctaccggacggcgaaccggccggactggatgagatttttacccgcgcccacggacgcccggcgcgcacgtttccggtgcaatttcctctactacgactggacaggatctacgtcaaaaatgccagcgccagcgcgccaaccgcgttgccgctgcggacatggcgacacctttctgatcatgcccctttaagtgcggagattcatttatga

SEQ ID NO: 50686 - DNA, 360 bp, Glycine max
  Peptide Sequence Number=SeqID_142371
atgcctcctaaagacctagaacagctgacccaacaaatcagagaccaattggaggagtcaatcacagaaaaagtgactcgaaagatgatggcatccttcagccagatgcagtcccagtttcagtttcagatgcaatcacagggacttgcactacctccagagccagagtgtaatagacaaaaaggaatcactgaatgtggctactacgtgatgcactggatgtccacgataatcttaggatctttcaggaataattgggagacgtattttaatgaagttagaccattggaagcagcgagattcaaggcgcttcgcatccagtgggcacagtattatctaaaagttagaaatcaaacatag

SEQ ID NO: 50687 - DNA, 72 bp, Glycine max
  Peptide Sequence Number=SeqID_142372
atgaagatgtctagaaaattcagtaaaaagttcagctcaaaattcaaagtattcaagccatggtggagttaa

SEQ ID NO: 50688 - DNA, 441 bp, Glycine max
  Peptide Sequence Number=SeqID_142373
accaacgcggagaccaattacggtcaggttcgcgacagttccggccgtacgtcctggatcccgctgaaagagctgagcaccgtgccaagcctgcgcacccgcgtgccggatctggaaaaccaggtaaaaaccctgaccgacaagctgaacaacatcgacggcacctggaaccagcgcaccgctgaaatgcagcagaaagtggcgcagagcgacggggtgattaatggtctgaaagaagagaaccagaaactgaaaaacgagctgattgtcgcgcagaagaaagtgaatgccgccaatctgcagctcgatgacaaacagcgcaccatcatcatgcagtggtttatgtatggcggcggcgtgctgggcgtgggtctggtgctgggtctggttctgccgcatctgatcccaagccgtaagcgtaaagaccgctggatgaactaa

SEQ ID NO: 50689 - DNA, 219 bp, Glycine max
  Peptide Sequence Number=SeqID_142374
atggcgctcggagtcgccaccaaggtttattcgcggaaaacgtcggaaaaatcggaaaggtgtggtctacgaacattaagcgtgaaaggttcgggagttgtatttacgcacggggaaggtattggcaccccacgcgtccgtcacaagagacggctttttagaaatctacacttaaccaataaaagcggaaaagaccatttcaaggcgttggacctttga

SEQ ID NO: 50690 - DNA, 117 bp, Glycine max
  Peptide Sequence Number=SeqID_142375
atggaggttgatgaaccttggttggggttatggctaacattgaattatcaagtagatatgggagcaagtggtgttcgtcattggaagtgcgatagacaggctttgtggttgatttag

SEQ ID NO: 50691 - DNA, 1023 bp, Glycine max
  Peptide Sequence Number=SeqID_142376
atgtctattgagaaagtggtttaccgcgctcacgccaccgcaaccggcggccgcgacggccgtgcgacctcctccgacggcgtgttggacgtgaaactgggcgtgccgagagagatgggcggcgccggcggcgaagtcaccaaccccgagcagctgtttgccgccggttactcggcctgcttcctcggcgcgttgaagtttgtcgcggcgaaagaaaaggtcaaaatcccggccgaagcgaagatcgacggcaccgtcggcatcggtgaaatcccgaacggcttcggcatcgaagtgcagctggatatctcgctgccgggcatcgagcgcagcgtggcggaggatttggtgaaaaaggcgcacgtggtgtgcccatactccaacgccacccgcggaaatatcgatgtgactctgaacgttaaaaccgctacaccgtccccggagccaccgcgttacatgaacaaagttaaatcgctatcacagcagaatttatcgttattgttagcgatctatatcggcatatttctcaaccttcatcgctatcgtcctgttcacgttcttcatcatgcggctggtatcgctcggcggccggctgttttatcgcatcgtcgcttcgctgctggtgttgatttcggttgccgccagctactacatgacgtttttcaacgtggtgatcggctacggcatcgtggtttcggtgatgaccaccgacatcgatctgtcgaaagaggtggtcggcctgcacttcgtgctgtggatggtggcgctcagcgccttgccgctgctgctgatctggaaaaacagcctgcgttacaccctgatagaacagctgaaaacccccggtcatcgcatcaagccgctgctggtcttgctggcggtggtggcgctggtctggctgccgctgcgcatgctggacgacgagcagagcgtgcaagagaagctctccaacgtcgatctgccgagctacggcggcgtggtggcgcactcgtatctgccgtccaactggctgtcggcgctggggct

SEQ ID NO: 50692 - DNA, 51 bp, Glycine max
  Peptide Sequence Number=SeqID_142377
cgcacccgtgagcctcgccctcgctcgcccgcgaagggcacgttgcgacag

SEQ ID NO: 50693 - DNA, 1026 bp, Glycine max
  Peptide Sequence Number=SeqID_142378
atggtgactcccatggccaagtttgatcctgagatagtcctagagttctatgctaacgcttggcccacgaaagagggagttcgggacatgcgttcgtgggggaggggtcagtggattccctttgacgcagatgccctcagccagttcctaggtgacccactagttttggaggaagggcagttgtgtgagttcaaccagaggaggaatagggctgacgggttcgacgaggaagccattgcccacctgtcatgcacaccggggcaggatttcgcctggaccactacagggaggcgggtgcgaatcatgcgcaccagcatgaccactttgacccagacgtggatgacactgctgctaagtaatgtcttgcctagcgatcataactccaatctccctctgcctaagtgccagttggtgtatgccattctgacacggatgagcgtcctcgtgacccaggtgattgttgacgccatttatttgtttgcagatatggcacccaccaggcaccctctggacccagataagtccaacagagccctggggtttccagcgttgatcacgggcctctgccagtcctacggagttcccgtcacccccagtaaagtaatccgactgccgatcacccgagccttcattgagaagtattgcacgcctaggcagacgcagggtgatgcacatcaggccgcagacgcaccaccaccacctcggcaggctgatccagctgggtcactaggcatggagcgttatctacagcatttggttcgccagcaggcggccaaccaccatgggcaggtgcagatacatgagtgtctctaccggttcagcctcagtcagcaggggcagggttccaccccttttttatgccctaccctggaacagtttggggctgaggttgcatggcctggagactggcccgatgcccagtcaggagaggagcctgcaggatcccccggtgaggcaaaggagtcccgtatggatgaagatatgactgacttgctcgatttcttgggaggaagcggagccatgtga

SEQ ID NO: 50694 - DNA, 573 bp, Glycine max
  Peptide Sequence Number=SeqID_142379
atggctgcccacaaggttaaactttctggaaagcctggaccattatgtccagtgcagtataaaagactagaaaaagaatttcattttgctaatcaatggactcccatttggtgtggtgataacatgggcctgagatgtgaggtccacatgtgggggaataaggttgagtccaaggaccacaatattgggcccagacacagtatacacaaccctgttccaccacataaaagggtccaaagaggaaggccaaagaaaaatagaaggagatctgtagatgaggacaatgtcacaggacataagctaaagaggaaattggttgagtttacatgtggaaggtgtggccaaaccaatcataacattagaaatgaacaagctttgaatgaggctgaagaagttgctgctcatgttcaacaagatccggtggagattaatttatctcagcctcatttgtcacaagatagtgacatggagttgatggtccctgcaactattgttccaccaatagcaaggaataagctaaccataacaagagccaaacaaaggaaggttgctgataaagatgatgcagtataa

SEQ ID NO: 50695 - DNA, 366 bp, Glycine max
  Peptide Sequence Number=SeqID_142380
gtgtcgtcccttgtgacggacgtgtggggtgctaatactttccccgcgcgtaaatacaactcccgaacctttcacttaaaagttcgtagatcacgtcttttccggtttatccgacgttttcctcaaataaacgttggtggcgactccgcgcgtattcctttcatggaacacgcatcccgcgagtcacgcgtcgccctcccgccgaagggtaggagcagcatcatcttaggcgatggtcaaataccgagccaaatccaaagacagagacaaatcgagggatggacgcgagtagaggctaggcccatgatcgatggatcgtcgtcccatgtcaagctccggacaagcgggaagtgctgctgggagtga

SEQ ID NO: 50696 - DNA, 156 bp, Glycine max
  Peptide Sequence Number=SeqID_142381
atgaccaaacttggtctctgcttgtcatcgggcccgccacctctggatgacaaaaggggtcagtatgcgttcatcgggcccgcgcctgacaaaagcaaggctcttgctcctacgtatcctccaatgaggaactcagacctacgtagttctagataa

SEQ ID NO: 50697 - DNA, 270 bp, Glycine max
  Peptide Sequence Number=SeqID_142382
atggaggttgaggtttttgattgttggggtattgacttcatgggtcctttcccctcatctgatgttgtggctactccaaggaatgatgctaagattgtgcggaaggcaaaggagaagaggagaggggaggcaccatccactagggaatacgccaaggaagaaggagcttcaccaccaagaattgccttggataagaagcttgaagaggatgctttaatggaggaaaagaaagagagaaggggggagcacgaaattgaaggaataaaatag

SEQ ID NO: 50698 - DNA, 394 bp, Glycine max
  Peptide Sequence Number=SeqID_142383
tatctcagaaaggaagaacagaggccaaggctcgcggttggggcaacaagccgaaggggccccaccctgccacatcagtagaagctttataagtgcgggtctaagatacgacggccaagtcgccacgatatgcgaggatgactccccgaggaggtcggatttggtacggtcatgtcctcctggttttggactaggaaattggcgagtagaggagcgcccagacttttacgcgacaagcataatatccgatgacaagtccctcgaaggtactaatacccgggacccggccgttgattttgagcaagaagcgggtcgaatgaagagtgaagaggacgaggatgtgggacttcccccaaagctggagaggataatcgctcaggaagaccgaaaatga

SEQ ID NO: 50699 - DNA, 402 bp, Glycine max
  Peptide Sequence Number=SeqID_142384
atgttggcaactagaacacgagggttgcgctcgttgcgggacttaacccaacaccttacggacgagctgacgacagcgatgcccgcgttcccgggcattcccctctctttcagcctacggggattcgcggcatgtcaccctggtaaggactactggggtatctacccattcgctccccagctcgtctctcagtgtaagtcggcccacagagtgctttcgccttggtgttctttccatctctacgcattcaccgctccaaatagaaaaaccggaaattccctctgcccaccagtactccagcttgagttttccaccgcctgccatcgggttgagccctgggatttgacggcgaacttaaaaaagccacctacagacgctttacgcccaatcattccgggataa

SEQ ID NO: 50700 - DNA, 270 bp, Glycine max
  misc_feature (17)..(17): n is a, c, g, or t
  Peptide Sequence Number=SeqID_142385
atgaaacacagctccanactcgaaagtggaggacacattgtcgcaacctacccttcggcgggagggcgacgcgtgactcgcgggatgcctgttccacgaaaggaatacgtgcggagtcgccgccaacgtttatttgaggaaaacgtcggaaaaaccggaaaagacgcgatctacgaacttttaagtgaaaggctcgggagttgtatttatgcacctggaagggtgtttccctttgctcctacgtattcctcaattgtgatgaggaaataa

SEQ ID NO: 50701 - DNA, 418 bp, Glycine max
  Peptide Sequence Number=SeqID_142386
cacagcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 50702 - DNA, 186 bp, Glycine max
  Peptide Sequence Number=SeqID_142387
atggttgttgaagtattggcgatcaaaatttctattcctgcgaatatagggtcgaaccaagcgcagtcttttaagaaaatgattttatcaagtcaaggtcaaagtatggaagtaaccagcttgcgaaagttggggcagaagatggatcaagttttcatatcttctttgactactgccaacacatga

SEQ ID NO: 50703 - DNA, 336 bp, Glycine max
  Peptide Sequence Number=SeqID_142388
ccattcgttcaagtcaagcgttcctttgcaattggtgctggtgctgtgacttcctttggttaccgtaaggatcggaatggtcaatggctgaagaaagacgcactccctcctcaagatgagcgtactccttcacctcctcctcagcgtgaagattcagctctcctgaatgaagttcttaccgaattacgaggtcttcgttcttatgttggtgaacatttcgactcattggatacacgctttgcgggcatggatattcgcctcacacaagttgaagaagatgtctccttcatccgtacttgctttgatccaccaccaccgcctccatcatcctcttag

SEQ ID NO: 50704 - DNA, 156 bp, Glycine max
  Peptide Sequence Number=SeqID_142389
atgtcgcggaacttcacggattgcgtaacgatgggtgtcaagtacctcgaagtggtcaagcaagggtcgcaccccaacaaacagatgatccccggacgaaattatggtatgacaattgcccctctttacttgtcttttattggagataaacaggaa

SEQ ID NO: 50705 - DNA, 201 bp, Glycine max
  Peptide Sequence Number=SeqID_142390
atggcttcctatggtgtggcatctccattcatctttctccttctccattccgctgcaatcagacctcaagaagcaaagaaatccattgatgaagaagatccaaggcctacaagattcacatggagctacattagaagtcatctagcagctttggagcaaataccgagaaaaatcccaatgaagaatgcaaagctgttatga

SEQ ID NO: 50706 - DNA, 279 bp, Glycine max
  Peptide Sequence Number=SeqID_142391
atggttgaggaggagcctcagttgtttgttgtcttggttgtgactgctgttgttgtattggaggaggaacatatggcttgcttggaccagcagcattctaaaaaggagggacaggctgttgttgttgtggaggacttgtccatctcagatttggatgattcctccaacctggattgtatctattgcttgaaaggccataattattctgttgttgttgattttgctgttgaggaggtctattataaatgtttgcaacataagcttcagattgctcattga

SEQ ID NO: 50707 - DNA, 210 bp, Glycine max
  Peptide Sequence Number=SeqID_142392
atgaagaataagaaggttgatgtggctggtgtctcactaagcgaggcactcagcgcgcttagcgagttgggagaatctggaggagaatctgtcaagcatctgcacgtttggcgcatcatcagcttgctcagcgagtcgtttgttttctctcgcgctaagcgcgcccattggaaaatcacttactcgtgcttagtgcgaaaatggcgttaa

SEQ ID NO: 50708 - DNA, 297 bp, Glycine max
  Peptide Sequence Number=SeqID_142393
atggtccatgacatattcgtcaaggtgaaactggaagtaacagggacatcagcagccctaaatgtgtttggcagtagacgaagcaacgatatggttacttccatacttcaacttgactcgatgaatcttttcgtaaaagcacgagcttggttcaatcccataacccagggaatggaaattttgatcgccaatacttcatcaacatttcatagggatgaaagactcgggaatacgcatgcagtgcatggaaaatgtaattatgagattgagatgcccgaagagacatccttaagttaa

SEQ ID NO: 50709 - DNA, 467 bp, Glycine max
  Peptide Sequence Number=SeqID_142394
atggggcagctccagcggcaagcttttcgtaaagcttacggtaaaatctgggacctagccatggtagaagtctccacagaggccattgcctccctcgcccagtattatgatcagccattgaggtgcttcatctttggggacttccagctatcaccaatggtggaagaatttgaagagatcctaggatgtcctctagggggaaggaaaccatacctcttctcagggttctacccctcattggccagaatttttaaaatagtccaaatctcggcgcatgaattagacccaaaagcaagtcgaaaatggggtgacattctcgcactgttgatcttcggaggagtcctctttccaaatgtggatgggttggtggacctagtagcgatcgacgcttttctcgcctatcataaccacaaggaaagcccggttgtcgctatgctagccgacctatatgacaccttcgaccgaag

SEQ ID NO: 50710 - DNA, 211 bp, Glycine max
  Peptide Sequence Number=SeqID_142395
tgaaaagatgaagaataagaaggttgttgtggctggtgtctcgctaagcgaagcttgtgcgcttagcgagaatcatccgctaagcgaggcacttagcccgcttagcaagttaggagaatctgccaagcatctgcgcgctcagcgcataatcagctcgctcagcaagtcatttgtcttctctcgcgctaagcgcgcccagcttgctcagtga

SEQ ID NO: 50711 - DNA, 744 bp, Glycine max
  Peptide Sequence Number=SeqID_142396
atgggtgatcaagaggagacacaggaacagatgaaagccgacgtgtcggctctgaaagaacaaatggcttccatgatggaggccatgttaggaatgaggcaactcatggagaaaaacgtggctaccgctgccgctgttagttcggctgccgaagcagacccaactctcttagtcaccgcgcaccatcctcccccaaatgcggtaggacgaggaaggagcacactggggcacaacaacaacccccatttgggatacaaccgggcggcttacccttgtcgattaccgcctaattacacgccgccaatcatgcatgatgatgcggatcaccgagaatatgcccaaggagatgtcgatttctaccccccaatccctgtcaaggggccggcacccaacacattgcctcatcccaacctcacagcacaaccaatattcttgtccacagaaggaccacccccgacggccgaagaaaaaaggaaactcgatctcctcgaggaaagattgagagcttttgaaggcttcggtgactatccgttcgtagacatgacggatctttgcttggtatcagatgtcgtcatccccccaaaattcaaagtgcccatctttgacaacttggcgagagtcgcggttgtttggtacactaatctggaagcttcccgcatccttacttggaaggacctgattactgctttcctaaggcaatatcagtacaattccgatatggcccccgatcgcactcagctatag

SEQ ID NO: 50712 - DNA, 639 bp, Glycine max
  Peptide Sequence Number=SeqID_142397
atggctgtcgctgccaacaaacgttcggtaatgacgctgttttctggtcctactgacatctatagccatcaggtccgcatcgtgctggccgaaaaaggtgtcagttttgagatagagcacgtggagaaggataacccgcctcaggatctgattgacctcaacccgaatcaaagcgtcccgacgctggtggatcgtgagctcactctgtgggaatcccgcatcattatggaatacctggatgagcgtttcccgcatccgccgctaatgccggtttacccggtggcgcgtggtgaaagccgtctgtacatgcaacgtatcgagaaagactggtattcgctgatgaataccatccagaccggtaccgcggcccaggctgatgccgctcgtaagcaactgcgtgaagaactgcaggcgattgcgccggtctttactcagaagccttacttcctgagcgacgaattcagcctggtcgattgctacctggctccgctgctgtggcgtttgccggttctcggcgtagaactggtgggtgctggcgcgaaagagcttaagggctatatgactcgcgtcttcgaacgtgattctttcctcgcttctttaactgaagccgagcgtgaaatgcgcctcggccggggctaa

SEQ ID NO: 50713 - DNA, 519 bp, Glycine max
  Peptide Sequence Number=SeqID_142398
atgggtgaagtagaggaggtacaaaagcagatgaaggccgacatggaggccatgaaaaagcaaatggccacaatgatggaggccatgatgagcatgaagaaaataatggaagctaatgcggttgcaattgctgctaccagcgctgttgctaaggtgaaaccgatgcccccatctggcctcaaccaaatgaatcatccaacctcagctatggtaggcaaagatttgggaagtacgagcggcccctattatgtgcaaattcaaaacaagcacgccttcccaccatatggcttgcctcccaactatacaccaccccaatgtggcatatactcccaatatgcaattgaagggcaagcagttggtggtatacccctgcaaaacactttggagggccctcagtatcacccacagccacacaactcacattccacaacggttaaaaaccctcatgctatggcagaaatgggaaagttggatcatctagaggaaaggctcagggccattaaagaaggcgaagattaa

SEQ ID NO: 50714 - DNA, 666 bp, Glycine max
  Peptide Sequence Number=SeqID_142399
atgccaacaattataatcagcagcaggtacaatggaggagccccccctggaaatcagttcaatagagatcaaggtggaccattcataaggccacaacaacaagtgcctagtctctatgaccgtacaacgaagctggaagagactctagctcaatttatgcaggtttctatgtctaatcagaagagcaaagagtccgccataaagaatcttgaggtccaagtgggacaacttgcaaaccaactggcagatagatcatcaagtagttttacagctaatgcagagaaaaatcccaaggaggaatgtaaagctgtgatgactagaagtagaatggcaatccaaggagatgatagtgaagctagaaagaagatggaggaacataaacaacagctggcacctaagccagcacttgaacctatttctgattttgtagaacttgaagagattaatgaggagactgaagatgacaaggaagaagagacaccaataaaagtggaagaaaaagaaagaataaaagaagaagaaaaagaaaaagaaaaaaagttgaaaaatgaaaaacaaaaatggaaagttgttgatgatgagatgaggaaaggcaggagtgaggcaaacaccgacaagaagaaggatactactccaaatgaaggcaaggaagtaccttatcctttg

SEQ ID NO: 50715 - DNA, 945 bp, Glycine max
  Peptide Sequence Number=SeqID_142400
gactacacgtccctcaccttaagagggctacacgccctcgccttcagagggctacatttccacgccttcagaggattacatgtcttcaccatcagaggactacacgtcctcgccatcagaaggctgcatgccctcgccgttagagggctacatatcctcaccatcagagggctacacgtcctcgccttcagaggactacacgtcctcgccttcaaaggactgcatgtcctcgtcttcatagaactacacgtcctcgccttcagaggaacacacatcctcgtcatcagaggactacacgactacacgtcctcatctttagaggttctacacgccctcgccttcagaggactacacgtccacgccatcacaaaactacacgtcctcgccatcagagggctgcatggcgtcgccttcagagggaaacatgtcctcaccatcataggactacacgtcctcgcattcacaggactacacgtcctcgccttcagaggactacacatcctcgtcatcagaagactacacgtcctcgccatcagagggctacacgtcctcaccttcataggactacacgttctcacctatacacgcctacacaccctcgccttcaaaggactacacgtcctcgccttcagaggacttcacgtcctcgcctttagaggacttcacgtcctcaccttcagaggactgcacctcctcatcttaagaggactgcacctccctaccttcagagggctgcacgccctcgccattagagggctacacgccctcgccatcagagggcagcacgccctaaccttcagaggactacacgtcctcaccttcagaggactgcacgtccttgccttcagaggactacctgtccacaccttcagagggctgcacgtcatccccttcagaggactacacgtcctcgccttcagaggactacacgtcctcaccttctga

SEQ ID NO: 50716 - DNA, 297 bp, Glycine max
  Peptide Sequence Number=SeqID_142401
atgggttccactgcagcggacactggcagatggtgtgctatcaagggtcttgatgatgctccacagcctaaatcaaaggcttctgctaggtggattgtcgtcaagtgtaatagacaaaaaggaagtactgagtgcggctactatgtgatgcactggatgtccaccatcattttaggaacttttaagaataattgggaagcgtattttaacgatcctagaccattagagacagagagattaaaagcattgcggatccagtgggcacaattttatctccgagttagagttcaggcctag

SEQ ID NO: 50717 - DNA, 651 bp, Glycine max
  Peptide Sequence Number=SeqID_142402
atgggaacaaggggttgtattaattatagtcccgttctcgccataagacagcttggctaccccatgagaggagcgccattagacgaaagcatcgcgcctttcatcgcacgaggtttcagtgaccacaacgcgagggtactccaaggagttcacaaggcatgggatgcggcgttaagaaaggacagagagcttaggggaagcagtaatgggatcatcggcggctatcataagtggctgagagtccgaactcaaggattggattggctcccaaatctaaagactgtgagggacgatgaggttaaagcttcggaagaaagtgatgaggtacaagccctaaaggcagagcttgaaagagcccgagtagtcgaagagaagttcaagtccatagccatcaaaggcagcagtagtaagctcaagctccgaagaggttttttttattcatcacgggtcaaaggcatgatcttgaaggacgagctaaaggcttaccttaggtcgaaaagaaatttgtcccaacagttaagcgagactgaagggaatatgtgggccatcatcgatgagtgcaaagagaagctaaatctagcggcgactcatgagcaaaggctagaggatgagtacgccaagatatcagcagaaagcgaagcaagggagagg

SEQ ID NO: 50718 - DNA, 423 bp, Glycine max
  Peptide Sequence Number=SeqID_142403
atggtgggttacataccttcaagctttgccgatttagtgttctctggcggaaggatcgaagtgggtctgagaagaggcaaatttgattatcctgctttgatgaataggaagcctggggcaaatggagataagaaggatggaggaactcatgttgtgactgtcgttcctacatggccaaatttcccaacagctcaacaatatcaatactcagccaatatcaacccttctcattacccaccaccctatcagccaagaacacccaatcatccacaaaggccacccctaaatcagccacaaaacctgcctgctgcacattcgataccaaacaccacccttaacatgaaccaaaaacaccaaccagggaaggaattttccaaaaaagaagcctgtataattcaccccaattctggtgtcgtatgctaa

SEQ ID NO: 50719 - DNA, 171 bp, Glycine max
  Peptide Sequence Number=SeqID_142404
atggttgatgaggaggatattaaagacccatcactagacccagacatcctagattctgaccaaggggaggaagtaatcgatttccagctatcaccacaactaaggacaaatgtactctatgcagtagcaacaatggactcgaaagtctggatattgtactctagagactag

SEQ ID NO: 50720 - DNA, 842 bp, Glycine max
  Peptide Sequence Number=SeqID_142405
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggtcacatcctatcctgaaattaaagtcccatcctctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50721 - DNA, 761 bp, Glycine max
  Peptide Sequence Number=SeqID_142406
cctcgaatcccgagtattacgttgcacatgatggatccaagcaagaggtcagcctgctgccaatccctgcagacggagcaaccctcaaaacgtgcccttcagagcgcatcgacctcgggctggaagaaagttttcgaaagaaagggtgttttgttagaatcttcaaaccgaatccagcgaaagcgagcgtgaatcagcagcctgtgattcccgaacttgaacctccgcttctcgatgacaacacccggcgagcagagctcgctgttcgattgagggcgaattggtgggggatcgcttataacgagcgaatcctcgactccttcgtccggagtcaacttgcaatcgaaaggcacatagaggccgcacttgtggcggacggatattccccgcaagtagtctttgaaagaagacatatgattcgtggctttcttttctatccggaggggcatgcgctgagtgaaaacgcttacgcggccggcaaaatgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccctaccgtcgtaaaataagagcacctggctctgcccattcacaaggactcgattctatgtccaaacatcacatgccagcagatgtggtcaccatcataggtactcaagatattgtgtctggagag

SEQ ID NO: 50722 - DNA, 1556 bp, Glycine max
  Peptide Sequence Number=SeqID_142407
atgcgtactagccaatatctgctctccacattgaaggagacacctgccgacgccgaagtgatcagccaccagctgatgctgcgcgccgggatgatccgcaagctggcctccggtctttacacctggctgccgaccggcctgcgcgttctgaaaaaggttgaaaacatcgttcgcgaagaaatgaacaatgctaacgcgatcgaagtgtccatgccggtggttcagcctgccgatctgtggcaggaaagcggccgttgggagcaatacggccccgagctgctgcgcttcgtcgaccgcggcgatcgtccgttcgtgctgggcccgacgcatgaagaagtgatcaccgatctgatccgcaacgagatcagctcgtacaaacagctgccgctgaacttcttccagatccagaccaagttccgtgatgaagtgcgcccgcgtttcggcgtaatgcgttcccgtgagttcctgatgaaggatgcctactccttccatacctcgcaggagtctctgcaagagacttacgacgcgatgtacgaagcgtacagcaaaatcttcagccgcatgggcctggatttccgcccggtgcaggccgataccggctcgatcggcggcagcgcctcgcacgaattccaggtgctggcagacagcggtgaagacgatatcgtgttctccaccggttccgacttcgccgccaacatcgagctggcggaagcggtcgcgccggcggcgcctcgcgcggcggccggcgaagaattgcgtctggtggatacgccgaacgccaaaaccatcgttgagctggtcgatcagttccagctgccggtggaaaaaaccgtgaagacgctgatggtacgcgccaccgaagagagcggccacaagctggttgccctgctggtgcgcggcgatcacgagctgaacgaagtcaaggccgagaagctggcgcaggttgccacgccgctgaccttcgccactgaagaagaaattcgcgccatcgtcggcgccggcccgggttcactcggcccggtcaacctgccgatgccggtggtagccgaccgcagcgtggcggcgatgagcgactttggcgccggcgccaacgtcgacggcaaacactacttcggcatcaactgggagcgcgatctgccgctgccgcaggtggccgatatccgtaacgtggtggacggcgacgccagcccggacggtcagggcacgctgctgatcaaacgcggcatcgaagtgggccatatcttccagctcggcaccaagtactcggaagcgatgaaagcgaccgtgcagggcgaagacggccgcaaccaggtgctgaccatgggttgctacggcatcggggtcacgcgcgtcgtggccgccgccatcgagcagaaccacgacgaacgcggcatcatctggccggacgccattgcaccgttccaggtcgctatcctgccgatgaacatgcacaagtcgttccgcgtgcaggcgctggccgaagagctgtacaacaccctgcgctcccacggcatcgacgtgatcctcgatgaccgcaaagagcgcccgggcgtgat

SEQ ID NO: 50723 - DNA, 234 bp, Glycine max
  Peptide Sequence Number=SeqID_142408
atgtcggagctaagagaaatacccttcgcactgtacctttctcttttcccgcaaaatccagaacgggagcaaaaggaatcacatggagacagtacaagtggagacttcaatctcttctccgtctctctaacgtttgtgaactctatcagagcagttggaggaaaaaatgaaggaatcttaggaaaccgcaaaagatgccgctgtcgctgtcggaagacacctgagttcgcttag

SEQ ID NO: 50724 - DNA, 219 bp, Glycine max
  Peptide Sequence Number=SeqID_142409
atgtacatcaagtatggcccaaaatacatcatgaagcatagccaacaaaacaagttgtccaatgaaacaaaaacgccccacacttattcccaaaacaattccaaagctccaaaattccttaaggatatgatcaagccaaggctattgtgcaagcaatcaatggggcaaaacacaccaaatgattatgatgatggatggctcaaattctcacaaaggtaa

SEQ ID NO: 50725 - DNA, 797 bp, Glycine max
  Peptide Sequence Number=SeqID_142410
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataaatgttccaatgagcatttcagttatcacgttggtgctcaaaaagtttgggattttggagcatatcaaatttgggattttcagattagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50726 - DNA, 165 bp, Glycine max
  Peptide Sequence Number=SeqID_142411
atgaaaataaaaggcatgcagatcgtagaacaaaaagcatgtcaaacaaagatacatgataatgcggcgatttatgcaaatgcaatgcatgaatatgacgcaggagtgatatgtccattacggtgccatgaagatatgcatgacatagtcaaggaatatgccaga

SEQ ID NO: 50727 - DNA, 237 bp, Glycine max
  Peptide Sequence Number=SeqID_142412
atgggtgaagtagaggaggtgcaagagcagatgaaggccgacatggaggccttgaaagagaaaatggccacaatgatggaggccatgatgagcataaaggagataatggaggtcagtgtggcttaccgaacccgtgctagagctagagtaatgggtgcagtagaggaggtgcaagagcagatgaaggccaacatggaggccatgaaagagaaaatggctacaatggtggaggcatga

SEQ ID NO: 50728 - DNA, 180 bp, Glycine max
  Peptide Sequence Number=SeqID_142413
tctgggatcgtagttttactgagacagttttgggtttctacgggaaaagaaaaagctatgatgcaaaggatgatccaacggtgaatgagtctgagatcatcattgcgggaaaacgagagggttttgggatgaggagaagagaaaacgaaattgagaggaagaggaggagtaggaagtatc

SEQ ID NO: 50729 - DNA, 204 bp, Glycine max
  Peptide Sequence Number=SeqID_142414
atggagggttggtttgaaaaaggtaaggaagatcccaatatcaggttgctacaggtgacgcctaaagatgcacattattgggattctaactccaatatgatcgttaatctgtttaagatgctaaaagctactgtaaccggcgaaactgaggacatagatgagacaaatatggaggctgtttcaatctatagcagtgtgcaatag

SEQ ID NO: 50730 - DNA, 366 bp, Glycine max
  Peptide Sequence Number=SeqID_142415
atgtttgaacatatctatactacagttatggatgttgtaagtttttggatgaatggagctcaaatttgggtcatgcttccgtgtatggattccttgagccacaatcgatacacaatgcaaaggaccgacgtgctgaatgtgagcattacttacaagcgtggttcaaggaatctcaatgagaggggccattggcaactggtagtactgtgtcctgcaaccaatgttgttgcatggttttgtttgttacgtaagaagcctgatactcatatcaaaactgcaattaacaatgcaatgaagacagcaaacacaattgcggatggtacaaataatcaagcaactcctaagtggattgaagtcacgatgtag

SEQ ID NO: 50731 - DNA, 117 bp, Glycine max
  Peptide Sequence Number=SeqID_142416
cctatctctcttaagattgttgaggccacaaggtccaacagatctttggcttgtaaaggattttacaaggttgaaagaaatctcaagaaccattgcttgctttgggactggatgtag

SEQ ID NO: 50732 - DNA, 58 bp, Glycine max
  Peptide Sequence Number=SeqID_142417
ggatcgtgcccgcaagacacccagtggactcgaagaagtccaacagggtcttcaacgg

SEQ ID NO: 50733 - DNA, 330 bp, Glycine max
  Peptide Sequence Number=SeqID_142418
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatccagggcgcagccgggcgagtacgtgaagggccttaa

SEQ ID NO: 50734 - DNA, 311 bp, Glycine max
  Peptide Sequence Number=SeqID_142419
atgagtgatggattttgcggtactcatttgcaaatcatggtcactgacagaggtgtgggcagaggagatcgtgatgattctgatgatgctccacagcgtcgacggcctactgcatccgcacggaggcagcgagtcgctgtgactgtggatcacgtcgatgagccaatcatccatgcgcctgatgttcatgatgacccgatggaggcaccagctactgtagaggacattcctgcggacacaggcacagaggctgctgaggatgagcatcagggatttctgggtggtccgagtgacccatccgtgttgaccct

SEQ ID NO: 50735 - DNA, 649 bp, Glycine max
  Peptide Sequence Number=SeqID_142420
tattgcaaggccggaggttcaagcagccaatatctcctacccacactctcttattcagttaatccaagggaacctcttccatggtcttccaagcgaagatccatatgagaggcaaaacgatggttgcattcctttaaagctaaacatattcatcgatggcttgcggcctcaatcgaaacaactactagatgcatccgcaggagggaagattaaaccgaagactccagaagaagcgatggagctcatcgagaacatggcggctagcgatcaagcaatcctttgtggtcgtacctatgttcccacgaaaagaagcctcttggaaatcagcacggctacaaccagggaaattcatccagattccatcaaggggcagcaggattcaatcatgggccaccgggatttaatcaaggaagaaacttcacgcaaggctcaggatggaggaatcagggaaatcaatataaggagcaaaggaaccaaccaccataccagccaccataccaacaccctagtcaaggagaagggtaaggttgaagaagaagaccggccagaggaagagaggatagagacgcaagaagaagaaaggacagaagaagaagagaaggtggcatcaccacctaagaacaagagccagagagcaagggaagcctag

SEQ ID NO: 50736 - DNA, 412 bp, Glycine max
  Peptide Sequence Number=SeqID_142421
ggtcctggggtttccagctctgattacgagcctctgtcagttctatagagtgtctatcacccccagcaaggtcatcaggccccctactaaccgagctttcatcaagaagtattgcgcccccaggcaggcccagggtgagacaccacagcagcctagggatggtcggcagcgggcaacagacgcaccgccgccacctccagagcccctcagctcatctacaaaggctggagcattgcctatgacccgtggccaactagcaagcgaccaagtccaaagccaaaggaagggtgatgcaatcctccctaggaagggaccaatcactagaaccatgagcaagaggctccaagaagattgggctagagctgctgaagaaggccctagggttctcatgaaccttagggtagatttctga

SEQ ID NO: 50737 - DNA, 427 bp, Glycine max
  Peptide Sequence Number=SeqID_142422
agggctacacgccctcaccttcagatggctgcacgccttcaccttcataggtctacacgccctcaacttcagcggactacaagtcctcgccttgaggactacatgtcgtcaccttcagacgactacatgtcctcacactcagaaggctacacgccctcaccttcagaggactacacgccctcaccttgaggaatacacgtccacaccttcagagagctgcacgctctcaccttcagagggcttcacgccctcgccttcagaggactacatgtcctcgccttcagaggactgcacatcatccccttcagaggactacacgtcctcgccatcagaggactacaggtcctcgcaattagaggactacacatcctcgccttcagagggctacacgtccttgccttccgagactacacgccctcaccattag

SEQ ID NO: 50738 - DNA, 572 bp, Glycine max
  Peptide Sequence Number=SeqID_142423
atgagacacactggtggcagtttgcccatgtatctgcagatcgccgaaatgctggtgcgcgaggtgtcagcagggcggctgatcgacggcgagaagcttgcgccggagcgcggtatggctgccgatctcggcatcgccgtcggtacgctacgcaaggcgctcgccgaattgcaggagcgcggccttctggagcgcgtacagggttccggcaactacatccgcgcggtcagcgatccgcaaagcgtctacgctttcttccggcttgaactgatcgagggcggcggcctgccgacagcggaggttctggatgtgacccggctagcgaagcccgccgatctgccctcttttggcacttcctccgaaggacacaggattcgtcgtctgcggcgcatcgccggcaaaccggccgccatcgaggaaatctggcttgatggttcctatgttgacacgatcaccatcgaaaacatgtcggaatctctctacctctattaccgcactcgcctcaacctctggatatcgaaggcggaggatcgcatcgatctcggtgacgtgcccgaatggacgcccgaagc

SEQ ID NO: 50739 - DNA, 432 bp, Glycine max
  Peptide Sequence Number=SeqID_142424
atgcaacaaaagacggggagactcaatagttttccaaaaagagatgccgctatattgaagagacatttagctcatttggaaacatatcttggcggcattaaatatatgacggggttacctgatattgtaataatcgtcgatcaacaagaagaatatacggctcttcgagaatgtataactttggaaattccaacaatttgtttaatcgatacaaattgtgacccggacctcgccgatatttcaattccagctaatgatgatgctatagcctcaattcgattaattcttaacaaattagtatttgcaattttacctttagtagttcctatacctgtcatgttccttggattattcacaagcggtattcaagctctcatttttgctactttagctgcggcttatataggtgaatccatggaaggccatcattga

SEQ ID NO: 50740 - DNA, 327 bp, Glycine max
  Peptide Sequence Number=SeqID_142425
gcccgtaacccagagctggaaaccccagggccctgttggacttcttcgggtccactgggtgtcttctgggcgcgttccctggggagattggcattgtggtcgctgggcagaatgttgctaaatagcaatgtcatccacgtgagggtggtcatgttggtgcgcatggtccgcactcgtctttttgcagcggcacgggggaaatcttgccccggtatgcatagtagatgcgtgatagcctccctctctggatgtgctcacacagttggttgccctccaatatcagggggtagctcaggaactgataaaaggaaactactggccccttaa

SEQ ID NO: 50741 - DNA, 510 bp, Glycine max
  Peptide Sequence Number=SeqID_142426
atgaccgaccctctcaatgagtcaatctcttgcttcctcataagggtggacccttgggtactagtaccctcaccttcagagggctacacgccctcaccttcagaggactacacgtcctcgcccttagaggactacacgtcctcgccatcagagggaaacacgccctcaccttcagaggactacacgacctcaccatcagaggactacacgtcctcgccatcagaggactacacgtcctcgccttcaaagggttgcacaccctcgccttcagaggactacacgtcctcgcctttagagggctacacgccctcaccttcagaggactacacgtccccgccttcagaggactgcacgtcctcgccttcaaaggactacacgccctcgcctttagaggactatatgtcctcgccttcaaagggctacacaccctcaccttcagaggactacacgtccacctttgggcgtattcttttgaaagattcgtgccccccttttgcacatgttctgtag

SEQ ID NO: 50742 - DNA, 537 bp, Glycine max
  Peptide Sequence Number=SeqID_142427
atgacaccggggggcggagcctatggaaaaacggctttgccgcggccctctcacttccctgttaagtatcttcctggcatcttccaggaaatctccgccccgttcgtaagccatttccgctcgccgcagtcgaacgtaccgagcgtagcgagtcagcctgagcgaggaagcggaatatatcctgtcgcatcgactattctgctgacgcaccggtgggccagcctttgttctagagcggcctgccacacgcgtggaagctccaacttcatgacaccctcatcagtgagtctattacaattcactacacatccccctttcgccagcgttggccgattcattaatagcgaaaggcccgcaccgacaggtccttcccgaacagttgcgcagccgaatggcgaaggggcagcctgtagcgcaagcgcaattaagcgcggcgggtgtggtgagttagctgcagccttagtgcaccccaggctttacacttgccacgctgatgcttccggctggtatgcttgtgtgccgattgtgagcggataa

SEQ ID NO: 50743 - DNA, 336 bp, Glycine max
  Peptide Sequence Number=SeqID_142428
atgccaatctccccctgcagatgtatcgggatcgcgccacaagacgctagtggacccgaagaagtccaacagggccctggggtttccagctctggttacgggcctttgtcagtcctacagggtgcccatccccccaacgagggatcgcacccacaaagacacccagtggacccggagaagtccaatagggccctggggtttcctgctttggttacgggcctctgtcgtcctacggggtgcccgttccccccggcaaggtcacgtcatcatgacataggtaaggatcgcgcctacaagacacccagtggacttgaagaagtccagcagggtcttgga

SEQ ID NO: 50744 - DNA, 459 bp, Glycine max
  Peptide Sequence Number=SeqID_142429
atgggactcatatcagacatccgagtaaaaagttattgtcgtttgaataggctcataggttcaacattcaatttcgagcgtctcgatatattatgggactcaatcagacatccgaaggttcaacattcaatttcgagcgtctcgatatattatgggactcaatcaaacattcgagaaaaaggttattgtcgtttgaattggctctcagattcaacattcaatttcgagagtcccgatatattactatgggactcaatcagaaatccgagtaaaaagttattgtcgtttgaattgcctcataggttcaacattcaatttcaagcgtctcgatatattgcggggactcaatcaaacatccgagaaaaaggttattgtcgtttgaatttggactctcagcttcaacattcaaggtcgaggcgtctcggatatatgacggaactcaatcagacatccgagtaa

SEQ ID NO: 50745 - DNA, 648 bp, Glycine max
  Peptide Sequence Number=SeqID_142430
atgcgatcttgggtaaggggtcagtggatccctttcgatgctgatgccctcagccagttcctgggatatcctttagtgctagaggagggccaagagtgcgagtatggccagaggaggaaccgggccgatgggtttgatgaggaggccatcgctcagttgctgtgtataccggggcaggattttgcccggactgctgctgggagacaggtgcggatcatgcgcaccaacatgactaccctgacccagatatggatgacgttgctgctcagcaacatccagcccagtgatcataattccgacctccccctgccgaagtgtatgccacctaccaggcaccctttagacccagataagtctaacagggccttgggttttccggcattgatcacgggtctctgccagtcgttcggggttcctgtcgcgcccagtaaggtgatccgaccgccgatcactcgcgctttcatagagaaatactgcacagctagacaggcacagggtggcgaccctcaggccccagatgcacagccgccacctcctcaggttgacctagttgggtcatttgacacggagaggtatttacggcatttggttcgccagcaggcggccaaccaccgggcgcacgtgcagacccatgactctctatattag

SEQ ID NO: 50746 - DNA, 486 bp, Glycine max
  Peptide Sequence Number=SeqID_142431
atgaagaacgtcgaagaacggttgaaaccttgcgagattcctcacggaaaacgttacggaaacgtttcggaacaaaataggggaggtggttgccgcccagctcgcccaggcgagcagggttgcttcctccagaagcaaccgccttctggaggaatattccagaggccaatcggcctgggtgctatttgccccccatttttactaagtacacccccctctgctgttttttggttaagattcttttttcgtaaagttagagaaacgttacgagatttcgcattaacgatcacttgttttctttccgtaatgttaggaaccttaggcattggcattaatgatctcttggggtggtccacgcttttgactctacgtatcctcgaatgttacggaacctcaccttacgattcttatgcaatgatgcttccatttgatttacttaacggtgtgtcattaggcgtgcaaagatccttttatttacggaattga

SEQ ID NO: 50747 - DNA, 416 bp, Glycine max
  Peptide Sequence Number=SeqID_142432
atgagtactttagagtgtcaaaattgtactaatgccaaggatatgtgggatactctccagttaacccatgaaggaaccacagatgtaaaaagggaatggcagcccaaggtaactgctatttctgaaagcaaagatctctcttctaagtctcttgccactttatttggtaaattgcaggaacacaagatggaacttcaacgcctcaatcagaatgaagaaaatgaaaaaaagaagagaagcatagcccttaaagcctcatcttcaatacaagaagaaaacgaagaagaagattcaaatgatgaagatttttctttctttgttaagaaatttcagaaattcatcaagaaaagaagaattgacaggcgtcagaatttcaataatggaagaaaatcacaagatgattctcaagtccttag

SEQ ID NO: 50748 - DNA, 433 bp, Glycine max
  Peptide Sequence Number=SeqID_142433
ggtcaacgttatggttttgtctgcttcaaaggcgtggaggacgcagagaggaggtaaaagggaagtgggaagaacaaggggtgaagtggttcgagtaaggaaggtatccatgaatcctatggaacccaaacaagccagaatcaacagtacgacctccactagtatgaaatcgtacgctgaagttgtcaagcacgaccataagatgaaagagaaggagattacgatgcctttgatggggaagaagggaccagaagttcctgacgtttccgtagttattcaaactgggaaggacaaaactagctggttggataatctctgggtgggccgtttaaaaaatagaggtatgtttgagaaggcggtggatgaggttcaggagatggtaggtatggatgtgaaggtatcatactggggggacgacaccattatcctttaa

SEQ ID NO: 50749 - DNA, 823 bp, Glycine max
  Peptide Sequence Number=SeqID_142434
gcgcgccagcggcttgatgccgcgcttggccgccaccgacgcgttcatcagcaccagcgcgccggcgccgtcgttcaggcccgaggcgttgccggccgtgacggtgccgttttctttctggaacaccggcttgagcgcggccaggctctcggccgtgacgtcgcggcgcacgtgctcgtcggtatcgaacaccacttcacccttgcgcgtcttctgcacgatcggcacgatctggtcgcggaaatggccggcctcgatggcgttggcggcgcggcggtgcgactcggccgccagcgcgtcctggtcctggcggctgatgccgaactgggcggcgacgttctcggcggtcacgcccatgtgcatgcggccgaacggatcggacagggcgccggtcatcatggacgcgcggctcatgctctcggcgcccgcgccgatggcgatgtcggcatcgcccagcagaatggtctgcgccgccgacacgatggcctgcaggccggagccgcacaggcggttgacgttgaaggccggggtttccttggcgatgccggcgttgatggcggccacgcgcgacaggtacatgtcgcgcggctcggtgttgatgacgtggccgacggcgacgtggccgacttcgtcgcccttgacgccggcgcgttccagcgcggccttgatgacggccgtgcccaggtcgcagggcggcacgtccttgagcgcgccgccgaaatcgccgatagcggtacggacggcggatgcgacgatgacttccttcttgatgggtttcctcctggtgatcccttcatcatactcgcgccgccgcgctgtcccg

SEQ ID NO: 50750 - DNA, 842 bp, Glycine max
  Peptide Sequence Number=SeqID_142435
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccgtctacagctttgggacactgcaggccaggaacgattccgtagtttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50751 - DNA, 179 bp, Glycine max
  Peptide Sequence Number=SeqID_142436
aacaccctggccgtgtgcgtgctgctggagtcggtgtcaccatcaagcaatacttcggatcggctccacaaagctcctgcagttcctcctccatgcctcctgaagaactcgagcagctgactcaacaaatcagggaccagctggaggagtcgatcatagaaaaaggactcggcaactga

SEQ ID NO: 50752 - DNA, 453 bp, Glycine max
  Peptide Sequence Number=SeqID_142437
atgaccatgattacgccaagctcgaaattaaccctcactaaagggaacaaaagctggttaaacctaataaaggatggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 50753 - DNA, 267 bp, Glycine max
  Peptide Sequence Number=SeqID_142438
atggagaggagtatgattgatgctgccagtgatggagctcttggtgatatgactcttgctgaggctaggaatttgattgagaagatggcttccaactcccaactattcagtgcaagaaatgatgctattgtccttagaggagtccatgaggtggccaaaaattcatcttcatctattgaaaataaaaggcttgagggaaaacttgatgccttggtcaacctaatcaccatacagatctctgtccttctttgcagcaatctggaatga

SEQ ID NO: 50754 - DNA, 443 bp, Glycine max
  Peptide Sequence Number=SeqID_142439
aacaccttggtcgtgtgcgtgctgttagagccggtgtgacaatcaagcaatactttggaccggctccacggacctcccgcacttcctcctccctgcctcctgaagaactagagcagctgacgcaacaaatcagggaccagctggaggagtcgatcacagaaaaaggacttgcactgcctctagagcctgaggttggtccttcaactactcgtgtcagcacaaggaagagttgtgttgacccctcagggaatgatccagacacgggtgactcagacaaatacgagttgtacagggaagaaaatcctccccgcttggtttccctaggaaaagtttatgagggatcgacaaccgttcacaccatccctttgttgcatgatcaagtgaaggtcggtgttgaggaggttagagatgcagatgctcccattcttgtacccactaaagag

SEQ ID NO: 50755 - DNA, 771 bp, Glycine max
  Peptide Sequence Number=SeqID_142440
atgagtcatcattcatctagtgttaatggcgagggtactagtcataaagaccctttatctagaatcttagatgagttgagttccctcaagttatggatagaaaaacaagagagaaaagaaaaaggaaaaaaaagagtggaagaaataagtcaagatgaaagaaagaaaataagagaggaagaaagaagaaaaataatgaaagaaatgaaaagagaaaaacatgtctcctatagtagtcataactcttgcaagagcctaagtgaagaacttcgtgactattacgaaggaaggcataggtcacatcttatacctcactcccatagaagagaaaaggaaagaaagcctcaagaggctaacattaacctcccatacttccatgggaaggacaatgtagaggctaacttagtttgggaaataagggtagagcaacaacttaaaaagaagtctacatcaaaatcctatggctctcactcttatccaaagaaagatcgaggtcgaggcatcttaggggtgacaccttctaagcccaaagatgataaggggaagacaatagaaaagcaagcccctaaggctaaggacacattacttctcaatgcccccaccataaaaaccatgattatgaggggccaagacatttatattagccaagataaggctactacttcaccttcctctagtgaaagtgaagaagcaaaaggggaagaatctagtgaagaaatctacccccaagaagaaggacaaccattagtggttaaagagaaatgtaaggag

SEQ ID NO: 50756 - DNA, 363 bp, Glycine max
  Peptide Sequence Number=SeqID_142441
ggaaaggcaatcaattcatggggctccagatatgatggtggaggatgcatgaacagcgctaggcaatcaattcatggggctccggactcgatggcaatcaattcatcaggctccggacttgatggtggagggtgcatgaatagcgctaggcaatcaattcacggggctccagacttgatggtggaggatgcacgaacagcgcaaggtaatcaattcatgggaatccggactcaatggtggaggatgcatgaacaacgcttggcaatcaattcatggggctccagactcgatggtggaggatgcatgaacagcgctaggcaatcaattcatggggctccggacttgatggtggagaatgcatga

SEQ ID NO: 50757 - DNA, 255 bp, Glycine max
  Peptide Sequence Number=SeqID_142442
atggagcagtatttgcggcatttggtcgccagcaggcggccaaccaccgggcacatcctgcagagtcagggttttacttcttttccgtgccagttcagggcagaggtcgcatggcccggagattggcttgaggcccaggcaggagaggcaccagcagaggcactagcagaggctcccgacgaggcagatgaggcccgcgaggacgaggagatggccgatttacttgatttcttaggagggagcagagccacctga

SEQ ID NO: 50758 - DNA, 510 bp, Glycine max
  Peptide Sequence Number=SeqID_142443
atgggcccaggtgtggagtgttctctctggctccaacctggcccctacatctcatacatcagatcttactatggacagagccaggttgatctttggcctggtctctcatacggacatgaacatcgcctcacatttgagtgcctgagcccggccattaacttggccaacatcaggaagaactgttggaacattgatgatctaacaatttctttccgaggggctaggagggcaagggcaaggctggctaatattccatctacttctgcagctctagcacctactccagcatctacttttgcagctccttcaattccagctcatgttgactcactgcgctttgaaaccatgcttcaaagtatccctcagggacagattctattgctgcagagtctacaggtggtagctcctctaggaaccatcctatcagtggagcagttcttagagagggtagcctggcctggggcccaaccttctcttgatagggaaggtgaaggtcctgttagtcggtga

SEQ ID NO: 50759 - DNA, 695 bp, Glycine max
  Peptide Sequence Number=SeqID_142444
gattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagttcaatggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtaggtgtaattgttgagttctatggtggcgagcttaatggagtcagttatagcgatccccgctactatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaagtagaatttggagcattccaaaaacttggagatccaactacaaaaaaacag

SEQ ID NO: 50760 - DNA, 825 bp, Glycine max
  Peptide Sequence Number=SeqID_142445
atggataacattttaggaagacacattttacctgaaagcaaggtggaaatataccacactgagctggacgagtttaaggctgaattggagaggtgtaacttccataaacgcctcaccaatttagttgacagcagcatagacttggctttagtgaaggagttttatgccaacctttacagctctgaagacccttcaccaaaggaagtcagggttagaggccccctgggctatcctaggaagattctcaagaaagatttgatgactcttgctcgggtgtggagtgttctctcatattccaacctggctcctacttcacacacctcagacctgacaatagatagagctaggctaatctttggcctagtctcccaaatggacatgaatgtgggagcccttatctctggccaaatcacatctatagcccagtctaactcttctagacttgggttccctgctctgatcaccaccctgtgtaaagccagaggggttaattctgacagcttggttttcgagtgcctgagcccggtcatcaacttggcctatatcaggaaaaactattggaatcctgatgatctagttgtttctatcaaaggggccaggcaggcaaagatgaggctaactgagcctccttccacatctacagctcctattccagcatgtacctcagcagctccttctgtcccagcttttacaggttttcagcatcttgaagccatgcttcagagcgtccatcgagggcagatcattctattacagagtttacaggtggtggcgcctccaggatctattccttcagtggagcagttcactgagatggcagtctag

SEQ ID NO: 50761 - DNA, 141 bp, Glycine max
  Peptide Sequence Number=SeqID_142446
atgacagcggacgtcggccatggaaagatgaccgatcgaggtctaaaaaagaagcttcaccggatgacgccgatcgaacatttcctaatcggacataatccaattgttattcagggattgaatagaataaacaatggccgg

SEQ ID NO: 50762 - DNA, 135 bp, Glycine max
  Peptide Sequence Number=SeqID_142447
atggcacatgccccaatggaaatggctccgaaaaagctttccgcgaagagatctaggagggacgccgcggctaaagggaccagtgccgcccccgagtttgatagtcaccgtttccggagcgccgtgcaccagtag

SEQ ID NO: 50763 - DNA, 276 bp, Glycine max
  Peptide Sequence Number=SeqID_142448
atgaggcaccaaatccctatgataggtgatatgatgcatgtgttgagtggtgcaaccctcttttgtaaaatcacccatgcatccaacatcttcatgattcacatacatagggactcattaggaataatcaacataaaaatacagagaaaggtgaaaaagaggctaagtcatgaagtgctaaaagtgacagttgagcttagcttatcagtggggctaagcacgagattacgcaagggtggcgctaagcgcaaaatcatgggttcagagcctatttaa

SEQ ID NO: 50764 - DNA, 767 bp, Glycine max
  Peptide Sequence Number=SeqID_142449
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggactgggcgcggtggctcacgcctgtaatcccaacactttgggaggccaaggcaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50765 - DNA, 312 bp, Glycine max
  Peptide Sequence Number=SeqID_142450
atgacaagcagagaccaagtttggtcattctgcacccttgtatcatccagaggcggcgggcccgatgatacgcggagataccttatggttattcgcacccttttgtcatccagaggcggcgggcccgatgacaagcagagacgcaagtttggtcattctgcacccttgtatcatccagaggcggcgggcccgatgatacgcggagatacttatggttattcgcacccttttgtcatccagaggccaattaggcatcataattttcgggccttcttgatgacaagcagagaccaagttctttggtcattgtga

SEQ ID NO: 50766 - DNA, 141 bp, Glycine max
  Peptide Sequence Number=SeqID_142451
atgaatcttgaagaacggtcgagaatcttcaccaaaataggggagaagcttgccgcccagctcgcccaggcgagcaaggttgcttcctccagaaggaacagccttctggaggaatcttttggagggcccaagtgggcatga

SEQ ID NO: 50767 - DNA, 318 bp, Glycine max
  Peptide Sequence Number=SeqID_142452
atggcaccagctgctgtagaggacattgtggcagacattcctgcggacacaggcgcagaggctgctgaggatgagcatgagggatttccgggtggtccgagcgacccattcgtgttgacccagtatgcggatcacgagcgtcctgagttgaagttatcctctcatgggaggaaggtccatagtttaggcaggtctgtccctgccattgagcgacttattgctagtacaggactaagttctctgatcgcgtgttcggtagacactggcgatcgggacttttgtcctcatttgtggagcgtggcaccgggagacgtctag

SEQ ID NO: 50768 - DNA, 342 bp, Glycine max
  Peptide Sequence Number=SeqID_142453
atggcaatacaaggagatgatagtgaagatggaaagaagatagaggaacataaacaacaactggcacctaagccagcacttgaacatgtttatgattttgtagaacttgaagagattaatgaggagactaaagatgacaaggaagaagagacatcaataaaagagaaagaaaaagaaagaataaaagaagaagaaaaagaaaaagaaaaaaagttaaaaaaaaatgaaaaacaaaaagagaaagttgttgatgatgagatgaagaaaggaaagagtgaggcaaacagtgacaagaagaaggataccactccaaatgaaggaaaggaagtaccttatcctttg

SEQ ID NO: 50769 - DNA, 195 bp, Glycine max
  Peptide Sequence Number=SeqID_142454
atggaatcgattatcagcagaggattcctgaacacaagggaagggttgtccctgtgtggttcagactttgtaaatggagttttacaaagagagtggaaaatctcaagtgggttgcttgaggactggacgctggacgtaggcgcgggaagtggccgaaccagtataaatcaagtttgcattcctctcttcctttaa

SEQ ID NO: 50770 - DNA, 396 bp, Glycine max
  Peptide Sequence Number=SeqID_142455
atgaatgacaatataactttaatattgcaccatggaggaagattcactccacgtgccagtgatggaaaggttgaatatataggcggagaatttgacgtttgggaagatatatctgcagattacatgaacacatttatattatatgatctggtgaaagcttattttaatcatgggttaaggagttgtacaacagatggaaatatattatacttagtgagggatgctttggaaaatgagaatgagataaatgtttattttcatcatgaagtagatccaattttagaagaagttccacagatgttatacttggaatgtcatccaattccagaagctgttgagaatgaggatgatttacatgatgtacctattgttggccttgaggaaggtaagttttaa

SEQ ID NO: 50771 - DNA, 348 bp, Glycine max
  Peptide Sequence Number=SeqID_142456
atgctggtctcccctgcggaagtatcagttggtctgtgccatcgtgacatagggatcgcgcccacaaggcacccagtggacccggaggagtccaacagggtcttggggtttccagctcaaattacgggcctctgtcagttctatagagtgcctatcacccccagcaaggtcatcaggccccttactaaccgagctttcatcaagaagtactgtgtccccaggcaggcacagggcgatacaccacaacagcccggggatggccgacagcgggcaaccgatgcaccgccgccacctccagagcccctcagctcatctacaaaggctggagcgttgcccacggccagttga

SEQ ID NO: 50772 - DNA, 177 bp, Glycine max
  Peptide Sequence Number=SeqID_142457
atggggcgtggccaagtggtaaggcaacgggttttggtcccgctattcggagatcccattttactcaaattacaatatcatcgaaaacttacagcagcttgccaaacaaaagctaaaagaaaaaagagtaagggtattactggcataatatccacaattggattcaagaaagcgtag

SEQ ID NO: 50773 - DNA, 573 bp, Glycine max
  Peptide Sequence Number=SeqID_142458
atgttgctaagcagcaatgtcatctatatctgtgtaagagtggtcatgttggcgcgcatgatccgcactcgtctctttgcagcggcacggatgaaatcttgccccggtatggatagtagttgtgtgacagcctccctctctggttgtgctcgcacagttggccctcctccaatatcagagggtggcctaggaaccatgtggagcacactgaaaatgaggacacgtagccctctaaaggtgagggcgtgcaaccctctcaagacgaggatgtgtagtcctctggaggtgagggcgtgcagccctctgatggcgaggacgtgtagtcctctcaaggtgagggcgtgcagccctctgttggcgaagacgtgtagtcctctcaaggtgagggcgtgcagccctctgttggtgaggacgtgtagtcctctcaaggtgagggcgtgcagccctctgttggcgaagacatgtagtcctctcaaggtgagggcgtgcagccctctattggcgaggacatgtagtcctctaaaggtgagggcgtgtagccctacgaaggtgaggacatgcagtcctctcaag

SEQ ID NO: 50774 - DNA, 898 bp, Glycine max
  Peptide Sequence Number=SeqID_142459
atggtagaagaatttgaagagatcctaggatgttctttagggggaaagagaccatacctcttctcagggttctatccctcattagctagaatttctaagatagtccaaatctcggcgcaggaattagaccacagaaagcaagtcgaaaatggggtggttggaatattgagaaaatatttggaggcaaaagcaagaatcttggcaggtaaaggcgaatgggctctgttcatagacattctcgcactgttgatcttcggaggagtcctctttctgaatgtggatgggttggtggacctagcagcgatcgacgcttttctcgcctatcataaccacaaggaaatcccagttgtcgctatgctagccgacctatatgacacctttgaccgaagatgtgagaagagcagtacgaggattgtttgctgtactccagctctttatgtatggttggtttcgcacctttttcgccaagaggtaaggcatgcttgcctgctagaaagtcaccactcatgcacagagaaaggaggggaaaattgggaccaactcttagcaagcaaagaaggagcgtctgtcaactggttccctcaatggaaagaaggaagaatcggagttcttatttcgtgcggaggatttccgaatgttcccttgttggggacgagaggttgcatcagttacaatcccgttcttgctataaagcaacttggttaccctatgagaggggcaccactagaggaagagttcgcacctgtcatttcacgaggtttccataagaccaacatggagacacttcagaaggtccgtaaggcatgggaggtggtgcaaaagaaggacaaagaactcaggggcagtaacaatgggtccatcggtggctaccgtaagtggttgagagcctacgtgcaag

SEQ ID NO: 50775 - DNA, 1077 bp, Glycine max
  Peptide Sequence Number=SeqID_142460
atggcccacttggagctctcgattccatggcgcggctcaacagagcagccgcaccgtcctacctatttaaactatcctgagggaaacttcggagggaaccagctactagacggttcgattagtctttcgcccctatacccaagtcagacgaacgatttgcacgtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggccccatcgctttactcacgacaattcaagcactctttgactctctttcaaagtccttttcatctttccctcgcggtacttgttcgctatcggtctctcgccagtatttagccttggacggaaattaccgcccgattggggctgcattcccaaacaacccgactcgccgacagcgcctcgtggtgcgacagggtccgggcacgacggggctctcaccctctcctggcgccccttccaggggacttgggcccggtcccgccactgaggacgcttctccagactacaattcggaccccgagggcgaccgattttcatggtgggcttttcccggttcgctcgccgttactaagggaatccctcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggag

SEQ ID NO: 50776 - DNA, 564 bp, Glycine max
  Peptide Sequence Number=SeqID_142461
atgctaccagagtatgagattgacgatttgtccacggaagcagatagcgttgctggagatcgattatttcctcatgattttgaagaagcgtcacacaaaacagccatgtttccatcaaaccatcacactcgattgatgcatcctcctcttataaatgagcttggcgttgccactatcaacgaaaaaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 50777 - DNA, 396 bp, Glycine max
  Peptide Sequence Number=SeqID_142462
atgattatgaggagccaagacatttatagtagtcaagatgaggctactacatcaccttcctctagtgaaagtgaagaagcaaaaggggaagaatctagtgaagaaatctaccaccaagaagaaggacaacctttaatggttaaggaggagtgtaaggaggtaagtgtctcctccaagaggccttgtattttggccattctcaatggtggaaaattaccattaaaggacctcatcgaagctcaaagatccagcctccatagaagccccacaagcaagcttccatcagcttctagcatgctttgctccatggcttctaagtgttgggccaaactcctcttggatctcgagcaagcagctaactcctcctttaagaccatgccatgtactcgtgactga

SEQ ID NO: 50778 - DNA, 551 bp, Glycine max
  Peptide Sequence Number=SeqID_142463
atgaggggagcgccaacagaggagagtctctcgcctctccttgtgagggatctaggtgcgcaaagtctcaaggttatacaaagagtccacaaggcgtggagaagtccgttgaggaaagacaaggagcttaggggcatccgtaatggcgtcatcagtggttatcatggatggctaagagttcacacgcgagggttggattggctctccaagttgaaagttatcgatgaggagaacttcgaagctccggaggaagatgaagaagtccaagctctaaaattagagctagggaaggcaagactcgccaaggagaagttcaaatcagccgctacacacatccggaaagagtgcatcgagttacaagaggaaaacgcggccactgcaagagcccttgaacaagaaaccaaaagggcccgcaaggaggaacatggccgagataaattccgaggagcattgtggggtagcaacaatgagctcaagctccaaagagaggaaagagatcggtcatgggtgcatggcatgatcttaaaagaagagttagttgcttgcgcaag

SEQ ID NO: 50779 - DNA, 435 bp, Glycine max
  Peptide Sequence Number=SeqID_142464
atgacgaacctcacgaacgatgacgaagagtttggaagcagcaacaaccgaagaggagaagcaaaacgaggaccagtgacgaagcgattgagaacaaattgggctcctagagtgacgatcgacgaaaatggtgacaaagaaggttttagggatttcgaacacgaacacgaacagagtccagtgcagtcgatgaaggagaacggagtggattattggcacgtggatcggaatgaggatcctagggttagggttttggaaaacgacggcgttgaatcggagtcgcaggaatggaggaagagcgatggagtgaggtcttggctttacgagttagggaaatctggtttgccggaaagcgcaccagatcgtcaagtatttaaaattaaaacagatgaatccaagtatcgaactcagggaactagtctaagacagggttaa

SEQ ID NO: 50780 - DNA, 309 bp, Glycine max
  Peptide Sequence Number=SeqID_142465
atgagggacgacaagaggtcttcgtacgtcattgggagtggggtgaattatggaattggcctcaggggaaagttcctcatcgcgttggaaacgacgccaaagtgggcattgccggtcgggcaagtcatggttggagctggagcttggggggcctccctctggatgggggcgggcgccttaggccgtacggaggtctacgggggcttgacccgtgcgggcgccaaagtgacaacatgggtatctccttccttcctttttgccccagttgctccgactcttttaacattggtacttgtggaggaaacgtaa

SEQ ID NO: 50781 - DNA, 452 bp, Glycine max
  Peptide Sequence Number=SeqID_142466
gtgtaccctaaacccggaagtagaatgggctggttgatcgattggttgattgatcgatgggtcgggttcacgatagggttgggggagacccctgaactgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50782 - DNA, 282 bp, Glycine max
  Peptide Sequence Number=SeqID_142467
atgatgttagtctccgcgcgccaacgggctcgtttgctcctagttgaccgaaaggtgcgggtaaccataaggacgacaaaaggtgcagaagacgatgtaaatctccgggcgccaatcgggctcgtttgcccctggttgaccaaaggtgcgggtaaccataaggtaaccccgcatgtcaccttgacttcacgtggtcaggacgacaaaaggtgcacgaggacgatgttagtctccgcgcgtcaacgggctcgtttccccctcgttgacgaaaggtgcggctaa

SEQ ID NO: 50783 - DNA, 474 bp, Glycine max
  Peptide Sequence Number=SeqID_142468
atgttgaaccgtcacatggctgataagcttattcggcaataccgtgcgcctcgggtgctccagtggcgtaatcatggtttctatcagctgttccctcctgttcagctactgaaatcggggtggtacgcgtccaattcggcaaaagcataccgaccggacatcagcgctggcaagtgtaaagccggggtgccaatgacggctgccgtctttccagttcgacctgtcggctgcgcactgcttaatgacggcaagccgggcgatcgagtgcgggcctttgcgtattacgagctggcgctaaagggcggatgtgtgcatactggcgattactatgttggcactgataacgcagggtgtcccagtcacgaagtgcgttcatgtggcaggagaaaaaaggctgcaccgggaagtgagagggccgcggcaaagccgtttttccataggctccgcccccctgacaagcatcacgaaatctga

SEQ ID NO: 50784 - DNA, 985 bp, Glycine max
  Peptide Sequence Number=SeqID_142469
atggacaagaagatccgcagtattgtgagtagcattttgaaagatgcttctgtgcctgatgctgagaaagatgttccaacatcttccaccccaaatgtttttgtgcctgatgctgataaagatgttccaacatcttccgctccaaatgctgaagccctcccttcacccagtgaagaggaatcaacagaagaagaagatcaagccacagaagagacccctgcaccaagggcaccagaacctgctccaggtgacctcattgacctagaagaagtagaatctgatgaggaacccattgccaacaaattagcacccggcattgctgaaagattacaaagccgaaagggaaaaacccccattaagaggtctggacgaatcaaaactatggcacagaagaagagcactccaatcactcctaccacattcagacggagcaaagttgcaatcccttccaagaagaggaaagaaatttcctcatctgattctgatgatgatgtcgaactagatgttcccgacatcaagagggccaagacatcagggaagaagacttgctgtgaaagagaactgggaagagctgccttggattgcaaggagatcatggacctcatcacgactgctggactgctgaagactgtcaccaagttgggagattgctatgagagtctagtcagggaattcattgtcaacattccctctgacataacaaacagaaagagtgatgagtatcaaagagtgtttgtcagaggaaaatgtgttagattctcccctgctgtgatcaacaaatacctgggcagaccaacagatggagtggtggacattactgtttctgaacatcaaattgccaaggaaatcactgccaaacaagtccagcattggccaaagaaagggaagctatctgcagggaagctaagtgtgaaatatgcaatcctgcacaggattggagctgcaaactgggtacccaccaatcatacttccactgttgccacag

SEQ ID NO: 50785 - DNA, 483 bp, Glycine max
  Peptide Sequence Number=SeqID_142470
atgactagaggcaatccatctgacttacaaccctttgatcctgagatagataagacatttcatagattagttaggcatcattttataccttttgatcattctgagcattccattactggtgaatctgtgcattctgttattggtgattttgaacatcctgatcttgagcattctgattttgcacattctgagaacatggcacaacctccaccccgtgagaggactctaagggaaatggttgcacctgatttcacctacgaaagcttgtgcatccaataccctgatgaggatgtcccatatgttcttaaaactggactgattcatttgcttccaaagtttcatggccttgcaggtgaagacccgcacaaacatttgaaggaatttcatattgtctgctccaccatgaaacccccagatgtccaagaggatcacatatttctgaaggcttttcctcattcattagagggagtggcaaaggactag

SEQ ID NO: 50786 - DNA, 204 bp, Glycine max
  Peptide Sequence Number=SeqID_142471
atgtggcggaagtcgaaaagaggtgtttttgcgcaatccgtaagtttccgtgacttcttcgaaaggcccacttgggccttccagaaggctgttgcttctggaggaagcaacctggctcgcctgggcgagctgggcggcaagcatctcccctattttgctataaataggggaggaagtgaagaagaaaagggttcagccccttag

SEQ ID NO: 50787 - DNA, 231 bp, Glycine max
  Peptide Sequence Number=SeqID_142472
atgaacttaatcatagttatcaaaaggaaagaacacgctttacggcgcccttaccgaacccgtgctagagctagagtaatgggtgaagtaaaggaggtgcaaaagcagatgaaggtcgacatggaggccatgaaagagcaaatggccacaatgatggaggccatgatgagcatggagaagataatggaagcaaatgcgattgcagttgccgctaccagcgctgttgctaag

SEQ ID NO: 50788 - DNA, 370 bp, Glycine max
  Peptide Sequence Number=SeqID_142473
atgaaaaaaagactagaagaaataagtctagatgaaaaagagaaaataagggaagaagaaagaaggaaaatactaaaagagttaagaaaagaaaaacatgcctcctatagtagtcataactcttgcaagagcctatgtgaagaacttcgtgactattatgaaggaaggcatagggcacatcctagacctcactcccaatggagagaaaaggaaagaaagcctcaagaggctaacattaacttcctatacttccatgggaaggacaatgtagaggctaacttagattgggaaataagggtagagcaacaacttaaaaggaattctacttcaaaatattatggctctcactattatctaaagaaagaccaag

SEQ ID NO: 50789 - DNA, 755 bp, Glycine max
  Peptide Sequence Number=SeqID_142474
acttagccgccattgatgctttcctcgcatatcaccatagcaaggaaagtccagtggtggctatcttggcagatttgtttgacacctttgaccggaggggcagcgcgatcaattggtttcctcgttggaaggaaggcaaagaaggagttcttttctcatgtggggactaccctaatgttccactgatagggactaggggttgtattaattataatcccacactctccataagacagctatggtaccccatgaggggagcgccaaccgaagaaagtctctcgccttgccttgtgagggatctaggcgtgcaaggtctcacggttatacaaagaatccacaaggcgtggaggaatccattgaagaaagacaaggagcttaggggcatccgaaatggcgtcattggaggttatcatggatggctaagaattcatgtgcgagggttagattggctctccaaattgaaagttatcgatgaggagaatttcgaagcttcggaggaagatgaagaagtacgagctctaaagttagatttagggaaggcaagactcgccaaggagaagttcaagtcagctgctacacacatccggaaggagtgcaccgagttacaagaggaaaacgcggctactgcaaaagcccttgaacaagaaaccaaaagggcccggaaggaggaatatggccgagagaaattccgaggagcattgtggggtagtaacaatgagctcaagctccaaagagaggagagagatcggtcacgg

SEQ ID NO: 50790 - DNA, 222 bp, Glycine max
  Peptide Sequence Number=SeqID_142475
atgggaagagatcccaagaagtttctccaactcttaaatgatataagtgtaattaacccgtcatggcccgagaagaatgagaagaaaagctataaagaaagaagatccaagaaggcgtatatggcttgggacgacaatgactcgtccgatggtttagagaaggagatcaaccttctatccaaggactatgaaagtgatgagaacatctctcaagaagtttaa

SEQ ID NO: 50791 - DNA, 539 bp, Glycine max
  Peptide Sequence Number=SeqID_142476
atggtgttatttgaggtgctccagtggcgtatctgttgtctatcagctgttccctcctgttcagctactgaaacgggcctggggtgccatgacgctgacgctaactcaccacttaatccgccttgcgctctatgcgccgctattccagtcggaacgctgtcgtgccattcgctgcattcaggcatgaatcgccaactgttgcgcgaagggcgatcgagtgcgggcctcttgcgctattacgggccagctaggcgaaagatgtgctgcatactggcgattactatgttgggtacactgatgccagggtgtcccagtcagacagtgcttctgtggcaggagaaaaaaggctgcaccggtgcgtcagtcagaatatgtgaatacaggactcactatagggcgaattccggagcttcccgcggtggcggcactgactctagaactacgctcggtctccccgggactgcggcgagtcggaaatggcttacgaacggggcggagactttttcctggaagatgccaggaagatacttaacagggaa

SEQ ID NO: 50792 - DNA, 573 bp, Glycine max
  Peptide Sequence Number=SeqID_142477
cctcgatcactcgccttcgcctttagaggactacaggtcctcaccttcagaggactacacgtccttgccttcagaggactacgtgtcctcatcttcagaggactacacgtcctcaccttcagagggctacacaccctcaccttcagaggactacacgtcatcacctttagaggactacacgtcctcgccatcagagggctacacgtcctcgccatcagaggactacacgtcctcgccatcagagggctacacgccctcgccttcgtagggctacacgccctcaccttccgaggactacatgtcctcacctttagaggactacacatcctcgcctttagaggacaacacgtcctcgccttcgccttcgtagggctacacgccctcatcttccgaggactacatgtcttcaccttcagaggactacacgtcctcgccttcagaggacaacacgtcttcgccttcgccttcgtggggctagacgcccttacctttagaggactacacgtcctcgccttcagaggactacacgtcctcaccttcagaggactacacgtcctcacctttagaaggtga

SEQ ID NO: 50793 - DNA, 357 bp, Glycine max
  Peptide Sequence Number=SeqID_142478
atgggggggatttcatcagcagactctccttccccgcatgtttgcatttttggagaaaacaccgagactttttcaagtctcacaagttatccagaactacgtaggtctgagttcctcattggaggatacgtaggagcaagagcctcgcttttgtcgaccacaccgctttttgttaccatgacccaagagctagtagcccacagagacgccttacggttatccgcacctcgtcattcaatgaccccaagtgtgattgatgagcagaggccaatgtggtcatctgcgccctttccggagatgtcagcatcttccggtggagactttttcaagtctcacaagttatctagaactacgtag

SEQ ID NO: 50794 - DNA, 552 bp, Glycine max
  Peptide Sequence Number=SeqID_142479
atggagaaaaaaatcactggatataccaccgttgatatatcccaatggcatcgtaaagaacattttgaggcatttcagtcagttgctcaatgtacctataaccagaccgttcaggctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttctccagttttgatttctacgtggacaatatggacaacttcttcgcccccgttttcaccatgggcaaatattatacgcaagacgacaaggagctgatgccgctggcgattcaggttcatcatgacgtttgtgatggcttccatgtcggcagaatgcttaatgatattacaacattactgcgatga

SEQ ID NO: 50795 - DNA, 543 bp, Glycine max
  Peptide Sequence Number=SeqID_142480
atgagggcagaattttcaatactcaaacgagagaatcaaagatctcttgctttgatagcaatcaattggcctacccgatccccggaaaagcaagagcccgtttgtgcgcttttggaaaaacatcaagaaaacattagcagtaacatactcaagagatctctagaaaattcttcaaccaaaccaacgacaatccaagatctccaaacagagataaacaatctaaaaagagaggtaaaagaacttcgtcaacaacaagaaattcatcagatcattctttctcagcttgaggaagatagtgattctgaaagtgccaacaacagtgaagaaaatcaaccagaaaatttagaagatgatatgtttatggaattaatcaacaagattaaaatccaaaaattctacataaacctaaaaataattattaatgatttcattttagaaataatggccttatttgacacaggggctgattcaaactgcattttagaaggattaattcctacaaattcttggagaaacctcagaaaaattaagtacggcaaatga

SEQ ID NO: 50796 - DNA, 860 bp, Glycine max
  Peptide Sequence Number=SeqID_142481
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatacttgcggcatttgacccaacagtatacgttgaagcaacgatcggtgaaccagataccctcgacccacatcttgcttacgatacgtcaagtggtgaggtactttacaacgtttacgaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50797 - DNA, 282 bp, Glycine max
  Peptide Sequence Number=SeqID_142482
atgaaagataagagagatgaggaagaaaaactagaaaaacaaaagaaaaagaaggatagtaaggccttgtcttcaaaggccaaggggaaaaagaggaaaaggattcctcaaagacgattgttaagaaggaaaatcattttgcaacaaaaggtgatatcaaaagggcactccttcttaaacaatccttgtaccttctcctatcaagggaaacatcccttagcacggccatacctcttgagcttgagtgatcaaggggttcctacagaccctaagagaataaag

SEQ ID NO: 50798 - DNA, 635 bp, Glycine max
  Peptide Sequence Number=SeqID_142483
gtggacagacggcatcggcaacacagtgggcgtcattcccggcaagacgatcaccgagcggcaggcggcgggcaacttcatcaccaacgtgttacgcgtcgaggcggcactggcgcgctgcgtggcggtttccatgccgcagcaggtttacgacgcgctggtgtcgctggcgttcaacgtggcaccggcaatccgcctgcggctcaaccatggtgacgttgcgaaaaaagggaaatggccgaggcgtggagctgagcagatgagtaaacgtaaccaccggcgtctggtggctgtgggcgcgctggcatcgctgacgcttgtgcatgaacctgtccgcactgcaccgtcgagcttatctgagacaagcataaccgacaggttttacacggcgaatccgggctggcggcacggcccatcctgccgcacatgggctggggtggagttgttccgtgcaacggcgcgcacccgtgcaggccgtccgaaggctttggctgaactattcgacaagcaggccgtgccgaaatatggcgggctgggctgcatgaagctgctgaaaatcgcttatgtccggctggccgttctatcggctgctgagggtgatcacgctggtctacagcatatcactgctggccgtg

SEQ ID NO: 50799 - DNA, 1230 bp, Glycine max
  Peptide Sequence Number=SeqID_142484
atgcctctcactgacgaccaagaacacatcctcgcgttaagtggcctctggaaaatcgccataaccaaccccaatgatccagagtttccttcccttggcatcttcagatgcatggtcaagttgattcaaaaaggggtgaatcacaaagattggctccttaggtgtcagaacatgtataccccttattacgcagcgcatatcattggttcttacaccatgaacaaacccaagtttgctgacaaagttgcacttcgcgcactgggtcatttggccagccatgaagcaacttttgaagccgttgctgaacacgaagctgaagtggtagaagcagccattgacatagcttccacgtgcctaaaagaggtgtatgaaaagttcgttgggttgaaggaatcggagagattggagtaccacagaaacttgcttacaagagggcatggagacttggaattggccaacataaaggcagaagaatgggccagccagcttcagtgttggtctctctatctccttgattgctttgcttgtagggaaagatctctgggactaatctgcaaaaaaaaattcttgaaggacttgtgtggaatgtggggtgatttagaagaagtggttgtgaatctttgtaatgtgtcaagatcctcagatgatacgcaacacatggcaattgatagtctcttgcaacttctaagagatccagttagaaggtataaagtaatagataaagctgctccagttcttgctgatttggttgagattagaagtttgggaaggaaaccaaaagtaggacaagcaatcacgcagactctcttacaggattaccacaaagtcaagtttggtgagttgaagagtgaaagaaccaagagaacattaggagagctatgggacttgaaggtggaaagagtgaaaaaagaaagcctaatgagtgagcaagaaataagagaaaaacaagtgttggcaggtattttgaaaaaagaagggaatcgggaatttgggtcaagggagattgaaaaagctgtggtgaagtacacagaggctttgagtttgtgtccattaaagtctaagaaagagagaatagtgattcatagcaatagagttcagtgtcacttgcttcttagagatccagaagctgcactcagtgatacaactcgagcactgtgcctatcgaatgtggcgagtgttgcgtgtcttcatagcaagagtttgtggagaagatcagaggcttggacatga

SEQ ID NO: 50800 - DNA, 2265 bp, Glycine max
  Peptide Sequence Number=SeqID_142485
atggattgtgagcgtctattttatttcagtcacgaagaaagcggccaagaactcctacacctggacactatcttggccttaaaagtactagagactatgggcatcgtggtgaccatggaaggtatcgaggaggtggatctggtcatgatgattatggatatcgtggtgaccgtggaaggtctccaaggcactcaccaccatatcgaggtggtagagattattcaccgaggcactcacccccaccttatggtggaagatctaggagggacaggtccaggtcacttccttattctccatatggtagcccagataggaggagcagcagccaccatgttccatgtttccaccgttgcgctgaatcctcaacctcacactttcctctttccactccccttttttacttcccgcaacctccaactttcacaaactctacaattccccagaaactggaacctccgctctatctcgccatcgctgcacccaacgccgcaatacgacgattccgaagaccacgtcatcggcgactgcgtcgtgttcgaggacggcgttttcgacgaaccgcttttccataaccaccaccacaatcccgacaatcttaccgtcgataagcccaagcccaagcccaggcccagttggaggaaaaaagtggaggagacattgggcgagaatttggtcccggacaagtggcgagaggttcaggcggagataaacattacgaagagggagatgcggaagattgcgcgggaagtggagttcaacagcaaggttgaaaagaagagaagaggcttgattccccttagggatatgaatttggatgactacaaggcttataaggaagccaaattggcgcagatgaagcttctcgattactcttctagttttccggtggacgaaaatgtccctgaacctcaattgaatcgcggagaaaagtttgaggctgaagctgaattggatggtggtgaacgtgttgcgcctaagaaccctaggtgggctgtttatgggaggggtttggaggatgtcactgagtttttcaatagtgacaactatgaccctactgctaaaacccctggaggtcgccggaagttgtttaataaggaggagaaggttttgttgaataagaggataccagacttggcagctgctacttcaactggatactcagttcatggacaccttgttgcatttttgtgtgcgtgtgtgagaatgatgattaaggataaatggcttcccctgcacactctcgctgcttgtggagaatttcaccttttagattctctgttgaagcataatgttgatatcaatgctgtggataaggatggtttgactgcccttcacagagcaacaattggaaaaaagcaggccataatcaattatctcctgagaaactcagctaatccctttgtacaggataatgagggagccacattgatgcactatgctgtactaacagcttctacccagacaattaaaatactcttattgtataatgtggatataaatctccaggacaattatggctggacaccattacatcttgctgttcaagctcagaggacagatttagtgaggcttttgctaatcaaaggtgctgataagacattaaaaaatgagtcagagaccaaaatcaccattaacgagaggcgcaagaataataagaagaagagaagagggttgcttcccttaagagatgcaaagaaaatcgagcttgagaagaagggaaatggaagagggttgagtccctacaaggataacccttctacgtttcacgtcaaagcgaagcttccagaacctgacttcaatggcgagcgtgtagagcctaaggatcccagagggtttcttcacgggaagggtttggaggatgtcatgcagtttttcatagttggagctataaccctagttctaagaccactcataaagggtaaatggcttcctcagcacactgttgctgcatgtggagaactttaccttttagattctttgttgaagcataatgctgttatcaattcggtggataaggatggtttgactgcccttcacaaagcgattggcaaaaagcaggtcataaccaattttctcctaaaaaactcagctaatgcgtttgtacgggacaaagagggggccaccttgatgcactatgctgtacaaacagcttctactgagacaattgaattactcttattgtatattgtagagataaatcttcaagacaatgatggctggacaccattaaatcttgctgttcaaactcagaccaaatttagttag

SEQ ID NO: 50801 - DNA, 702 bp, Glycine max
  Peptide Sequence Number=SeqID_142486
atggcttcccttgatgatcataaaactaatgaagaaatttccatcaaccatgttgagattcctatccatgcaattggtgtagagccaaaaccaaaccaagaggtcaaagagagaagaaacattgactattctcagagagcacaatggcttcgtgcagccgtattaggagccaatgatgggttagtctcagttgcatcattgttgatgggtgttggagctgttaaggaaaacatcacggccatgcttcttgctggctttgcagggctaattgctggggcatgtagcatggcaattggagaatttgtttctgtgtacactcaatatgacatagaaattgctcaaattaaaagagataaagaaaataataatattggtgaagaagcacaaagggagaagttgccaaatccatttcaggctgctctagcatcagcactagcattttctgtgggtgcagtgataccactactagcagctgcattcataaggaactataagattaggcttgttgtcgttgctgttgtagctagcctgacattgttgctatttggtggtgttggagcagtgcttggaaaaactccagtgaggaagtcctgtatcagagtgctccttggaggttggatggccatgactataacttttggtcaccaagttatttggcattgctgggctttcaatgtgattcattactttggtcttttttaa

SEQ ID NO: 50802 - DNA, 1071 bp, Glycine max
  Peptide Sequence Number=SeqID_142487
atgaatttagacactatctttgcttttaccttagcttatattctactggtaataacctcatcagagttccctagtgttgctggggacgatggattctatagcttcaatgcttttctcaccgcagctagatcctttggtgggtttggcaccacgggtgattttaacactcgtaagagggaggttgctgctttcctagccctaacatctcatgagaccacaacaaatagagtccctggttatggtgtgatcaccaacatcatcaatggtgggattgaatgtgggaatggtcctactctaggatcagagttccctagtgttgctgcagatgatgttagcagcatcatcagtgcttcccaatttgagcaattgctgaaacacagaaacgatcaaatttgtgaggggaagaacggattctacagctacaatgcttttgtcactgctgccagaacctttgatgggtttggcactacgggtgatgttaacactcgtaagagggaggttgcagctttcctagcccaaacctctcacgagaccacaggaggaggaggatggcctaatgccccagatgggccatatgcttggggttattgctttgtcacagaaagagataaatccaataattattgtgaaattagcaaggcaccatgtgcctcaggcaaatcatactatggtcgaggaccccttcagctgacacacaactacaactatgatctagctggaaaagccatacattcagacttgataaacaatccagacttggtagcccaagacccagtggtatcattccagacagctatatggttttggatgacatcacaagccaataagccctcatgccacgacgtgatcaccaataggtggaccccatcttctgtcgacatggcagctaatagagccccaggttatggtgtgatcaccaacatcatcaacggtaggattgaatgtgggaatggtccttctccagcctcaaatgacaggatcgggttttataaaaagtattgtgagatttttgggctctcagatgctaccaacttggattgcagtagccaaaagtcctttgatcaagattaa

SEQ ID NO: 50803 - DNA, 1563 bp, Glycine max
  Peptide Sequence Number=SeqID_142488
atgaaccacaacaaacgaggcgtgcttactcgtttgaagactctcgtcaactctcactctcagggcttccactcccctgcgcccaaacgaccaaagcaagatccatcgtcaacagaaaatgacttagattactctgtttgccgaggccgcattgacgtctcaaaatggaagactttggatgcagaggagcttggtataactagttctatgatttcatacccatctcagtttgtcctgaaacttcttcggagaaaaggatttgagtcctacttagtaggtgggtgtgtgagagatctactactgaatagaactccaaaagattttgatgttatcaccacagcaaagctgatggaggtgagagcgcagtttcgtggtttagctcgtgccgaagttgttggacgtcgttttccaatatgcttggttcatataaaaggttctgtagttgagctagaaactgttatccctgctcagatgtcctttaaagaggatcctgctcgtcttggtttatcattatcaagggagactgaggctgcaatgtggaaatattcttcacttgttaagagcttggacaagaataaaattatgattgaattgaactacatgctgtcttatggcgctgctgaaccatctttgcatctactttggaaattcaaattacttgaatttttacttcctgtgcatgcagcatatcttgatgaacaagctattaaagaagatgctccggcttccaatatgttgatggctccaatccaactgaatctttttggatttcagatatttgtacccaagaaagcagggaaacttgcttctgcgattttcaaaatgctggccagtgatgttgaattttacaagactgaaagaagaaaaaattcaaagataaattatggcatgcttgggaagggacacctttcagagattgcatttgttttgggcaaaattgttcttgaaactatgagtagtggaactgttggggatggggaggattctgaagctggacaatgccaccttaagactgagggaaccaaagaaattgctcaatcgcaacttccagatctagtaaaccatgaagtggcggcaatgaatggtgaaggacaccttttatcaataccaaattcagaatgtaggcaaggaaaaagcaagaaacggaaattggttaagaatagatgcattgcaaagaagaaaatgagctccgggaaccaagaattatctgagaaatttgaatacaaggaaaataaagaggagcaacagaagctagttaagttaagccagaaggttgatatgtctacagaggattctttgcccaaaaagaaaaatgatcacagaaaacagttgataagtgataggaagaaaatcaccagtgccaataaaagttttctacaccaagctaagcatatgaagacggatgaagacagcacatgcatgccatcacaatctacggtatccgagaatcatcaggtgatagctaacagcaacatagacgtgaatgcaaaaacaacaaatgagtcgaacttaaagaagaagaaaaagggtttatcactagttgaaatgtttaaagggaaataa

SEQ ID NO: 50804 - DNA, 579 bp, Glycine max
  Peptide Sequence Number=SeqID_142489
atgggtgggtcttgcgttggaagagtccacttgggagaaggtgggataatgatagcaccaacagcagagagaacaaggaagacatctcacgttcggcgcatgaaaaggaccggaatcactgaaagcactagtgttaatggaggaatcagtagcattaacagcaataacatggtgtttccgcgtgtggaaactgggaacttgaaggagttcaatttcgcggatcagaaagcagcaaccaagagtttcaagtcggatgcattgcttggtgaaggaggctttggcaaagattacaatgcaaaaatttcagattttggcttggccaaattaggcccttctggggaagattcacatgtgagtacgagtatcatgggaacatatggctatgctgctccagaatacattgcaacagggttaagggcacttgacaaaaaccgcattatagagcagcagaatctaattgaatgggcaaagtcttctctctctgataaaagaaagttgaaaagcatcatggatgagaggatagaggatgttcttgacacattggaacgcatcgaagctatcaaggatacaacgaagtaa

SEQ ID NO: 50805 - DNA, 969 bp, Glycine max
  Peptide Sequence Number=SeqID_142490
atgcagaaccagaacccttctgaagatgattccaccaaaaagtctccatcttctccctctgatgacacatcccatccaaccaacaacaacaacaatccgcagggtgaaagccttgtcatgaaaaccgtttggcaagtgttggaggaacttggtggcagtggtgatgatagtgacggtgacagtggctttggtgatggggcccctgtggctgtggcagtaggtggtggtggtgatgataatggtgatggtgatggtagcgttggtggtggggccactgtggctatggaaaagagtgatgatgatagtgacaataatggtgacaatagtggtagtaatttggctgtggctgttgtcgtgggtggtggtgacggtagtggtagtagtggtgttggggccactgtgactgtgtctgtggcagtgagtggtggtggtggtaatcatggtggcggtagcagtggtggtggtggtgggggtcctgtggctgtttctgtggctgtgggtggtggttcaacggtggtggagagtgtggttgtgagtactgaaggagtgcaggggagaaagagaaagacttctatcgtgagagaccctcccacaggaagacctacttgtcctctttgccaaaaagagtttccaacctggaagggcgcgtttggccacatgcgtgcacacccagaccgtgattatcgcggtttctttaaacctcctgtgtttggatccccatcctcaacccaagatcaaccacctagggatgacaagggtgatgatagtgcaaagaagagttctggtgaggttaacaatggggagaaaggttcagcatcatcgcatgttcgagtgccgatgtttgatctgaatgaaccaatagaggaagagggatcctctcatgctgccgagcctgctgaagacatgagttccgaggagggaaagggttttggatttgacttgaatgagatgcccccagctgaagattaa

SEQ ID NO: 50806 - DNA, 468 bp, Glycine max
  Peptide Sequence Number=SeqID_142491
atgaaactgaccaaatacaggctaaagacccaagtggagaaggacgaagacctaagtggagaaggacaaagcccccgagtggagaaggatgaaggctcagaggcaaagacactatcaagactattaattacttatcaaggtaatccttgtggcgtctatcctgacttatcttccttcactggaagtggcgtctaccctgacttatcttccttcattggaagtggcgtctacccagacttatcttccttcaccggaagtggcgtctaccctgacttatcttccttcacgggaagtggcgtctacccagacttatcttccttcatcggatgtggcatctaccctgacttatcttccttcaccggaagtggcgtcatccaaatcttcgtagcctgtatcaagcgatctgctcctactcaggttcacatcatctgggccttcaaattagtttgggccttcagcaacaattaa

SEQ ID NO: 50807 - DNA, 309 bp, Glycine max
  Peptide Sequence Number=SeqID_142492
atgggaacatatggctatgctgctccagaatacgttgcaacaggtcaccttcatgtgaagagtgatgtttatggttttggtgtggtgctgcttgaaatgctgacagggatgagggcatttgatagaaaccgccccatagagcagcagaatctagttgaatgggctaagccttctcgctctgataaaagcaagttgaaaagcattatggatgaaaggatagagggtcagtattcaaccaaggcagcattgaaagcagcacagattaccctaaaatgccttgaacgtaaccctaaaaaagtcctcatatga

SEQ ID NO: 50808 - DNA, 321 bp, Glycine max
  Peptide Sequence Number=SeqID_142493
atggtttccaagaacaacactgtaactttgtgtgttgtgaaaggatggggaagagggtcgaggtgtgtgccttttgagtacatatcaacaacgaccatgatcgttgtgaaaccattggaaactggtaatcttgtgatgaaatccatggataaatcttcccaaatagtcgaaggaatgggcaaaggttgcaacaagcctgcaggtgctgaagctgctgtctcgctaagcctggaccatgtgcttagcgagcatcaaccgctaagcgagacatcagcccgcttaacgagtaaagggaatcttggagataatatgccacgctag

SEQ ID NO: 50809 - DNA, 1176 bp, Glycine max
  Peptide Sequence Number=SeqID_142494
atgaattgcaaaatcaaaccaaaccaagcccgccccttcaccgtggacaccaagatttatggcctgccgaggaagacatccatgattgttgctgttaagaagttggggaaaaggaagcaacactttcgctatgctacaagcaagagagagatgcaatgtggtgggatgtgtgacttgcaagaggtgggacacgtagagaggggcgacacatacccacaagcccaaacatcagtcatctccttcacaggaaccctaaatctgaaactacctggagtccgttctgccacggctgagaaaatagcgacgcggaaacacgctcgtcttcacgatcctgcgatccagcgcgactggttatcccactgtgcaccatcccgctatagtgattatgtggccaatgttgttaagtggtggcaacatggcggatttttgcctaaccggcataggcgatttatgaagggaggccggctatggtggcgccctaggctgcaatggcatgtttatatgatggaattttggccttccgcagttgataacacggtttgggggctggccgttcctcgtggctgtttggaattgataactatgggtgcaagtataagaaaaatgatgttgtttttttccaggatggtcatattctcaataagtaatgccagatatacttatgtgcatgatcagaaatatccctctgaagatgttgacatacaccatgtcgtatcaaggaggagtaatgctaaatatctttttgtgcacgcctcagcacttcttgtattagcatgtgccttgtatctatatgttcttaaggaaaaagcaatcagtctagtgtattacagcttgctttttgacatatttcttgtcaatttgttacttgggaagcctgttaagaaagagtctgttgtgattatgccagcttttggagtacagcttgagactcattatgtgagtggaaaagtcatccgatactttgttcccattgacaagattctgaaacctgttctaatagaatgtgtgactccagtgacttgttattggactctatcattgattattcgtggggaatcagaaatggtgttagttttcaagaacttacgccctccggtgaaaatgttggcctatgtctggaaggccctgtgtgctgcaactgatagtaaagaagagacctgtactcatgcagaatga

SEQ ID NO: 50810 - DNA, 1509 bp, Glycine max
  Peptide Sequence Number=SeqID_142495
atgtcgtgttcgtcgtcatcggggtcggaggaaggtgatgagggattcgactcttaccggaaaggagggtaccacgccgtcagagtcgccgatcagttcgccgccggcaggtacatagcgcagagaaagttgggttggggtcagttttccaccgtgtggctcgcttacgatactaaaactgagattatttggcttcttgatgtggattgccactacggctctatgaatctacgattccttattttgctcagcatgtgtcacaaaatgaaatctatgcatgttggagtagcggaaaatggcgaatggtcctcacaaaacgtgaccacctggtttcacatggatgatgatttgtcttcatatgttgctctcaagatccagaaaagtgcagctcagtttgctcaggctgcccttcatgagattgaacttctttcatccattgctgaccacaatccaacaaattcaaaatttgttattcaattgattgaccactttaaacacacaggtccaaatgggcagcatctttgcatggtccttgagtttcttggcgatagcttgcttcgcttgatcagatacaaccgctataaaggtcttccattgaataaagttagagagatttgcaaatgtgttttgactggtttggattacttacatactgatcgtggtatgatccacactgacctaaaacctgaaaacattcttctatgttcaaccattgatcctgccaaagaccctttaaggtctggactttccccaattcttgagcggcctgagggaaacacaaatggtggagttacaagtcttattgagaaaaggttgagaaggagagcaaggacagcagttgctaagatatctggaagaagagcatcaatgggaggaataggagatgctgcaaagactggtagaaatattgatgggattgatgtgagatgcaagatagtagattttggaaatgcttgctgggctgataagcagtttgcagaagaaatacagacaaggcagtacagagcacctgaagttatactgaaagctggctattccttctccgttgacatgtggtctttagcttgcattgcttttgaacttgccactggagatatgttgtttacacccaagggcggacaaggttttagtgaggatgaggatcaccttgccctaatgatggaactccttggaaagatgccccggaagattgctactggtggagctcaatccaaggatttctttgacaggcatggggatctaaaaaggattcgaaggctaaaattttgtccacttgacaaattgctgactgataaatataaattttcagtgaatgatgctcaagagttttcagaatttcttttaccactctttgattttgcaccagagaagcgaccgaccgcacgacagtgcctgcaacacccatggctgaactacatggaatctcctccaaatgaaatgagaaatgaatctgctgtggaaaaggtagatgttgggatgagcaaccttaaaatcagggtggaaaagtga

SEQ ID NO: 50811 - DNA, 390 bp, Glycine max
  Peptide Sequence Number=SeqID_142496
atggtgtcatttgattgcattgactttggcagccccgagtctctcagatggcctaatgttggcaagtataaagttgatgttgcttccttcgagtcactagcacttcccgagttacaggttaaagaagacactgatctcttcatcattgacgaagttggtaagatggagttgttcagttcctcattcttccctgcagttctaagagttttggagtcaaatatcccagttttggcttccattccagttccaaaattcggcagagacatacctgaagttgcaaggttgcggaatcatgcaggggcaacttgttttacattgagcgttagtaacagagatgctgttagagaacagatacgctcacaattggaagatatgctgacaaaacactag

SEQ ID NO: 50812 - DNA, 702 bp, Glycine max
  Peptide Sequence Number=SeqID_142497
atgttagtctcattatacgtaatgcttgactttgttttagacttttggactctgttagctgcatctacaggaaggaaagggatgccatcacaagaagagcttgttcgtggccctgtaatccataaggaaaagaaaaaggcattccagggtctattcagctccgtcatcaaagattttactagcagtaaagaaaagcatgtgccccttatggaaaaagaagatcccaaagaaagtatatggaaactctcagcagtattctcacatgcaaactttgtatgtaatgataatgttgataagctgacaatggatgaaaatcagcttgaattaaacatagatgacattggcccagaggatcatggagaaaaacgcaaagaacaaaccatattgggattccttaataagaataaattgcccggcacatttcagtctttgaaaggaagattgaaagagatgaagggaaacaaccaaaaaacatcagataaggaaaggcaacaggatgaaaaagatggcgcgctggatcaaattaagaagaaatatggattttcttcttcctcctatgaatcaaccgctgctaaacgggcacgaatcaagctgcatgaaaacacaaagaaattggggggtatcaaccttcgtgccacagagatgcaagatacagcaaaatcattttcatcattggcaaaacaagtgctgcaacgaagttga

SEQ ID NO: 50813 - DNA, 2700 bp, Glycine max
  Peptide Sequence Number=SeqID_142498
atgaagtgtcgtgtttcaatctttctgttatccctaatccttctcttcttcttcttcttcttcttcttcttcagcttatccgcctcacaatcccaacaactctctcttccctctctaccagcaccctcgcttaaaccggccacggcacttgttgctgccctcgatggcactatgtatttggtggacagtgtttctgggagggttttttggtctttttcaactggatctcccatctaccaccactcctatcgtgctcccatcaatgaccctgaggacaacaacgttaccggtctcatcgaatgcggagatgactgggaattgatcgtccacgatgctcgctttggtaaaacgagactctccgaatcaattgcaaattatgttgctttaacccctaccgaaacaaaggagggagcatcgatatttggatccaaaaaagacactatgtttgaagtggatgctaaaactggagcgcttgttcgaacgcactatgatcttgataatgcttctaatgtggtgttgagtggtgatgatcggctgcagcgtgttacaactacaaagaataatgagcttgttgatcctgcacagctggactcacctgagtttttgctcaagataactaggtctgattatgttttgaaatctcttggtaaagcaggaatagttttgtggactatgaacgtggcagaatttaaggctagattaatttgccaacataatgaaaatccttctggaagggattcgtttgatgcagaggatgggtatgttgtagaccgtggcttagattttgctatgccgtatgcatgttgggacatgaaactgaatgaagtctaccgccaacgcaagaattttctgttacatcctgctgaccctggaagattgtctggtatttatcaagagaatattatgctcccattccatacttcagagctgatgcttccatcacaacctgatatggatggatttatccttggtcagggcggtaatatgatgctacctttgcccatatcaaattctttgccctctttgcaacaaaaactcgatttctgtgagagcaatgataatgtagccatgctcccttggcctcttatggagatcagtacacaagaggaagttgatccaaaaaaggtgattgaatggtcaacaacactaccccttatattatttaccatctttcttggcttttttgttttctaccactatttggtggttacaaataaagaccaaaacagggagttaaattcaagaagtttacctcctaagaagaagaaagcacgcaagtcagtaaagaacaatatcaccattgacaacagacaggataaacctatgtcatcagctgaggaggataaactagcacgtaaggagacaaacactgatacatatacacaaatgcaagttgatggacgcagaattggtaaactgtttgtgtcaaacaaagaaattgctaagggaagcaatggtaccattgtttttgaggggacatatgaaggccgagttgttgctgtcaaacgtcttgtcaaagcccatcatgatgtagcccataaagaaatccaaaatctcattgcatctgatagacatccaaacattgttcgatggtatggggtggaatgtgatcatgattttgtttatcttgctctagaacgttgtacatgcaacttggatgatttaattcatatgtactctgatatatcagagaacccgacaatttgcgaggatcaatattctaatttttttaaaaatgctcgaatcgatacgaggaatgatatgcgatatctttggaaagcaaatggatttccatcacctctgttactgaaactgatgagcatttctataattggagaaagaagaaaaggatctatcgtaaatgtggtgctagatctaaggtggtataggttgacagctcccataaagaaaagggatgtagtttctggacttgttcatttgcatgaactaggaataatacatcgagatttgaaaccccaaaatgttttgatattaaaagaaaaatcattatgtgcaaagctttctgatatgggaattagtaaacgccttcttgaggatatgtcttctttgggtcacactgttactggctgtggaagttcagggtggcaagcaccggagcaacttgttcaaggacgtcaaacacgagctgtggatttatttagtttaggttgcgttctctttttctgcatgactggaggaagacatccatttggagaacgtcttgagcgggatttcaatattgtgaaaaatcaaaaggatcttttcttagtggagtttattcctgaagccgacgatcttatttcttgtttgttaaaccctaaccctgatctcagactaacagcgattgaagtattgcatcatcctcttttttggagctctgagatgagactttcatttcttcgtgatgtaagtgacagagtggaacttgaagacagagaaattgattctgatcttttgaaggctctagaaagcattgctccactggctttaggtgcaaaatgggatgagaagctagatcctgatttcataactaacattggtcgttaccggagatataaatatgacagtgttcgacacttgctgagggtcatgagaaataagctaaatcactacagggaattgcctcaagaaattcagccaagtacatcaaccttgactgcagataatgatggtgataatgttgatgattggttgccatga

SEQ ID NO: 50814 - DNA, 966 bp, Glycine max
  Peptide Sequence Number=SeqID_142499
atgggtgggagctggtgcggttctgcgaagatgccgacgaaggtgtcgagaagggagaggatgactgatggtgtattcagaagtgttgtgggtgattgggtggaagacagttgggctgggttaggaatgggtgttatgtggtacaaggcagagatgctagtccgtggtaatggagcccaacaatttcaaccattgcacccccaggacaatatcggcaccactgagaagggtgctaccattacccaccatgacttgaagggtttgtgtcgatgtggatggaaggtggaggaaacgagcgacgcgggattggatgaagttgtgggtgctccctccatcaatcaagataaccatgtgatgataggcgatggagctatagagacgaaatgtctctggagccgaggggaaagaggctcaggaggagggctggttagtaactggtctagggttggaggatccacgtccggctcgactataatgagggccatgtcttcaggaaataatctcttgaagggtagtctgggtgctgaaggacttgctggtaacggcggcaaaactggagagacctcatggcataattccagcaagagaccagacacgaagcagcttagtagaaatggggggagcgaagcctacgatccgttttgcgaggcactcatattcagtgagatagttattcaccgttcctctctattgcaacttaaacaaggcgccctatggatcatcgtagaaggatggggtgatttgggcgaggaagatgagggtcacaaggtgttcaaggatggagtcaattttagagttgagggtggattgggcttgggaaagggtggcttgtgtctgggtgaggttggtgtggctctaggtaaggcaggtgaccgcctcctcgaggcggttagtggtggttcgacgcgtgttatgcttaggcatgatcgacagcaggtcgaaccagttgttacagctatcaactaa

SEQ ID NO: 50815 - DNA, 2169 bp, Glycine max
  Peptide Sequence Number=SeqID_142500
atgatggaggttgtgattgttgcaattgctgctacacttggaaatcttctgatgggatgggatagttcaactattgcagcgggtatgacctacatcaagaaggaatttgtcttggatgccacacttgaagggctaatcgtgtccatgtcatttataatcggcactgttgtgacaattttctctgggacagtgtgtgatttggttggaagacgccctatgttgataacatcttctatcatgttcttccttagtggtttggtaatgttgtgggcacctaatgttgttattgttctgttagcgaggataattgatggggttgccattgctcttgctgttactcttactcctctctacatatctgaggtagcgccggctgacatcaggggccaattgaacactcttactcagtttgcttgttctggtggaatgttcttggcttacatcctggtgttctcaatgtccttgtcggattcgccaagttggagactcatgcttggggttattttcattcctgctgttgcttattttttactggctgtgttttacctgcctgagtctcctaggtggcttgtgagcaaaggccggctactcgaggccgaaagagttctgaaaaggcttcgtggcatcgaagatgtttcaggggaattggcgttgctggcagagggtctcagccctgggggtgaagccacatccatagaagagtatgtggttgccccagctagtgagcttcttgttaaccaggaagcagagaaagattatataaagttgtatggtcccaatgatgagggagttacaatggttgctcaaccagtgaatggacagggtagcatgatatcccgtagtatgttgtctcagcaaggaagctttggaactctgactggtggtggtcttaaggatcctattgtcactctctttggaagtttgcacgagaatactctccctgagagtggaggttcacgcagtatgctacttcataatgccaacagtatctttagcattggagagacgtcgagtccctttggtaccagtgacaacctgcatgcgccactaatgtcatttcaagggggtgctggggagaaggatagggcttatgggtccaaggacatattaggcatgaggagcaatagcagcctgagaagtaatagtagtttggttcatgggaatgctgttgatgctcctaaaaataccaacattggtggaggttggcagttggtttataaatcagctgatggtgctgggggtgggaaaagagaaggactccaaagggtttatttgcacgcagatactgctgcactttctcactctcagcatgtttcatttgtttcaacttctggctatgacataccgatagatggcggtgaagcatatcaagctgctgctcttgtcagccagtcagttctaggtactcatgatatgttgcatctgacagaagttgctgcaaaagggccaaaatggagagctctgctagagccaggagtcaagcgtgcattaattgttggagtaggacttcaaatacttcaacaggctgctggtataaatgggtttctctactatgctccccagattcttgagaaagcaggagtaggggatcttttatcaaatttgggccttagttcagcatctgcttcttttcttgtaaatatcattacaacattctgtatgcttccttgtatagctattgcgataagactcatggatatttctggcagaaggtccatcatgctgtacactgtacccattttgatagtttgtctcctgatactagtgatcaagcagttctttcaaatcaattctgtcgtcgatgcagcaatcactgctattagtgttgtggtttatgaaagcgtcttctgcatgggctttggcgttattcccaacatcatatgtgctgaaatctttccaacaagtgttcgcggaatctgcatttctctgacttctcttacatattggggttgcaccttgattgtcactttgatattcccctacttgctccagcttctcggtctcactggtgtctttggattgtttgttgttggctgcatcatttcatggatatttgtctacttgaaagttcctgaaacaaaaggcatgcctttagaagttattattgaattctttgctattggtgcaaagcctggtactgatcctgccgcattgggaatcaaaggctga

SEQ ID NO: 50816 - DNA, 2250 bp, Glycine max
  Peptide Sequence Number=SeqID_142501
atggagaataaaagtgcagagaacccgaaaggtacttacatagtccacttggccaaatccgaaatgccatcaagcttcaatcagcattcaatatggtacaaatcagttttgaaatcagcatccaactcggcagaaatgctttacacatatgacaatgtgattcatggattctcaaccagattaacacatgaagaagcatggttactgaggagtcaagctggtattctaaaagtgcaaccagagaaaatatacaagccacacacaactcgaacaccacatttccttggactcgacaaaatcgccgacatggtccctgagtcaaacgaaggaagtgacatcattatcggactcctcgacacaggtgtttggcccgaaagcaagagctttgacgacaccgggctaggaccgatccccaacacatggaagggaaaatgcgaatcaagcgttgatttcaatgcctcaagttgcaataagaagttgataggagctaggtcttattcaaaaggctacgaggctatgatgggtaccattattggaataaccaaatcgcctcgagacattgacggccacggcagccacactgcaagcacagccgcgggatctgtagtgaaaggcgcaagcctattcggctatgcttccggtacagcgcgtgggatggcctcacgcgctagggttgctgtctataaggtttgttggaaagattcttgtgttgtttctgacatattggctgcaatggacgcagccatctctgacaacgtcaatgtcctttcaatatcacttggtggtggtggatcaaagtattacgatgacgatggcgttgcaattggagcctttgcagcaatggagaaagggattctagtttcttgctcagcaggaaatgatggccctgatccatcgtctctcggctccaacacagcaccttgggtgatcacggtgggagctggtacaatcgatcgtgatttcccagcgtatgttagccttgggaatggaaaaaattattctggagtgtcattgtttagtggcaattctttgcccgataataattctctctttccaatcacatacgccgggattgcaagctttgatccattaggaaatgagtgtttatttggaagcttggatccaaaaaaggttaaagggaaaattgtgttgtgcgatcttggaaatattcctatggcagagaaagggtttgcggtgaaatctgccggcggtgtgggcttagtgttgggaacagtggaaaacgatggggaggaacaagcaacagaacccactaatttgccaacaattgtagtaggtattgaagctacaaaagcaataaaaaagtacctattgtatgatccaaaatcgatggctacgattgtgtctcaaggaacaaaggttggaattgagccatcgccagttgttgcggagtttagctctcgtggtccaaatctacttacgccacaggtaatgaaacccgatttaattgcgccaggtgttgatattttaggggcatggacaagacataagggtcccactgattacaaagaagatcataggcgcgtggacttcaatataatctcgggaacatcaatgtcatgccctcacgtgagcgggatagcggctataataaagtcagttaatccaaattggagccccgccgcaatccgatctgcactaatgaccactgcttattcgacttacacaaatggtaaaagtttgatagatagtgccacaaacaaatcgtcaacaccatttgatattggtgctggacatgtgaacccagttcttgcgcttaatccaggactcgtttatgatttgacgaccacggatgattatctccacttcctttgtgcgttaaactacacacccaaaaggatcgagtccgtggccaggagaaagtacaagtgtgatcctcacaaacactacaatgtagccgacctaaattacccttcttttagtgtggtgtataaaacaaacaacccaacgattgttaagcacactcgaactcttactaatgttggggtcgcaggaacatacaatgtatcggttacgttggatattccatctgtcaaaatcgtagttgagccgaatgtcttgagcttcaaccaaaatgagaacaagtcatatacagtcacatttacaccatccggtccatcgccctcgactggttttggttttggacgtttggaatggtcaaatggaaagaacattgttggaagtcctatctcaatatattttgagcctcctggcgtcattggaaactcctaa

SEQ ID NO: 50817 - DNA, 183 bp, Glycine max
  Peptide Sequence Number=SeqID_142502
atgggagagaagacatcacgaaggtacaaatatgttggttcaaagtggaaatacaaggtgtacaaagggagacacttgatgttgcaaggacagaaaaataaagggggagaattgaggagtttcaagccaaaagataaggtgtatgcacattggaaattgaatttttttatcactaagatttag

SEQ ID NO: 50818 - DNA, 315 bp, Glycine max
  Peptide Sequence Number=SeqID_142503
atggcgcgagtggtgactgatggcatcgcgactggcggtgccaacggtggtcggtggctggagcttgaagcactctttttgctttgtggtggtggtggtggtggttttgaagggtccgggcaaaggccttttgcagagcttgaagcactctctttgctttgtggtggtggtggtggtggttttgaagggtccgggcaaagagctctttggatagtaaatttattgggtgcttccatgaacactacacttaaacctaaagctcttgtgtcgtcgtgtagttgtaagttatgttttgaaaaacccaggcttcgataa

SEQ ID NO: 50819 - DNA, 3665 bp, Glycine max
  Peptide Sequence Number=SeqID_142504
atgaccattgatgtgccaccatccggtgcccaaagtgtgaggacaaatagaccttcctttagttctagcaatggcattgaggctaccccagtacacaactatgcatctgttagcaatggtgatggttatgatagtgatggctccaattttgcgccacttacaccaacaactctatcaatggctattccatcagaacttgctggagctgttcccttgattgataaattccaggtggaaggattcttaaaattgatgcataaacaaattcaatctgctggaaaacgtggattcttttctaaaagatccgtgggccctcaagttcgagagaagtttacatttgaggacatgctttgtttccaaaaggatccaatacctacatcaatgcttaagctgaatggtgacttggcaagccgagcaacaaaattatttcaaataattttgaaatatattggagttgatttatccgatcgtgtaactccaataagcttagaagaacaagttgagcttgttggtaaactatacaagcaaagtttgaagcgttcagaactccgagatgaactctttgtccaattatcaaaacaaacgagaaacagccctgagagggaatacttgattaaagcatgggaactaatgtatttatgtgcttcatccatgcctcctagcaaagacattggagcatatctatcagaatatgttcacaatgtggcatatggtgtgactgctgatcctgaaatccgagcccttgcattaaatacattaaatgctttgaagcactctgtcaaggctggtcctagacatataatacctgggcctgttgagatcgaagctctgttgacagggaaaaagcttacaactatagtgttcttcctggatgaaacgtttgaagaaattacatatgacatgtcaacaacagttgctgatgctgtcgaggagtacattgggctagatgacaataaatatattggggatctcctagcggaatttaaggcagtgaaggatcgaagtaagggagatatattgcactgcaaactaatattcaagaaaaagttatttcgtgaatcagatgaagctgtgacagatccaatgtttttgcagttgtcctatgtacaattgcagcatgattatattttgggtaattaccctattggaagggatgatgctgcccagctttctgcattgcaaatcttggctgagattggatttgttagaagacctgaatcatgcgcacaaatagcaatgactcgagcaagacgggaatgggagttggacattctttcttgttatcattcactggcgcatgtgacaaaagaggatgctagacagcaatttctgcatatattgagaacacttccctatgggttttctgttttcttcaatgttcgcaaaattgatgatcctattggactattgcctggacgaataatattgggaatcaacaagagaggagtccattttttccgtcccattccaaaggaatatatgcactctgctgagttgagggacataatgcaatttggaagcagcaatactgcagtattttttaaaatgcgagttgcaggtgttcttcacatatttcagtttgaaacaaagcagggagaagaaatttgtgtagctcttcagacacacataaatgatgtaatgctgcgccgctattccaaagctcgatctgctgcgggtggtcctttgaatgaagacatttctaatgattttaagccttctaatttggaattatacgaaaaacgtgttcaagaattatcaaaacttgttgaagagtctcaaaggaatgctgatcaattgctggataacttgcgtgagaagcaaaaacaagaagaggaaatgctacaagaattagagggcttaaaaagatctttaacagctggcaagcagagtcttgcagaagttacaaatgaccgtgacaagcttaggtcattatgtgatgaaaaagacaaggcacttcaggctgaaattctagagaaaagaagcatggaagcaaagatggccgagttgagtaatctggttacaaagaacactaccaaaaaggactgcactcaaacaaataaccaagtgtcacagaaactcgaagatgacctaaaactatgtaaaggtgagctgcgtgtaactgaagaaactatcaaaagcttgagaagtgataagttgattttggaacagaagctatctgagcttgagaagaagagtgctgaagagattaattctcttcaatggaaacttgagcaagaacgcaaaactctgaactctaaagtgtatgaccttgaacgaaaactggatgtgtttagacaagaattaactgtagctgagtctacactctcggtcaaggactctgaattggctgcattgaagaacaatttagatgaactagaagaattgagagaaatgaaagaggacattgatagaaagaatgagcaaacagctgccatactgaagatgcaagcagttcaactagctgaaatggaattgctttataaggaagagcaggttctcagaaagcgatattttaataccatagaagatatgaaaggcaagataagagtttattgtcggttaagacctcttagtgaaaaagagattgcaagcaaagaaagagattctcttactactactgatgagtttactgttgagcatccttggaaagatgataaaccaaaacaacacatttatgaccgtgtgtttgatggtgatgccactcaagaagatatatttgaggatacaagggcaatgcaatctgctgtggatggttataatgtttgcatatttgcttatggtcaaactggttctggaaagacttttacaatctatggagttgaaaacaatcctgggcttaccccttgtgctactgcggaactttttagaattttaaggagagatagtaacaagtattctttctcgttgaaggcatatatgttggaattatatcaagatacacttgtagatcttctgttaccgaagaatgcaaagcgtttaaaattggatattaagaaggattccaagggaatggtagcagtagaaaacgtaacaattgtgtcaatttctactatggaggaattaaatagcataatacagaggggttctgagcagcgacatacatcagggacacagatgaatgatgaaagttcaagatctcatctcatactatcaattgtcattgaaagtactaaccttcaaagccaatcaactgcaaggggaaagttaagttttgtggatcttgctggctcagaaagagtaaaaaagtcgggctcttcaggtagtcaacttaaagaagctcaaagtatcaacaaatcattatcagcactaggagatgttattagtgctttgtcttctggtggtcaacacataccttacagaaatcacaagctaactatgttgatgagtgattcactagggggtaatgccaaaactctcatgtttgtgaatgtatctccggtagagtcaagcttggatgagacgcataactctctaatgtatgcatcacgagtgagatcaattgtgaatgatccgagcaaaaatgtttcttccaaagagatagctcgactgaagaaattgattggatattggaaggagcaagcaggaaggagaggagaggatgaagatttagaagaaatccaagaagaaagaccaactaaagagaggactgatggccggcattctat

SEQ ID NO: 50820 - DNA, 441 bp, Glycine max
  Peptide Sequence Number=SeqID_142505
atgaaggaggagaatcagatagaggaactgtggagggaagtgagggatttgagtttgggaaacagcggaagagatacgggagagtttgatttggaacttgagaagccaacaaggtatgtgccttggtgcagtgtggatccttatccttctctgaggaccatggatgatgagatggccaagtttcccctgtacttcaatggccctcggccgtttgaatgtactgtgaaggctggcgaggatgaaattcatgcaggccaagtatgtggttccatcatgttagacagggtgcggatgatggaggggtaccatatgcagtttgacattaagtacgcttatttcaacttcttacagtctattcgatatcgatctactccaagtacaatgataaatgataaattgtctgaggagatagattcagattctgcttattatgaatcttga

SEQ ID NO: 50821 - DNA, 159 bp, Glycine max
  Peptide Sequence Number=SeqID_142506
atggcagttaatgagtctaaagaatgggttagtggcaccagaaaaactaaatcgctgaggcagaacatgctgacatcaagaagccactacgggcgagatgagccgatgcctagattgtgtttgtttgtgctatgcaactcgtggagcaatccagtttag

SEQ ID NO: 50822 - DNA, 1290 bp, Glycine max
  Peptide Sequence Number=SeqID_142507
atgggaacctcggtggcggatctagctccgggtctgtcacggaagctgaagaaggttcaagaatctcggatcgacacgccctatctcttgtcttcgctcaacacgctctcttccttctacgacgacaacactcctcaggcgcgtcgcaacctccgatccaccatcgagaagcgcgccctctccatcaactgcgaattcctcgacgcttcccacgccgcgcagctggccttggatagcgtggagaacgaggtcgattcgctcgccgcgtgctgcgacaggcgaagaagaataatgcagttaggaggtaatgaggcagttccatcattccgtgctagcaagcataatagagctgagtatgtgctagcactgctgacattatcggtaccacaaagaggctcaaacaagagcttgaaactactacacaaagagattgtggcatgtttcttacgtgattatcagctctcccctgaagagataaatgcacttagagaagaagagctgaatgaaaactttttcaaggcattgtctcatgtccaagagattcatgccaattgcaaagtgttgcttaggacacatcatcagcgtgctggtttagagctgatggatatgatggctgtgtatcaagaaggagcttatgagcgcctatgcagggaaagatctgtccttttcaaatattgtgcagaagaggtagccaatatgagacacaacgcactatttagaagatttataagtgctcttacacgtggaggacctggtggattgcctcgaccaattgaagtgcatgctcatgacccactacgatatgtcggtgatatgctaggctggttgcatcaggccttggcatctgaacgtgaacttgtagctgtattacttgatccagatacaattaccgattctggtccaaagcaattctccaataactctgaggatggctctgggaagacagaatctgacttgatgtttgttcttgatagaatttttgaaggaatctcagatttacttgggcgagaaactgcactttgtaatacactatgggcactgaaagatgctgctcagaatacattttttgatattttgaaaggccgaggggaaaagcttttgcggtatcccccacttgttgctgttgatctttccccgccaccagcagtgacggaaggggtatctgtacttcttgaaattatcgacaactacaacagcatgatggttcctgcttctggccaaaaacctgcttttggtccagttatatctgctatactggatccaatagttcaggagtaccctgcaccgtag

SEQ ID NO: 50823 - DNA, 384 bp, Glycine max
  Peptide Sequence Number=SeqID_142508
atgaataacttagtttatgtcatgtacaacttgaagttgaaaagtagacaaataagaaaagttgttgctcttccatttgaaaatatgaaatctaatgatgagtggattacaaaacagggagatgatattttttatgaaaacaatgtccaagttaagcaagagcaacctttaggtgaaaatgatagtggaaataatattgacttggttggaaaaagtttaactgacccaactttggatgtatttgatattgacaatttgattttgaatgataatgtgaaagatcacttctcaactaaggaagaacttgaagatgatggagaggaagaaaatgttggtgatagtgatattagagataattttattaaaggattgatggacatttga

SEQ ID NO: 50824 - DNA, 531 bp, Glycine max
  Peptide Sequence Number=SeqID_142509
atgatcgtcactcttaatgatgtgtcatgtctcctacacttgcctgtgataggcagaccaattgatcatgtcccctccaccttcaatagaaaggttgtgaagattctgctcatgactcgccttggcattctgacaaacgaagaggctatagcattgaccactgcaggtgccaggtcttgggcatttgtgcatcttcccactgttggctatttcgagcctacgaccgatgctctggatgacccggtgcgagatgaacgtatggccttgtctttcaaagagggtgctaaggcaatttggtcatgtttagagcatcccatgccatccatcacaacgtctatgtggtttcccaccccctatgccattccatcagagaagagagagccagcatgttctcttgtacgtttatcgcccatcctagtggagctatcgcctgggcagacactggcagagtatgtagcaagtggagactactctttgctaggattgatttcggatggcgtcacgcaccatgtagagcttactagatcttag

SEQ ID NO: 50825 - DNA, 684 bp, Glycine max
  Peptide Sequence Number=SeqID_142510
atggggcatgcttccccctacaaggaagttaagggaatgcccgtggaaaatcgtgatggagaggacatggttgaacttgttagaagctgccaaaatgagtttaaggagtactacattcaaatgcaagcagctaagcgaagtcaagcacctcatccttcacagctatctgaaaaacttagattaacacggcatttcttgtccttttacaactttccatactccctaggcgtcccttgtggggaagagaaagggatagagttgaaggacgataggataattcttgacaaaacattagctgatcaagtgtcatcatggaaaagcagcaggggcctcagtgatacagtggtgactgatcatgcttgttctggggaaacgtgctcttactaccatattggagatgtatttatttgtgagaagactggacaagttcatgtttgtgacgatacatgtagagaagtagttatggatcccacaaacgagcttttggtctgtacaatatcggggcactgttttgatagattattgtcaccttcggaaatggagcctgatactgagcagcagcaaggtggtgtgactgatgaggccgagccatttatgggatctggccgttttgcacgagcttattcactgggatacaattgtgctgatgaaaaggagcttgaagctacattgaggttttgctga

SEQ ID NO: 50826 - DNA, 309 bp, Glycine max
  Peptide Sequence Number=SeqID_142511
atgggaggtggtaaggacaaacacaatgaagaagagaaaggagttttctcacatcttgctcatggggtagctcaagctgctcatgggtaccctcctggggcatcaccctcctcaccaagggatatggtatggacaccctccacaagcaccatcggggttcaagcatggattcgcaagcatgggaagtttaagcatgggaagtttggcaaggcctttgttgattttattggactgagaacggagtcatcacattgtctttatatgaacaactataaaccgtgtatcttggagacttggatgtatatatag

SEQ ID NO: 50827 - DNA, 443 bp, Glycine max
  Peptide Sequence Number=SeqID_142512
atgacggtgatggtgtcgtgtcgtggcgtcgcgttccaccagaagctgaaaaatgatttggagaggctgctagaggaccatgcgactagaggagttcaagaatgtcgttgtcgaaggaagggattggattgggccacgaaggacgtgaaggtggtgaagatcaaatggagaaccgccaaggaaggattaaggttttttggtgatgctcctcccgcgctcattttaagcaacaatgagaaggacaacaagaacaaggaaaagaaggagaagagtgagaaggagaaggttgttaggattgttgggggaagagatgctgggttgaagggtaatgttgtgtttaggattggggatgattatcttgttttggagctttcaaggagtggagaaaaggtgaagatcaaggttggtgatgttgttgaattgggttctaaggaggaagagat

SEQ ID NO: 50828 - DNA, 1437 bp, Glycine max
  Peptide Sequence Number=SeqID_142513
atggaaggaaggcgagaggaggttgatggaggggaagaggagattgtcgtgttaccaaaagtagaggaggagaaacgaggtggaattgagacggtggaggattattggttggttggaaagaaagatatggaactcatccttaaaatggccctatggaattttaaccgtaatttggtgatcattgagaagataaagaattataagaatccaaatatggtggacctttctaagtgccccttttgggttaggatttatgatctcctaatcagccaaagaacgaagacggtggcggtgtccctaaaaaacaatatggtgattggaggaatcaataaggaggtgtttgttgaaggagttatgaggaaattaagaaatgaaggggagaaggagcaaaatgaaggcattgataataggcaagagttgagagtgaaaattgaagacgtagctgattcactattaaaattccgattgtccaatgaggagagttacaacaagaagaatgaagtggccaaggagaaggtggtagaggaaaaagaaggtactaggtcaacaagtgctaatcccaaggaggagacatccttactagccaagcttatgaaatctaaataccatccccatgggtctttatgggaagcactgaaaggatacaggtcgagcttcacttgggctagtatattggaagcgaaacgaatcttggaggaagcccatgaagccactcaagttccaaaaggaatgaaggcagacagtttgtatgggaaacacacatctaatggaatctatagtgttaaatctggatattttgtggctaattcaagatggaacccaacaaaatcaactctgagcaagggaggaggttttgtggaagaacatatggataggagatgcatcaccaaaatgcaagaatttggcctagcgagcttcttcaaatatcctcccagtctggtcgaatttaagggaaaagaggatttaagtggactccctatgtcccattgggtggagttttttattgacataatggatgaggatcctagagcaatgatgtttgtgatcttgtgggcaatttggtacactaggaatcaacatgttttccaaaataagaggatgaaggttcaacctttgttgagtaagatggcttttgttccgctatcaagggaagacattacaatggctcaagaatcaaatttgattccaacctatgggaaaacaccaccactaggcatttttaagataaattttgatgctgctatgagaaaggaagtaggaacgagattgggattcattgtgcatgattctgaaggtttggtgcttgcaccagcctctatgcttattcagtccatgttcgggcctagggaggctgaggcctttacctttcaatggtcaattatcaaggcagcggagttgttattgtctgatgcttgttatgaaatagattgcctgtag

SEQ ID NO: 50829 - DNA, 195 bp, Glycine max
  Peptide Sequence Number=SeqID_142514
atgagggcaaaactcgaaacaacagacgaagtccaagacatcgcaaggcaagaagatacaatacaaaggttcaaccataagcctttcaacctggtgacctcgtatggcgagtctgaggtgaagccagaaaagatccccaagtgggaaagcttggtctcaattgggaaagcctattcatggtcacaacaagcctag

SEQ ID NO: 50830 - DNA, 3048 bp, Glycine max
  Peptide Sequence Number=SeqID_142515
atgactactccaaacgtggttttacgagtgagggacccacctgtagtttgtattcaccgaagccgacaacactcttcagatcactctcattctctgacaccgggaagctcaaaacgacgccgtggagcagctgaagacgctggtggggagggagctgacaatgggctctcaccatggccactcgaaggagtttctggacctcatcaagaccgcatcgtcctccgtgagatcgaaaccctaaaacgcctcctcaacgacgccgacacaccaaaacgcaagatcaaggagtacatcatccgcctcctctacgtcgagatgctcggccacgacgcgtcgttcggctacatccacgccgtgaagatgactcaccacgacgccctcctcctcaaacgcaccggctacctcgccgtcacgctcttcctcagcgacgaccacgacctcatcatcctcatcgtcaacacaatccagaaggatcttgcctccgataactacctcgtcgtttgcgccgcgcttaacgccgtttgtagactcatcaacgaggagaccatccccgccgtgctgccacgtgttgtggatctgcttaaccactccaaggacgccgttaggaagaaggccgttatgtcgctgcaccggttttacctgaaatctccgtcctccgtttcgcatttgctttccaatttccgtaagcggttgtgcgataatgatcccggagtaatgggcgcttctctgtgcccgctttttaatctcgtttccgatgatgttcactcttataaggaccttgtcgttagctttgttaatattcttaagcaagttgcagagcataggttgccgaagacttatgattatcaccaaatgcctgcacctttcattcagattaagttgctgaaaatacttgcattactgggaagtggggacaagcaggctagtggacacatgtacactgtgcttgaggatataattaggaggagtgattcaatgacgaacatagggaatgctgttctctatcagtgcatatgctgtgtggcttctatatatcccaatcctaagttgttagaggctgctgcggatgtaattgcgaaatttttgaagagtgacagtcataatctgaagtacatgggcattgatgcccttggtcggttgataaagttaagtccacatattgcagaacaacaccaactggccgtcattgactgcttggagattaaagcggttggtgattttgacccagatgatagtctgaaacgaaaaactttcgaactgttatacaaaatgaccaagtcctccaatgtggaagtgattgttgacagaatgattgattacatgattagcataagtgatgaccattataaaacttatatagcatctcgatgtgtggaacttgctgagcaatttgcaccaagtaatcattggtttatacagaccatgaataaagtttttgagcatgctggagatcttgttaatattaaggtggcacataatttgatgcggttgattgctgaaggatttggagaggacgatgatgctgcagatagtcagttgagatcatctgctgccgagtcatatttgcgcattattggagagccaaagcttccatcagtgtttcttcaagtcatctgttgggttctgggggaatacggaacagcagatggaaagtattctgcttcttatatcagtgggaagttatgtgacattgcagaggcatattccaatgatgaaaatgttaaggcttatgcaatttcagcactgttgaaaatttatgcatttgaagtagcagctgggaggaaagtggatatcctatctgagtgccaatcgttgattgaagaatcattggcatcacactctacagatttgcagcaacgtgcttatgaattgcaagctcttataggtttggatgtacaagctgttgaaacaataatgccacgagatgcaagttgtgaagacattgaggttgataagaatctttctttcctcaatgggtatgttcagcagtctttagaaaggggtgctaaatcctatattcctgaggatgtgcgcactggaatggggaatatgaacaatttcagaagccaagatcatcatgaaactttgcagcatggtctaagatttgaggcatatgaagttccgaaggctccaatgcaaccaaaagttactccagtttcatttgcatcctcagcagacattgttccagtacccgaggttttgtcttccagggagacccaccatatctcatcagtgggatcaacatctgaggctggatcatcagagcttaagctacggcttgatggtgttcagaagaaatggggtaaaccaatgtattcgtcttcaacatcatctgcctctgtctcgtattctacttcccaaaaaccaacgaatggggcaactcaggtggatggtgctacaactgtcaattcaaaagtgcgtgatagttatgattcaagaaagacacaggttgagattactccagaaaagcaaaagcttgctgcttctttgtttggtggttcaactaaacctgagaaaagatcatctacaagtcataaggtttcaaaatctagtgctagtgctgcagacggatctcagggatcaaaggctgcggttgtacccaatgacgtagctgtggaaaaaacaattcatcaaccacctcctcctgatttgcttgacttgggtgagccaactgtcactacagctcctccttatgtggacccattcaaggaattggaaggacttcttgacccaagcactaagtctgcaacaaatcataatgtagctgctgctacaaatgcccctgatattatgtcactctatgccgagactactgccagtggtggttattctatacccgtgagtggggggtatgatgtaaatcttttatctgaattgtcaaatgcagcagcaaaagctactagtggagaaacaattgtgacgtctttgccacaatctattatgggtcgaaatgctaaagattctttggagaaggatgctttagtgaggcagatgggtgtgaatccctcgagtcagaatcctaacttgttcagtgacttgcttggctaa

SEQ ID NO: 50831 - DNA, 1443 bp, Glycine max
  Peptide Sequence Number=SeqID_142516
atgaatttgcagatcaaatcacccaccccatcttccaaatcagaagagcaggtttttagtgatccagctgttattcagtcagaatattctgggttgcgaagttctccagtgggtgagctgccaagttctccagtggctgggttgctaagttctccagtggcctcagttggtggcagaagtttgacagaatcaattcaaaggcaagatagccctgcaatatccagtaaagcctttccttctgggttgccttctcatcagtctgtaactcagctgggaccttcaaatttatctgatgctactcaagttgctagtcatccatctttttctgcagcaatgtattggcaaggtcccagtgggatatctagcagtagttatcattctctgctacagtctagttctcttcaccccacatcactggcagcatccttagttgtgcagaatcagatgcaaaatgcagaaactcaggtacctataaacgggggatggacaggtttatcagagtatggtctacctgtatcttctgccatgacttctcttgtaaatcagactcattcaccttctcttacctctttaaaaaattctgattctcttgatattccatcccttttgtctactaagacacctgtgtcatattctccatccatgacttttgatggatcaaacatgcctcagttttcttcaacactccaagacataaattctattcaagctcaaatatctggaaacatttgtcctgacccaaggccaattcatcctcaacattctgtccatcgttctgctccttcatatgtagattctacttcaggttccttgccaacagcaacttctttgttaaccccggatcaatttgcctatcctagagaacagttattgtctttatcacatttaaaccctactcagaaggacatgggttctctgactctaacatcctctggttcctctgcattaattccttctccagcatctcaggcaccattgcttccactaccaacttcagtgcaaaagcctccatacacagctccacaatacactgaggagtttgattttgaggccatgaatgaaaagttcaaaaaagatgaagtatggggttctcttggaaagacaactacaaaaatagagggagtggcgaataatgcttctctcagtttgggtgacagagaatgtcatggggtgataccaaaccctaagactgcatacaagaaagatgacttttttgatacaatttcttgcaactctttgactcatggatcaaggaatggacaaaatcgtttctctgagagaatgaaacaggatactgagacatttggcaatttccagcagaggcctaattttactaatggtggttatggtgctggacggggtgctaatttcaggggctcaaataattggggaaggggttatggctacaatgggagagggcgtggtccaaactttcctttctag

SEQ ID NO: 50832 - DNA, 63 bp, Glycine max
  Peptide Sequence Number=SeqID_142517
atggtttgggataacctacaagatgctcccttaacctgggttaatgattccacaccagtgtaa

SEQ ID NO: 50833 - DNA, 1800 bp, Glycine max
  Peptide Sequence Number=SeqID_142518
atgaccatcggtgggtgtggcgtggtactctgtgagcaatgcagagggagaactggggatgtttggtggggtcttcgcggatgtcctggcattgctatgtgtattcaagatgagcttccagctggcaacgaagctcttcaaggaaggtcagagaagtcactgacagaatcatggacagggaggactccgatgactagtgataatggtgaagtgctgaccaagaaggcactgcctccaattcttgaccatcgaggtgatagcaaacaattctcggacatatgtggaagcacggaggagtttcatattgaatggtttgctgaagaaggcaatgagggcagtggaaaacgcttgtttcagttgctcaaaagccaattgggcttgcggggtccatacaaatggctcaatggtggcggtcttgaccatgggggctgcaatagtggcatagcatatgatgaatctccggtgagcctcaaaggaagcactgtatatgaggatattgtcaaagaagatgatgatgaagtggtggaggtatggccggaaaatcaagttcattgtggcttggaaggaagatggcacgttgcacaacccaaacaacattactttgaactcgtaatggctgtgatgggttctgaaggtgggcttggggatatcagcatcatggaacctatccctgaccgtcaccacgttaagagcacggtagtcgatgcaaaacctccacgtaccatcctgcttctggacaagcaacaccggcgacgagaagaggctcgtgctgggttgaataagccctttctgaagcatggaatcaacctgaagctcaatctcctgcttttgatagtgaggataacagtagggcctcacgttgactggaggggagtttgggaccaagtgaatataatgatcgatggacctagccggaggaaggctctggggtgtgttgatgggaagtgggtcaggaggatcttcaagaaatacaacaatatggaagtaggaaacatcgtcgtgtttccgatagaggcgacgaaactgggacatggttctgaatggtcaaagaaactgattcacaaaggctggtgcactccaagtattgaccatttcccgccatcactcgtaatggggtttgagtggtccgacagggcaagctcagggcgaaagcctgtgaggcgcaaagtttccggtgccaaattgcccgataacgaggtcaagctaatttgggccggggtctatatgaggccaactggggtcttcatcttccacgataagaaggaaaaccctagaggtgcaacaatgccctctatggtggtgagggcaagagaggcaggagcatcgtgggacgaggagtcagggatgatgggcctgggctttgcggcgaatctctggcatcaagccgaagatgaagcaactcaaaaggaacggggccgacaaatcgataatgtgattagccaagtcttcgaactccgacaggaatgtgggccaggaggtaaattgggcgttgctgtactggttgatcttaaagatccaaccaagaggttcggtgccgtcaaaacgaggcatttctatcttcattttgtgggtggttgcaggaatagaggtggagtgggtcatcgagtgcatggtatcgccaagacgagcaaggacatcctcgagatggctggagaagcctgcgtgcttgtggaagaagaagacacagagaagagaagagaaggaacaaagaaggataagacaacatcaagcaaggaggagatttttcctaaggtgacttcgctgatcatcatccattcttcctcagacgtagttgttgag

SEQ ID NO: 50834 - DNA, 1257 bp, Glycine max
  Peptide Sequence Number=SeqID_142519
atgtcgtcaagaacaagtttttccgtggtgcatggtgagcctgaactggtggtgccagcaggaccaactccgcgagaattaaagaacctctctgacatagatgaccaagaagggttacgttttcagcatcaggtaataatgttctaccaaaagagtcatgttatggaaggaaaacaccctgctacggttataaaatatggtttggctgaagcacttgtacactattacccactagctggtaggttgagagaatggcctaatagaaagttaacagtggattgcagtggtgagggcattttgttcgttgaagctgaggctcatgtttcactcaaggagctaggcaattccattctgccaccatgcccccacatgaaggaactcctccttgatgttcctggatcacaaggcattctcggatgccctctgctgttgtttcaggtaacccgtctaacatgtggaggatttgctttcgccgcacgcatgaaccacacaatctgcgactcactcgggctagttcaatttctcaccatggttggtgagattgcaagaggtgtttctatatcacagttccctgtgtggcaaagagaactattcaatgcaagagacccaccaagaatcacttatgcacaccacgaatatgatgaaaccaaacattgcagcaacaaagatacaatggactttgaccaaatggcccacgagtcatttttcttcggcccaaaagagattgcaacccttaggagtcaccttcctcagcacctaagaaaatgctcaacttttgagatactatctgcttgcttgtggaaatgtcgcaccaaagcacttgggctggagcccaatgagatagtgggcttatctccctttattactgctcgtggcaaagtgggcctacatgtgcccaatgggtactatggcaatgcctttgcctttccaatggcgctttctaaggctggacttttgtgccaaagcccattggaatatgcattgggtttgataaaaaaggcaaaggcccaaatgggtctagaatatgtgaaatcagtggcggatcttatggttctcaaggggcctgcaggggctataccttttgttagcttctatggacggtttagaaacaatgaaggtgaggatggggttgttgtgccaattttgttgccacaccatgtcatgaagaggtttctctttgagctggtgaagatcacaagtgagagacaaccaacctatgatggaatcgcgttgcctttagacgctatgtgcatgtga

SEQ ID NO: 50835 - DNA, 324 bp, Glycine max
  Peptide Sequence Number=SeqID_142520
atggcctcccaatttgctagtgagcctcttatggagaaagaggaaaccgttgctcactgtctcatcgccaaaactatggctaccatcgattccaacccgaagaatggaacttcagagaacatcataataataacaaaaccatgggatgtgaaaagggtccaaaacgtggcacaaatagaggtagacaacaagcacaaaagcttcacagtcataaaggttaaggccttctacaatggatttcttggagatgttgctggcgaagcgaaaatgggcattgaagcacctactgaggcatatttctcagtgccagttcttccaaattaa

SEQ ID NO: 50836 - DNA, 1800 bp, Glycine max
  Peptide Sequence Number=SeqID_142521
atggcggggcaatcgcggaagtggatgattctggtggccaccatatggattcaggcattcaccggcaccaatttcgacttctccgagtactcatcttccttgaagtcccacctcaacatctctcagctgcaactcaactacctcgccaccgccagcgacatgggcaaggtcttcggctggtcctccggcctagctctcatgtacttacctctctccctcgtcttgttcatcgcctcctccattggattcatcgcctacggcctccagtggcttgccatcaaaaatctcatcaccttgccttattatctgttctttcttctgtgtctgttgagtggctgtagcatctgttggttcaacacagtatgttttgttctctgcattaggaatttcccagttaacagaccccttgcattatcactcactgtgagtttcaatggtgtgagtgcagcactctacacacttgctgcgaattcaatagacccttcatctgatgcattgtacctgctcttgaatgcccttgttccccttctcacttcccttgcagcactagtcccaattcttctccaaccccctttagactctctcaatagatctccagaagcttctcgcaggaactcagtgatatttctagtactcaacttcctagccattttcactggcatttacctccttctctttggctcatcaacttctgatgaatccacgtcgaggctctactttggtggtgccattttgttcctcatatccccactatgcatccctggcactatatatgctcgagattggtttcaccatgccatccattccagctttcggatggaaggctccggcttcattcttgtccatgtcgatgatcttgagctgcataaggaactcctcacgcgtcaaaacagcactctcagtctcagcaatggggacggtcatggcctgctgagtgagaatggatccaagtatagaagtcagagtgcaaaatctagtgatgtgtgttgtggcaagatgtttggccaggatcagttggcaatgctaggtgaagagcacactgctgcagtggttgtccagaggttggatttctggctctattatgttacatacttctgtggaggcacaataggacttgtttacagcaataatctgggacagatagctcaatctttaggcctcagttcaagtatatctacccttgtcacactctactcggcattttccttctttggccgcttgctttcagctgtaccagactatattagaaacaagttctactttgcaaggaccggatggctagccattggacttgttccaaccccagttgcattcatactgcttgctgtatcagacagtgccgcggcacttaaaacaggcactgcactgattggtttgagttctggcttcatattcgcggctgctgtggcagttacatcggagctatttggacccaacagtgtgagcgtcaatcacaacattctcataacaaatatccccattgggtcgcttctgtttggttttctggctgcgttgatttatgatgagaatgcttacaaaatcccgggagagttaatggctgacacactggtgtgcatgggaagaaagtgctacttctggacatttgtctggtggggaggaatgtctgtcctaggactatgttcaacacaggccatggaattgttgatacttgaaggtggatgtataggggttatgattttggaggcagagctgaagcaagggagagtgaagattttgtttctctctccagcaatgcaccaaacaggaaaaacatggaagctttggaagcatgaggtttga

SEQ ID NO: 50837 - DNA, 1005 bp, Glycine max
  Peptide Sequence Number=SeqID_142522
atgcctcaaccacattctccctctttcctcctctgtcaacaacactactctttctctttccaacaacattctcaaactctcaccccaccttcacctttcacttttcccgacaaccaccaacacgaccaccttctctctctactctccaaacagcgcgccacgcattcctctttctcccctcgccacgacgtcgttcgttggatttccacagtctccgacttccacgccttcgctcctctcaccaccgttctcgccgttaactacttcgacaggttcgtcaccaccctaaggtttcagagcgaacaaaaaccatggatgactcacctggcagcacttgcttgcgtctctctcgccgccaaagtggaggagacacgagtgccacttctttttgacttccaagtgggggaatcgaaattcttgtttgaagcaaagactatacagaaaatggagctcctagtgttgtccactctcgaatggaaaatgaaccctgtcaccccaatttctttcttccaacacttcctcgctaggcttggtttaaagcgccacttgcattcggagtttctgtgtaggtgccaacgtcttcttctctctgtcattgcggattcaagggttatgagttatcttccttctacactggctgctgctataatgatccacattattaaagagattgaaccattgaatgctacggagtaccaaaatcagcttcctggtttacttaaaactagtgaggaacaagtgaatgagtgctacaaactgattctgggactttacgtttgcagcaacggcattcacaatttgaggcgcaagcgtttgtccgaacctagtagtagcccagatggggtcattgatgcatctttcagttgtgacagttcaaatgattcatggacagttgcatcaccttcagttgagccagtgtttaagaggagaaaacctcaggaccagcagatgcggttgccttcagtgaatcgagtggttattgatgttctaaatactcctcgttaa

SEQ ID NO: 50838 - DNA, 1719 bp, Glycine max
  Peptide Sequence Number=SeqID_142523
atgaatccatacgcaaatcccggccacgcccctgtggttgcgcgagtaacacacgcgcctccacccttaagttccacgcgctgctttcttttacgttttaaaatccttccatacctctccgccacttcctgcacaaaccctcccttctccatgggacagtcaccgtccacctccgccgcgcctccgccggacctcaaccgcctccaaattgctcagttacacccaaacaccgattctgattccaccgattacaccctgcgtctctccgacgattgcttggccgcaatctttcatttcctgaacaccgccgatcggaaacggtgctctctggtatgcctccggtggcgccttgtcgacggccagaggcggcaccggctctccctgaacgcacagccggaattactagacttcgtcccttccctatttaaccgcttcgactcggtcacgaaactcgctctacgatgcgaccgaaagtgcgcgagcataaacgacgaggctttggttctgatctcgctgcggtgcaggaacctcacgcgcctgaagctgcgcgggtgccgtgacataacggaactcggaatggccggcgtaggcgacaactgcaaggcgctgaagaagctatcgtgcgcgtcgtgcatgttcggcgcgaagggaatcgcggcggtgctcgatcgatgctttactttggaagatctaacgctaaagcggctacgtggggtccaccacatcggcgacatggcggttggtgccgcggcttcgttgaaatctatatgcctgaaggagctcgttaacgggcaaagctttgcgccgcttttgattggttcgaagaagcttcgaacgttgaaggttattgggtgcacgggggattgggatgagactctggttagggttggatgttccaacaatgggttggttgaggttcacttggagaagcttcaggttaccgatgtagggcttgttgccgtgtctaaatgtttagggttggacactttgcacgttgtgaagaccgctgagtgctccgacgtggggctttgtgcggttgctgagaggtgtaagttattgaggaaggttcacattgatgggtggaggactaataggattggtgatgatgggttggttgcgattgccaaacactgtcttaacttgcaggagcttgtgttgatcggtgtttatcccactttttcgagcttggcggcgattgcgtctaattgcgggaatctggagaggttggccctttgtgggattggaaccgttggtgatgcggagattgagtgcattgctgataagtgtgttgcactcaggaagctttgcattaaagggtgccctgtgtctaatgctgggattggggctctagcttcggggtgtcccaatttggttaagcttaaggtgaagaagtgcaaaaggattactggtaaaggggtagagtgggtgagagaacagagggtttctttggcgtttaattatgatgatagtgaatttgaagctttggatgggggtgcaagtgatggggttgggggagctcaggataatacggtagagtttctaccaaacatcatcaaccaaactaccgtggccgaggctgaggcttcttcaagtaataataacaaccgaatgacaatgttaagatcaaggtttgggtttttggctggtagaaatttagtaccgggtgccttcagaaggtggtctaacagtgataatgtctccagtagcagttttggatga

SEQ ID NO: 50839 - DNA, 123 bp, Glycine max
  Peptide Sequence Number=SeqID_142524
atggcggacaaatgcgactacagtcccaattgtggccaagttactgttgcagacaattcacagagtcaagttgtggcttatttcaggactcaggagtattttggtgtgtggggtttagtgtga

SEQ ID NO: 50840 - DNA, 618 bp, Glycine max
  Peptide Sequence Number=SeqID_142525
atggcttctctgctgaacctcccggttttggaggttccacttttggagggagcgcgcgacgtggatggagaagtgggagccgatgccgctggcgacgtagacggtggggccgagggagccgagggcgcaccagcggcggggggtggagagggtggggccaaaggaccaggttttggtgagggggtggaagatcaaggggcgggggagggccggggagaggttgtgggtggtggcggcgaggaggacgaggcggttagcggcggagacggactggacggagaggttgcgggagaggaaggaggggtggcggcggaggagaaggtggtggaggggtgggtggggagggagggggagccacgtggcggagatgggatcgaaggtgtggaactggatgacggcggaagagtgggagtgggagagaatggcgtagagagaaaaaaagggagggaaagaaggggaggagacctgggatcaaaggttgttcttcttgttgatgaatatgttgttcttgtttttggcgtttggttgtggaagaagaagaagaagaagacgactcaggcatggctatggccatgggatgggactgtggggaaaggaaaggatagaaagtggggttag

SEQ ID NO: 50841 - DNA, 747 bp, Glycine max
  Peptide Sequence Number=SeqID_142526
atgaaactcactcccacaaaaccattcatcctaaggtgcttcctcatctccctcttcctctcccttcccttcctcttcctctacctcttctacccacaacaacaacaacatcatatcacaaccaaagacctcagaatccgaccgggttactcctcctacgaatcctacattcagcgccagctgaacaagacccttaacccaaaactccgaaaaatatggacaacacgcgactggaaccgcaagatccccgtcttcgcgcggttcttcgaggaccttaaggtgaaaaagcttctaaaaaacacgtccaaggcgttgtgcatcggtgcacgagtggggcaagaggtggaagcgctgcggcgaatcggagtcgttgattcggtgggaatggacctggttccgtaccctccccttgtgatgaagggtgacttccacaaccaaccgttccaaaacgacacgtttgatttcgaattctccaacgtgttcgatcacgcgctgtacccgcagaggtttgtgtcggagatcgaacgcacgttgaagcccgagggggtgtgcgttctgcacgtggctctgtcgaggcgtgctgataagtactccgctaacgacctctacagcgtgcagccactcgtggagctattcaagcgttctgctttggttcacgttcgcagcgtcgatggttttggattggacaccgaggttgcgtttcggaagaagggggaacctcctcctgctgctcatcaccgtttgtga

SEQ ID NO: 50842 - DNA, 492 bp, Glycine max
  Peptide Sequence Number=SeqID_142527
atggggttggggatggagaaatcggcgaacatgagaaccagcaagccaagcagaaagggaatcgacagaaagaagaggaaagggaacaaaatagcgagaacccatcgcaggttagggctcggcggaatcaaagtgctggtgatgccggtcaccggtggccggaaccatttaaccggtgatcggaggaaagggatgtatgtcttgaaaactgtcatgtattcgttggatagggtttttagtaaggcagttccaaagacactttttgaactgtggacgaataggacacctagtataaggcaccttataagaattgtcaaaagtggaaatgtaaggttcattgaaaatggtgaaattagtgggagtatagttccacgagaagtgaaaattaaagaagttagagtgcaaatccctttagtttttattgttacaaacaataatgaagaagtcaaaggtcctgactccccggtgctcaccatcgggcatccagcacac

SEQ ID NO: 50843 - DNA, 445 bp, Glycine max
  Peptide Sequence Number=SeqID_142528
atggatagggccaattgcaacatcatggttggtggattagttgacgatgttgggatagatatgagtagaaataccatagatccttgcttggggcaatacaaatattttcagatcttagactattcaaaacatcttttaaatctaataagtttaggtcatgcattaggagctggtagaggtagaggcattagtgaggatgcacatgaggctgatgttcctcggcgtcgcaggcctactgcttcagcacgtaggcaacgggttcgtctgcgtgagggcgtcactgagagacctgaggatgtgcctcagttgcatgaggatgttcctcatgtgtctgatgccaccccagagatgacaggcgccgtcgatgctgttcagacagagggagtggctactgatgggagcttggggtcacctgctgcagatgagggattccccggtggaccac

SEQ ID NO: 50844 - DNA, 1577 bp, Glycine max
  Peptide Sequence Number=SeqID_142529
atggtagctgtattcaacaaagagcttttgagctggtacctcatcacccttaaactcaaagaaaccttagaatctgggataccgtcttctcctaattcgggtaaccgatcaactgagtttccccagcagcagcaggaacctacagaagcattgcaagttgtcatcaatgaagatggtgaaaaatttgaagaggaaccaaactcaccaacatctgaatgggtggtaaccatcaaggaaaaactagatgaagcgggtcaagaggatgtggcaagttcatggtccaagctatcaatctacaaaatccctcactaccttagagatggtagtggcgatgacaaatcttttgcaccccagattgtgtccataggtccttaccatcatggcaaaaaacgccttcgccaaatggatcgccataaatggcgttcccttaaccatgtcctcaagcgtaccaagcatgacattaggctctatctcaattccatgaaggagattgaagaaagagctcgctcctgttatgaaggaccaatcagtctaagcagcaatgagtttgcggaaatgcttgtccttgatggttgttttgtgctggagctattcagaggagccaccgaggggttcaagcaacttggatattccaggaatgatcctgttttcgcaatgcgtggatcaatgcactctattcagagagatatgatcatgttagaaaaccagcttcccttgtttgttctagacagacttctgggaactcaattgggaaaaccagacctgaaaggactagttgcaagtctatcactcaggttcttcgaccctttaatgccaacagacgaaccgttgacaaaaagtgacaggaacaaattggaatcatctcttggaggcactaacacctttgaccctttgtctgatcaagaaggtcttcactgcttggatgtgttcaggagaagtcttttgcgctcaggacctcaaccagtacctagaatatggatcaaacgccggtcaaatgctcaaagagttgccgacaaacggaggcagcaactgatacattgcgtcacagagcttaaagaggctggaatcaagttcaagaagagaaagaccgatcgcttctgggacatcaaatttaaggatggcaaactgcgaataccacggctcttgatccacgacggtaccaagtctttgttcctcaacctgattgcctttgagcagtgtcatcttgattgcagcaatgacattacatcctatgttatcttcatggacaacttgattaactccccagaggatgtggggtaccttcattatcgtggcataattgagcattggcttggtagtgatgctgaagttgcagaccttttcaaccgcttatgccaagaggttgtgtttgacatcaataacagttacctttccccattgtctgaggatgtgaatcggtactacaaccatagatggaatacttggtgtgcaagcttgagacacaattacttcagtaatccttgggccattatctctttggttgctgctgttgtcttgttactacttactcttgcacagacctattacggtatatatggatattacagaccagccag

SEQ ID NO: 50845 - DNA, 121 bp, Glycine max
  Peptide Sequence Number=SeqID_142530
atgagggatgacgaggcagttccaaagagagagaaagagaagaagaagaagaagaagaagaagctctggattccacctcttcccgtccttcgagacggttgttgtgctgcttgctcttcag

SEQ ID NO: 50846 - DNA, 2778 bp, Glycine max
  Peptide Sequence Number=SeqID_142531
atgatgagtgattcaacaaacaaattccaagcgaggtttctgaaacacatgcgattagcacacaaggacatagaaaatagggaacttttagcaatcatcgcacacaaacgtcttcgggttggggttggggtttgttcccctttcgccaccacagtaaacccatgcttggccttgctttgttgttggcaacttcccctttcgacggtgtacagagtgggaatccttgcagcccttagatcgctcaagacccgctccgtcatcggcctcatgatcaccgcctcacacaacaaagtctccgataacggaatcaaaatcgctgacccaagcggcggcatgctctctcggcattgggaacccttcgccgacgccctcgccaacgccccttctccccaacgcctcctcctgttgataaatgaattcgtggagaaagaagggatctcggtggatggggactggcaagtcgaatcaatcttcccgcggattttgaagtcttcatttcacaatgtttatcgcgtcaaccattcccgaccccgaaaaccaccatttccgtttccgaaaagaaccgaatgcgacgagtctctgcttctacattacctatccaatgggtggcacgacgacgcgcgaaacctcctccaaaattcctctggaggtgacctccactcgcgcgttgttcgctggacctcgctactctccaacttctcccgccacggtttcgtgaccgaagctcgcacactcttcgacataatgccccacagaaacctcgtctcttacaacgccatgttgtccgcgtacctccgctccggcatgcttgacgaggcttcccgcttcttcgacaccatgccggagaggaacgtcgtgtcttggactgcactgctcggtgggttctccgatgccgggaggatcgaagatgcgaaaaaggtgtttgatgaaatgcctcagagaaatgttgtttcgtggaatgcgatggtggtggcgttggttaggaatggggatttagaggaagcgaggattgtttttgaggagactccttataagaatgtggtttcatggaatgctatgatcgcggggtatgttgagagagggagaatggatgaggcaagagaattgtttgagaagatggagtttaggaatgtggttacttggactagcatgatatctggttattgccgtgagggaaatttggagggggcttattgtttgttccgggctatgccggagaaaaatgttgtttcttggactgctatgattggtggctttgcttggaatggcttttatgaagaggcattgttgctttttcttgagatgttgagagtttctgatgcaaagcccaatggtgagacctttgtttctcttgtttatgcttgtggtggtttgggtttttcttgcattggcaagcagttacatgctcagttgattgttaacagctgggggattgatgattatgatggtaggttgcgaagaggtcttgttaggatgtactctgggtttggtcttatggactctgcacacaatgtgtttgaaggtaatttgaaagattgtgatgatcagtgttttaattccatgataaatggttatgttcaggctggtcagctggaaagcgctcaagagttgtttgatatggtacctgttcggaacaaggttgcatccacctgcatgattgctggctatcttagtgccggccaagtactaaaggcttggaatttgtttaatgacatgcctgatagggattccattgcgtggactgagatgatttatgggtatgtgcagaatgagctcattgctgaagccttctgcttgtttgttgagatgatggctcatggtgtttctcctatgagttctacatatgctgttctatttggagccatgggttcagttgcttatcttgatcaggggcggcaattacatggtatgcagttgaagacagtgtatgtatatgatttgattcttgagaactctctaattgcaatgtatgcaaaatgcggggagatagatgatgcatataggatattctctaacatgacttaccgggacaaaatttcttggaacaccatgatcatgggcctttcagatcatgggatggccaacaaagctttaaaagtgtatgaaactatgcttgaatttggaatttacccagatggccttacattccttggtgtcctgacagcatgtgctcatgtgggtcttgttgataaagggtgggagttatttcttgccatggttaatgcttatgctattcaacctggtttggagcattatgttagtattatcaatcttctgggccgagcaggaaaggtgaaggaagcagaggataaaacaaatgcagatgttgctaggcgtgcggccaaacggctgtttgagttggaacctttaaatgcaccaggtcatgtggccctttgtaacatatatgccgcaaatgataggcatattgaggatactagtttaagaaaagaaatgaggatgaaagataagggtatgaaagcttcagagcaggattactttgaacagctttcaagctcattcaggtgcttagtggatttgatcccagctgaaaaatgtaagtttgatggggtgaacaacaaagtggtcgtggatggagctaatggggttggtggagtgaaacttaaagatttagggaaattgttgaatgttttgattattgaggttcggaacagcagtgaagatggaggtgtactgaatgatggagttggtgctgattatgtgcagaaagagaaggttctttcaaacaactttggttctaaagacactgggataaggtga

SEQ ID NO: 50847 - DNA, 282 bp, Glycine max
  Peptide Sequence Number=SeqID_142532
atgatgttcaacctgatatcggaggattggcgaggtttcgtcacatcatggctcgttcgtgcagacacatacttcaagcactcaagttggatacatgctctggattctccacccatggcctctactatatcgatcgtaattgtagatacgaaaaaagagggtacattaagcaaaagtggcaacagaaaggaagaaaaagaaggaattctgaagcaggcccagcccaacagtggcgctaagcgcgcatcaggcgctaagcgagcaactaactgcaagcgctaa

SEQ ID NO: 50848 - DNA, 256 bp, Glycine max
  Peptide Sequence Number=SeqID_142533
atgcgacttaggactgcatctggagacgttgtccctatcaacttagaaattgaagccacttgtcggcgtaacaacgctgcaagaagaagaagggaacaagacaccgaaggaagcagttacacctcacctcctctttctccacatcacgctgaaatggacggggaaccggcacgaagagtcaccctagagagtcaccctagaggacttctccaacaccgccactcctcagttcttcacgagcattgcaagaccggag

SEQ ID NO: 50849 - DNA, 2118 bp, Glycine max
  Peptide Sequence Number=SeqID_142534
atggatgtgcttctgaaggtggcaatccaattacccatattttctccacccgtttgcccgaacccgactcgcgatcgttgttccacggagctccgtttctcgcgctggaacaacgccaacgccgagaagttcaaccggcgccgccgaactatccaggaaatcgaagacgaaatctgccgcactcgccgcttcacggccgccgacaacatcaccaacaccgctttcgccgccgattccgccgcagccgccgaaacgttcaaatccctcggaactccctccgccccgtcacaaccttcaattccggggaagaaatcgaagtactccaagccgccgccgaagccgaaacccttactcgattcgcaccccgtggtttcgcgagccgcgagcctcgaatttcggccgggaccggagaacgtcagaatcggcgacgacggagtttcctacgtcgtcgacggcgcgccgttcgagtttaggttcagttacactgagactccgaatgcgaagccggtgaaattgcgcgagccgccattcgcgccgttcggaccggcctccttgccgcggccatggacggggcggaacccggtgcccccgagcaagacgacggtgaaggacttccacgcgctggctctgccgccgccggatgaggaagaggttcaaccggttcggttggccggtccggtttgggagtcgagagatgaggtattgggagaaccgttgactaaggacgaaatcaatcgcttgattaaagccacagagaaatcttcgcgccagcttaacattggcagggatggtttgacacataacatgttggaaaatatacatacttattggatgcggcgtagtgcgtgcaagataaagtgcagaggagtgtgtactgtggatatggataatgtgtgccagcagttagaggaaaggactggaggaaaaatcatttacagacaggctggcacagtgtaccttttccggggcaaaaactacaactatgaaactcgtccacgatttcctttcatgcggtggaaaccggtgtctccagtatatcctaggctaattaaacgagttccagaaggtctaacacttgaaaaagcaactgaaatgcgtcaaaagggaagggacttaatgcccatatgcaagctaggaaaaaatggtgtttactgggaccttgtgactaatatcagagaggcatttgaagagtgtgagcttgtgcgaataaattgccaggaactaaatacaagtgactatcgaaggattggagcaaaactaaaggatcttgtgccatgcgcactgctttcatttgaaaatgaccacatacttatgtggaggggacaaaattggaggccctctttaccagatcccagagatgatgacaaggaagccaataaaattaatgttgacaatggaaattccaataaactgccttcagatgcccaagaattgtcagcattgtgtctacagaataatccagtagagaatctaagcaatgaacctcttgacataagcattttatctaattcagatgatgtgagtttgtacaaggctgtgtcttgtcccacagaaaatagcaaccaactggtgtctgtggttactgatgctgcttcactttctatgaaatcctgtgaagctgaaactacagaagatgccatggtcgcttcttgcgagccacaaatgttgcctggaactaataacaattctgtgagtaacatagtagatccttattctgacaagtttccaggagcagcagatgttagtgagacctcaagatctgcactctgcacggaaggaattttatcactgttggagcaagctgttgagaaaggcagtgcactagttttagacgatgaatttttggatgatgacctcctttatcaaaccacagtggcttttgctaaatcaactccacccgagcctgtttataagctacctaaacaggttgtcattgtaaaaagtgagaggcaagaaggtttaacgctggagacagaagaaattaccagtgttacaaggataggtgaaaaaatgaataagagttctaaaattagaagaaaagaatatggtaggggatctctgaatgtattagtaccacatagaacgataaacgtagataaacttgcaattctgaaatga

SEQ ID NO: 50850 - DNA, 264 bp, Glycine max
  Peptide Sequence Number=SeqID_142535
atgaattgtttgcagcccagcctcattacaagcctagaaagtccttcggattcaagttgtgaaaagatgaagaagaagaagaaggttgcagcaactggtgtctcgctaagcaaggcatatgcgcttagggagcaacatccgctaagcgagacactcagctcgcttaacgagttaggagaatctggaagagaatctgccaagcatgcacgcaccattagctcgcccagcgagtcatttgtctcttttggcgctaagcgcgcctaa

SEQ ID NO: 50851 - DNA, 708 bp, Glycine max
  Peptide Sequence Number=SeqID_142536
atggcctctaagaagcgcagagcttgtaccagtcagccacaaagggaggaacccacatgggactccaccaaatttgtctctgaggacaacattcatcttcgaaacattcttccggaaaagaacgtggagctcacttatactcagtacgatgaatttcttgaggagttggaacggagggacgccttcctggagtggccgatcatcattccagagagggagcacctgaccactttttcccaatttctacacacctaccttgaccatcggaccattacggagaagctctgcatgccaggtggccagtttatactgaatgctgaagggactccatggaagattttgtggaaggacttgaccactctcactcagacatggactgtcttgtcctacttcaacttggctcccacctcccacacctcatatctgaacatggaccgcacccgactaatttatgagcttggctctggccgctctaaatgctccgctagtcattcctccactagcaattcctcgtctggtctctactctaccttcccttctctctactcctcccgagcatctcatttctatgatgtagagtcttcaatagggccaatatcttctcatgcagagtcttcatcaactctcccttcatcagccactggtgatgatgatgttgcagaggccagtgatgatgatgattatattgcagatgtcacaactgcttag

SEQ ID NO: 50852 - DNA, 1272 bp, Glycine max
  Peptide Sequence Number=SeqID_142537
atggcttttgcattgtccagtcagttctgcgagagcctcgtgacggtgtgtgataagaagaagctgaaggttattttccttcccttcctatcaacaagccatataattcccatcgtagacatagccagattgatccacacggtgaaattccctgcttcccaagttggcctccccgacggggtcgagacctttaacgttagcactcctcccgacatgatctctaagattggaaagggcttgtcgttgctccagggagagatcgagcaactgtttcaggatctcaaagctgattgcattgtcaccgacatgttctatccttggacagcggatgctgcggccaacctcggtattcccagattgatgttcctcgggggaagctacctctcccactctgcccaacattccctcaaaaaatacgcgcctcaccacttggagatgacacgcttgcagagctatggttcgttgtttgataccttctatgaccttgagggtacttaccaggagcattacaagacagtcaccgggaccaaaacatggagcttaggaccagtttccttgtgggtcaaccaagatgcttctgataaggctggaagagggtatgcaaaagaagaaggttggttgaaatggctcaaatctaagcctgagaaatctgttctgtacgtgagttttgggagcatgagcaagttcccttcttcccagcttgttgaaatagcccaagccctagaagaatccggtcacagtttcatgtgggtagttaagaatagggatgaaggggatgatcggtttctggaagagtttgagaagagagtgaaagcaagcaataaaggctatctaatatggggttgggcaccgcaactgctgatactggagaattctgccattggaggattggtgactcactgcggatggaacaccatcatggaaggtgtgaccgcagggttgcccatggcgacgtggcctctgtttgcggaacagttctttaacgagaagccggtggttgatgtgctgaagattggagtggctgtgggagccaaagaatggagaccgtggaacgactttgggaaagaggttgtgaaaaaggaggacattggaaaggcgattgctttgctcatgggcagcggagaggaaagtgcagaaatgaggagaaaagctgttgttcttgccactgctgctaagacagctatacaagttggaggctcttctcatactaacatgttgggattgattcaagagctcaagtcactcagatttgaaggaaactgcctaccatga

SEQ ID NO: 50853 - DNA, 693 bp, Glycine max
  Peptide Sequence Number=SeqID_142538
atggagagtgaaggaagaagagaaggaggagagagagaaacaacagcagcgacgaggaaggtggagggtgctgagagaagatacaaaggaataaggatgaggaagtggggcaagtgggtcgctgaaattagagaacccaataagcgttcaaggatttggctcggttcctattctacccctgtcgccgccgcacgtgcctacgacacggccgtcttttacctccggggaccctccgcacgcctcaacttcccggagcttctcgtcagagaaggcccggccgccctagtcgccggctgcgacatgtcagcggcttctattaggaagaaggccaccgaggtcggtgctagagtcgatgctcttcaggcaacccttcaccaccactacgtgcccccgcggcaacttctctctggcggtggtggtgggtccggggatttcccggtgcgggttgttgacctgaataagatgcctgaacccgagagttcggactgtgagtgggatcgcgggttgaggcaaagtgatgttgttgatgaggcctatggtggtgtggagtactgtactgggacagcaatggcctacggtgcccagcagttgggtacaaaaggagagattgtgaaaggggaaatagaaatggaacgggccactgccaagggaaaacgttgtagccatgggctctgttttgacaacgatggatga

SEQ ID NO: 50854 - DNA, 1536 bp, Glycine max
  Peptide Sequence Number=SeqID_142539
atgtgggatctgaatgactcccccgatcagagaaaggactacgagtctgaaggctgttcttcttctctgtatgatgataaaggcaagagggtggcatctgtttccaattcaagctcctctgcggtggtcgttgaagatggatcggaagaagaagacagtgaaagaggtggaagcagaacattggataacaagaaaaccaacaaaatattcggcttctctgtagctcatgatgacagtgaccacccacccgtcactcatcagttttttccggttgaggactccgaacttccagtcaccgctgccgccgccgcggccggaagctccttcccacgtgctcactgggtaggcgtcaaattttgtcaatcggaaacacccggcgccggaaaagcagtgaaagtgtcggagccgatgaagaaaagccgccgaggaccacgctcgcgcagctcacagtatcgaggagttactttctacagaagaaccggtagatgggaatctcatatatgggattgtggaaagcaagtatatttgggtgagtattacgatgtggatgattgcatatgtggtggatttgacacagcacatgcagctgctcgtgcgtatgatagagctgctattaaattccggggagtggaggcagacatcaacttcaacatcgaagactatgaggaagacttgaagcagatgaccaatttaactaaggaggagtttgtgcatgttcttcgccgacaaagcactggatttcccagaggaagctccaaatatagaggcgtaactttgcataagtgtggaagatgggaggctcgaatgggccaatttttgggcaaaaagtatgtctatctgggtttgtttgacaccgagattgaagctgcaagggcatatgataaagcagcaataaaatgcaatggcaaagaggctgtcaccaattttgatcccagcatctatgatggtgagcttaattctgaatcctcaggaggtgtagctgcagatcacaatttggatttgagtttgggtaatttgatctctaaacatagcaatagtcaatcatcgaggaatcacttcccaaattctgcaaccgatcagcatatgccacctgaatctaattggcagagtgggggaagcaagcctaagctggttaatatacttccaaaaccatgtggtagaagcaacatggaagcctatgggcaaggtgagagtgaaaccttgaggttgctaagccaaactcaccttcaatccccaaccactaaagaaatgcacagatatggtccgtataggtcgccagcagagccacaaatgcctcacaatttcgcacatcatcttcaccaaccaagttttcatgttcctagcagcagcagcaaccgaggccgtattggaagcgatctttcgttatcaatgtccgatcaacaacaatggcaacaagccgggcctccacatttgttagcaactgctgcagcatcatcaggattcccacagcaaattagaccctcccaaggttggctgcagaaaaatgggttccactctctcatgagaccctcatga

SEQ ID NO: 50855 - DNA, 1011 bp, Glycine max
  Peptide Sequence Number=SeqID_142540
atgctttctgctgttctcaagttcctggctgatgcaactgctatgtgttttgctcctcacaaccacggattatttttaaattacacatcaaaatgtgcgcaacatatcatatcgtcgttggactggctacatcataaccaaattcaatttaaggaagaggataaaagaaatattatattttgcctgaaaggctctttcacctatgcagcaaaaatactcaatgtgatactcaccgagtctagtggatcctcaataactctaccaaaaacttttgctgttgccaataacttgcttgatttaataatttcaattgaatcatgtatgggctcagggtatgcaatgcgtcttgttgcagcagcaaagacttggcttcctgatgtgcttctggcattgggatctactagtatcctaaaacatactgactgtggtgaggaacattcaactgcacctgaacaaatgaagttgcattttccaaaatggccattgattttagccaagactgagctcttcaaagcaaatgaagccgaagacaatgaatcctctcgaccagaaaaattctcagcgttcagcaagcttctggaaatgctgattatattactgaaaaaaaatcccagtataatggatgcagtcggtgtaattttcatggtttcttcacttattgggctagaacagaaggactttgggctggcattaggactcttgcggtttgtaggtcttaagttgtttaaacctgatgaccgggattggggtgacatgatgctctcttgtctgcaagaaatctttcccaagatagagaggggaattgcagaagaaaatgacaaagatgagctggagaaattaacctatgcaaaggagtttattgaacctctttggatgtatcatctgtatgaaactggaaggtttgccatgtctcagtcaattggggtgacacaagattatggctatgctcaaggaaatagcgcttttaaaataatggaacggacagttcaggatcaccattatagaacataa

SEQ ID NO: 50856 - DNA, 84 bp, Glycine max
  Peptide Sequence Number=SeqID_142541
atggtggcggagcttatcggagccgaaccggaaatggaaatcggatcgagatccgaatcatgcagtattttggttgttgggtaa

SEQ ID NO: 50857 - DNA, 1701 bp, Glycine max
  Peptide Sequence Number=SeqID_142542
atggcgtcgaagccttcgccttcgccctcgccctcttcttccagatcagagcctctcgtcgatccctccgctgaaagtggagatgtagctgcattgtatatagtgaaggatattcgagatgtggcgaataaagtggagggttcaagtccgactgctaaagatgtgctgctggttattgattctttgaagaaacaagttgctgcagaacgagttgtttatgtaaagaaaagaatagaggaaaacagacagaagctggttggtgtcactaaccatctctgcacaatgtcaacggagagaaggaactgcagcattactgatacgaatagaagtctggacctactgacaaagaggcaaaaagatgcaattgatatgcacaatggtgttcatgcgagtaatggtgacgtggagagcaacggctatcatgatgataaccatggttctacagcagttcttctagggtctaatgttgccgtaaagaatgctgttcgtcccatcaagttacctgaagtaaaaaaattgcctccttacactacatggatttttctggacagaaatcaaagaatgaccgaggatcagtcagttgtaggccggagacgaatttattatgatcagaatggtggagaagcactgatttgcagtgacagtgaagaggaaactatggatgatgaagaggagaaaagagaattcatagaatcagaagattatatacttcgcatgactgtcaaagagtttggtttaactgacattgttctggagtcgttggctcagtgtttttctagaaacaccagtgaaattaaggcaaagtatgaaaccctcagtattcatgacaatgctggcgggtgttccaaggctggagattctgaagagaattctcaaagtggcaatttttttctggaaaaggatcttgaagcagctcttgactcttttgacaacctcttttgtcgacgatgtcttgttttcgattgtagattacatggatgttcacaggatcttgtcttccctgctgagaagcaacctacatggaaccctcctgataccgaaaatgcaccctgtgggccaaattgtttccgatcgtcagaaagatttgccaaaacatcctctgcccaggctgatgaagagaagtcctctggtggtgctttatctaggaagaagtcttctgctaagaggcggataaaatgtagccaaagtgaaagtgcttcatctaatgcaaagaacatatcagagagtagtgactcagagaatggtcctggacgagatgctgtctcagcctcccgctcagcacctcctaaaactaaacctgtggggaaaggtggaattggtaaaaggaacagtaagcgagtggcagaacgagtcctagtatgcatgcagaaacggcagaagaaaacaatggtttctgattctgattccattagtgaagctcttgaccgttcatcgaatgatatggtcactgacccacatgccatgagcagtgaagacaacatgaggaaagaagagtttgtagatgacaatgtttgtaaaccagaaatcacagataataaatcttggaaagctcttgaaaaggggcttttagagaaaggaatggagatttttggtagaaacagcatgcaagagtatgaccactggtccaagtgtttatatgaagttaagcttgtcttcagtcaatttcatggggaatggatgggtataattttgaagctttga

SEQ ID NO: 50858 - DNA, 1830 bp, Glycine max
  Peptide Sequence Number=SeqID_142543
atgaggagcttggaaactttaaaggaattggttgcaactattacagattggaagtcgcttaagaagatggtttgcaaaccctttaagccttgcattttgcatttggcaatatcacaacatgtgacccagttgtatagcgaagaagagttggttcaattaaataatttcagaaaactacattcaagtgttgaatcgaagtcaaagacaaaaaacactgatcagagggtgaccggaaaaagacaaatcgaagggatgcccaaagaggaaagacccatgccagcagtgattaaaaaaccaaaaaagataatcttgatgcagaacaaccaaacaccagatttgcctgcagaaatcaagaaccgagtcactgagttgaatggtcatgatattaaatttctcatgcacaagaaactcttctgttcagatgtgaaaccaaatagcaatcgtttgtcaatgccaataaatgaaattatgtgtgaattcctgacagaagctgagattgcaaaattggatgaaagagatgacactaatggaaaaggacgacttgttggtgtggaaagcattcgcatacttctgctaatcgctatctgtctcttcacctcttcctccgcttccaagatcggagaaacttgcgggtcagacaacaaatgcgacgctggactcagctgccaagcatgtcctgccaatgggaatacccgaaccagatgttcgcggatacaaccattgagccccacctctagggtgaaaggcttaccgtttaaccgctattcatggctcacgactcacaactcttatgctctggccggagccagatccgccaccggatctgtccttgtagcccctatgaaccaggaagacacagttgctgaacaactcaagaacggagttagaggatttatgttggatatgtatgattttcaaaaggacatctggttgtgccactccttccaaagcaaatgtttcaacttcactgcatttgtaagtgcgtggcccctgctttctagtttcttcaatgtgacacaacaacccgccataaacgtgcttaaagacatgcggacatttctagatggaaatccatcagaaattatcacgatcttcattgaggactatgtcacagctcctcagggcctaacaaaggtgttcaaagattcagggctgagcaagtacatattcccggtgtctcgcatgcccaagaatggtggagattggccaaccgtcgatgacatggttcagaagaatcagcgcctagtcgtcttcacctccaaatctgccaaggaagcttctgagaacattgcttatcagtggacatacgttgtagaaaaccaatatggagatgatggcatgaaagctggttcttgtccaagccgtgcagaatcacccgcaatgaacacagagtctagatcattggttctggtcaactactttcattctgctccaaatcgatctcaggcctgcgctgacaattcggctccactacttgatatgacgaagacttgtcatgaagcagccggcaatcgttgggccaatttcattgctgttgattattaccaaaggagtgatggcggaggagcaccactagccgttgatgaagccaacggtcatctcacttgtgggtgcgacaacatagcctattgcaaggaaaacgctaagtttggcacttgtgatgtccctcccatttctccacctccacctgctacagaaaccctctccaccggaaaccagcagacccaaaatgataatcacacaaacaatgcttatattggtagaacggccaagctgatgcaatcggttgttggaattttggctacgacaactttcttggcatggttatag

SEQ ID NO: 50859 - DNA, 1188 bp, Glycine max
  Peptide Sequence Number=SeqID_142544
atggcttctaccttgtcatgcaactctttcaatcactcaatggcagttttctcaaaatctcatttctcaattcttatgtacaaagagctttcactggatatttcaccttgtgtgagttatggaagcagaacaacaaagcaaaggaagacactgatgcagatcaaagcaacagtggcagaggaacctcctggtgtttggaaaactgtggttgtgtctgaaaatggaggaggaggggatggtgcccctcagaagaagaagaagcttaaggtacttgtggctggtggaggcattggtggttttgagaaggatatgagtgctataagaggggaggggcagtataggggtccaattcagatacaaagcaatgcttcggctgatttggaagctatagatttggaggttgctgaagaagttatgagagctggttgtatcacggatgataggatcaatggcctcgtggatgggatttctggctcttggtacatcaagtttgatacgttcactcctgcagctgaacgtgggcttccagtcactagagttattagtcgaatgactttacaagatatccttgctcgtgcagttggggaagatgccataatgaatgacagtaatgttgttgattttgttgaccatgggggcaaggtaacagtggagctggagaatgttcagaaatacgatggagatctcttggttggagcagatgggatatggtccaaggtgaggaaaaagttatttggccaaatagaagctacttactctggctatacttgttatactggtattgcagattttgtgcctgctgacattgaatcagttggcttgaattttccagctggaaggtaccaagtattcttaggacataaacaatactttgtatcttcggatgttggtgctggaaagatgcaatggtatggatttcaccaagaacctgctggtggtgctgatatccccaatgggagattctatcctattttccaccctcatcctcaagttgggaaaaaggaaagatttcttaagatattcgagggttggtgtgataacgtaattgatttgatacatgccacagaagaagaggcaattcttcgacgagacatatatgacaggacgccaacatttacatggggaaagggccgtgtcaccttgcttggtgattctatccatgccatgcagccaaatatgggccaatga

SEQ ID NO: 50860 - DNA, 1884 bp, Glycine max
  Peptide Sequence Number=SeqID_142545
atgtggcacgaggcgaggaggtcggagaagaaggtccacgacatgatggacgcggctcggaagagagcgcaacgacgcgccgtttacctagccaagaggcgcggcgatcctcagcaatctattcagctcgtcggctttcgaagccgaacctatcgcgacgacgctctctaccaagccacgcaggatcagcagggcctgataccttggaatgggaaacaagatgtattgattgacagatttgatgggcgtgctctccttgatttcattcgcgattctagccacaggcgcgtcccggaaaagtctgaagaagaagaagagttagaagagtttgttaattttgagcgttatcgggatttaataaagcatcgccgtagaggatgtcggataagatacagaaggttctatggttccgcggccactgatttctttgttttggttttgaagttgaatttacaaactaggtttttaatcttaacagtttctgatgaggaggctttgcaacatgtaaatcaagagatggaggccaaggctgctgctccatttacatcagacagatctaatttgtcgcagcctgctgcaagcaaaggatcttactcgcaggttgggttttcttatgatgggaatggaaaagaagaaacccatatttcagatgatgacgataatgataacgaggaagaagaagatgatgaggatgatgaggattttaacagtgatgatagcaatgatgaaggaatggaaataattgcaaaagaatatggagttaaaaggtatggttggcttgtttacatggataagaaggctaaggaggaagaaaaaaggcaaaaagagttgatcaaaggtgatcctgcaattaggaagctgagtcgtaaggaaagaaggaaggcttctcagattgaaagggagagagagagagaagccacacggatatctggaactcgtgtgctgcatcatgatccctaccgggaaacaaggcaaagtcctacatatgaagcctattctcgatctagaaggtcaaggtctccgttgcggtcatactctccgtcgcattcaaggcgttattcgcgtagtggtcattctgatgatattcaccgaagcaaaccaaggactcctaaaatagaatacattactgaatttgggggctctggagcagcagatgaacgcaggcctgaaggattttctccaccacgatctcctacatctcaagttgatttgttaaaccggccaacatctggttgcatacttgaggcgttgcatgttgatcctgcttctggtgtatcaattgataaggataagggcactaaagtcttgaaaccgtcagtaagtggttcttcttcagcattagcaaaattaaaggctggtggttctggagggcccttaaaacaaggggagaagaaagaaactcctcaagaaagacttaaaagaatcatgaacaagcaactaaacaaacaaattaagaaagatactgctgcagaacttgccaagaaaagggaacaggagcggcagaggcaggaaaagcttgcagaaactagtagattgagtcggtatagatgccgcagccgcagcaggagtttcagcggttcccctccaagctgtcatgctattttgaatcctctaaaagtgttgtcgcaccgttctaatactatgataaatttgtccaaggaagataccggcgcagtagaagtccaagtagaagcagaagttccagaagatattattctagttctcattcacggtccccttctcgcacacgttctccgtctccttattctcgatctcccagccttgaagctgttgagtccgggtacggcaaagaatgggcctagagccgttcgtgatcagggactatggtcattgcctcattggtctctactctctaccccttaa

SEQ ID NO: 50861 - DNA, 117 bp, Glycine max
  Peptide Sequence Number=SeqID_142546
atgcaatggcacaataatgatggagaggagttgtgcttgtcgagccttgaaggtgacaatgtgcggcatggaagagatgggataggaaggtggcgcaaggagaaggtgagaagatga

SEQ ID NO: 50862 - DNA, 3318 bp, Glycine max
  Peptide Sequence Number=SeqID_142547
atggtgtgtgtatttattgaaccgggatttctttaccaccctgtctgcaatttccatagtagttgtctggagccactcatcgggtctgtgtggacactaagaacatcccaaaaaatttcctctaacgttgtgtcgtatgggtttcccttccccaccactttctgttccttccaccgtcaaaccctaatcatcaacccactccctgccacattcactctccatgttccgcctccggtgtttgtttccttttttagtcttgagtgggagtactgtgattgttttaggttaagcacgtggggattgcttcacaaaacattcacttgttatgtggttctgtcgtgcatcttattctggcttgctggatatggactgtgctctttgaatgggatacaaaacccaccagattatgatggttgtgcatcttttgagagaagttatgatttgggttcttcagacgctactgttagtgactctagtttaggctatgggtttccatctccccataacagttatgaaaatgtctgtccgaaaagtcattcgttctgctttccatcaatgttgtctggactttcacataaagagaaaattataaaggaagcttctctaggagaatctggcagtcaatacaacagtccattttgtgcagagttacctcaagatggcaggcaaacaagtaaccaaagctggtcagctgaacatggtgtgtttaggttacttaatggaggggttgtctcatgttctttgaacaccagagaggaagtggatggcataccacctcttccaaccgaggttggttgtaaagatgacatttcttcttgtggaggctcttcacttaagcagaagacaacacgtttttggtcaacgaactctgaggtttccaaatcaaattcttttgatggttctgtctcacccaatgtaaggattggccctactatgctggactggggacaaaaatacttgtattcttcttcagcagcctttttaactgtgacaaatacatgcaatgatagcatattaaacctctatgagccattcagctcagacttgcagttctacccttgtaacttcagtgatgtttcactaagacctggtgaatcagctttaatttgttttgttttcttccctaaaagtctgggcttgtcatcagctagcctgattttgcagacaagttccggtggattcatagtagaagctaaaggatatgctactgagtgtccttttggaattcagcccttatcaggtgtgcaaatttctcctggtggaaggctgagcaagaatttttcattgttcaatccctttgatgagaccctttatgtgaaagaaataactgcctggatatcaatttcttcagggcataattctgttgaaactgaagcaatttgtaggataaatgactttcaggttattgatgcttggctcttcccaactattaaggatcgattggttgtgaatagtggtcattcaccaatgatagcaatcaggccccataggaattgggatattgctccacatggctctgaaaatctcatggagatggatattatggttggatttgagggaaaaatctttggtgcattttgtttgcatttactgaggccctcacaagacacatctgatactattatggttcctattgaagctgaagtagatagtcattctgcttgtgatactgttggtatatttatttcagcaactcttgagggtctagccacatgtgatagtggtgaaattgctatcactatctctcttaggaatgatgccccgtatgttttaggttttgttaaagtcatggaggtttctgacactgagcttttccgtattaagttcaaagaaggtttactgcttttccctggtactgtgactcaagttggcattatttactgtagtcacctgcacttggatttgcatgactttgcacctaaagtctccaacttgcgagagaactgcaaactgttgattcttactaatgactcaactagtcccctgattgagattccatgtgaggacattttatatatttgttttgaacatcataggaaaatgcattcatctgatcaagtagaaggcaagtccaaacatacccaatttgacagtaggagaacagggtatatgggcagaagcatgcaattgcggccaaatctcaaggttggaagctatgtctctaagtggatcactgtaaagaatcccagtcaacatccagtggtgatgcagcttatcttgaattcaggagaaataattaatgagtgtagggatttagatgatttattattcccttcttcatctagtaatttggttctagatgaaggtgctactccaaaaaagtatggattctctattccagagaatgcactaacagaggcttatgtgcaccctcatgaacatgtaactttggggccaataattttttatccatctgatcgatgtgggtggagtggttcggcattgataagaaacaatctttcaggtgttgagtggatacctttaaagggatatggagggttgctttctctagttttgctcgagaggtctgagcatgttgacaatgtagattttgatcttaaaatgcccaagacactcaacttttctcttccatataccttacttcacatgaaagagataagttctgcctgttcacaacatttagtgaaagagttatatgccaaaaacactggagacttgccattggaggttaaaagtatcagagtttctgggagagagtgcgggttggatggttttaagattctttcttgtaagggttttgctcttgagcctggggaatcaactaaacttctgatatcatatcaaactgatttttctgcagctgtggtgcatcgagatcttgaactcgtcttggctactggtatttttctgttacccatgaaagcaagtttcccttattatatgctaagtagctgcaagagatccatgtattggatgcgattgaagaaatcccttggatttattcttgttgcatccttaatatttctgatattttgtttcatatttcctcaaaccactgcattgggcttcttggatttctcttgcaagagtgatgataacttggtccacaccaccataaaaagtgcagagaaaacccctatgctacatcatgaccagagaaagagtaagctctctatggctagtgagatgaatcatctaatggaggcctctagtggcaaatattcctatggccaaggcaatccatctgaactggaaatatctcaacagttgacacacaaatctgaaaatcatgaacagactagtcatgcattggatattcaaagtgaaagaaaattgtcatcctcttcagaactctga

SEQ ID NO: 50863 - DNA, 1782 bp, Glycine max
  Peptide Sequence Number=SeqID_142548
atggaaactcgagggagcaaggcaatggtggctgcagagaaaaccgtgaaaaatgggcgtcgatccaatagagaaaggaaaatagccttgacacaagatgttgataagttgaagaggaagctcagacatgaagagaatgttcacagagcgttagaaagagcattgacaagacctttgggatcccttcctcgtcttcctccttatcttcctcctcatacattagagcttgtggctgaagtggcagtattggaggaggaggtggttagactagaagagaaggttgtgaatttcagacaaggtctatatcaggaagctgtctacatttcctctaagaggaatgcagaaaatttgagggactcaatggaccagaactccatcaggagctccaaacatcaaagatcaaagtctttgtcccaaagtgagctcaattcaactaccatggctaggcctcaaatttctcttgctagaagtgcttccagtagaaggctgttctctgacattttcactgatcactctggcaagctagtgaacgggaaactattgcacataaatcaagattcactatcatcaatcccagaagagggacggcgaaaagagaatccactgttttatagctctctgaaggataagcaatctccagagaagaaaacggccaaagtcattgctccagtgaagaagtctccaatcaaaaaagaatcagctgataagtgtgtagatcacttgaagttacagatggaggggagattagtagatcaagaaacagctgagagttcttcaagttcattacatgataaggtgtcagaagttgatagcacacccaaccgaatttcggaggatattgtcaagtgcttgtgtagaatatttgtgagagtaggcacattcaaggaaaaattaggggaatcaaaaacacctctcagttctacatctgtatgcagcaaggaaaaggatcagttgtgtgatccatatggtatctgttcagaatctaaaatgagggatattggtacatacaatagtttgtgtgagatcaaagcctccaatgttgacctcaatcgaacaagatatgtagtttttctgatccgtaggttaaagtgtctatctaacctaacagacatattcaggtttctactcgggaaacttgcctccgtgagcatgaaggatcttactcatcaagagaaacttgcattttggataaacacttataattcctgcatgcttaatgcatatttagagcacggcatacccgagagtcctgaaatgattgtagcactaatgcagaaggcaacaatagaagtgggggggcagctgctcaatgcaattacaatagagcacttcatcttgagacttccttatcacctgatgtttacctgcccaaaagctgcaaaacacggcgagatgaaattgcgaagcatatttggcttggaatggtcagagcccttggttacatttgcactttcctgtggaagctggtcttcacctgcggttaggatatacacagcatcacaagttgacaatgagttggaagcagcaaagagggattatttacaggcaacagttggcattacaaaaacaaacaagttaataattccaaagttactagattggtatttacttgactttgcaaaggacttggaaactttgttggattgggtttgcctccaactacccattgaactgagaaaggaagcaattgaatgccttgaaagaagggaaagacagcccctttcacagctggtacaaatgatgccctatgacttcagttttaggttgcttttacaccaataa

SEQ ID NO: 50864 - DNA, 153 bp, Glycine max
  Peptide Sequence Number=SeqID_142549
atggaacctcctccatcacaatccattgaagtttctggcaccggatgccaagctggggatgatacacaagacaagatcattaatgaatggttgtcttgctgctatgactgtacacagggtatcttcgatttcttgtgctgcaacttttgttag

SEQ ID NO: 50865 - DNA, 1131 bp, Glycine max
  Peptide Sequence Number=SeqID_142550
atggttgtttgcgacttctgggagctcagtctcgctcagagtcagagaaaaacacccaaatcaaatattatcatggagcccagcttggatttgagactgggctttgtccccaaacccctttccctgtttttcggcgacgtttctgggaacagagacaagtgcgacaaagtggtcacactcgatggcttcgtgcagagattggaggaagagttgacaaaggtcgaggctttcaaacgcgagcttcctctctgcattctcctcctaaacgatggtgcctgcttagtgcttgaatttcaatctatagcgagattgaaggaggaaaaagtgaagtgttcgggaatgcaagatccgcctcttaaaaccagttcaggaggaaatgaaaatgaaaactctgagaagaagaattggatgagttcagcacagctttggagcactcagaaatccaaatcgaggaatgaggaagatgataggtctgtgccagcgaactcaattaatgggaattcgtgtgtccccgagaaggagggctcgcaagttccgagctttggtttgatggctcgtgcttctgaactgagtcatagcaattccaagagtgttggtggagatactagttctggctcctctttgctccgtgttgaggtacagagtcagccacagccgccgcagcatatgcagcagaatccgaggaaacaacggcggtgctggtcgccggagcttcaccggcgctttgtggacgcccttcaacaacttggtggagcacaagtggccactcctaaacagattagagaactgatgcaggtggaaggccttacaaatgatgaagtgaaaagtcatttgcaaaagtacaggcttcatgttaggagattcccagttttttcaattggccaggttgataatggctcatggatgacacaggatgaatgtggggataaatcaaagggaaacatgtcacagtctggttctccacagggtcctctcacacctctgctcctaggaggagcaggatccgctaagggtctctcaagccctggacggaacagtgtggatgcagaagatgagcaatcatcagattgccggaattggaaaggagggctccaccaccagcagcttgaaactgataatcacagcctctaa

SEQ ID NO: 50866 - DNA, 951 bp, Glycine max
  Peptide Sequence Number=SeqID_142551
atggtctccgaatccgaactcatcggccgcctccgcgagtttctccggagctccgacctcaacaccaccacaaccgccaccgtccgccgccagttggaggccgatttcggaatcgatttatccgaccgaaaggcattcattagggaacaggtcgacttgtttctccagaccgaacacaaccaaccacaacaagaggaacgccaaaacgacgacgtcgaggaacaagaagaggatgcgcctaataatcccgaacaaagccaaccctccgattccaaagaagaaaccgatgaagaagaagaaggcgaagaggaagaagataaacctgaacaggccaaaaatgccaagaagaataaaggacgatctaacaagttaggtgatgaggtagtaaagaaaagaggtggtggtttttgcaaattatgtagcctgtctccgcaacttcaggaattcatggaagctccagaaatggccagaactgaggttgttaagcaattatgggtctatattagggagaaaaatttgcaagacccgaacaacagacggaatataatttgcgatgagcgattgcgttccctttttaatgtcaattccatcaacatgttccaaatgaataaagcattgtcaaagcatatctggccattggaatcagatgatgttgtccaggtgaagtccacaccaaaggaaaagcagaagaagcaagagagagatgatgcatactgcatcataacctctatgacagattcagatgaagcaaaaaaaaaggaaaaacggcagaagggaggagggaaatcaggttttcttgctcctcttcagctatctgatgcccttgtaaacttccttggtactggagaaagcgagttagcgagaactgatgtcataaaaagaatgtgggattacattaaaggaaacaaccttcaggtttgtcattgctctgaattgtcctgtgccatatag

SEQ ID NO: 50867 - DNA, 2826 bp, Glycine max
  Peptide Sequence Number=SeqID_142552
atgtgggcctctgttgtctatgcttcaagccaagaagggtttttgcataaggagattgatgaaaatgttaaaagagaaatcattaatcacaggtctctaagacatcctaacattatcaggtttaaggaggttattttaacacctactcatctggccattgtaatggaatatgcatctggtggagaactatttgagaaaatctgcaatgcagggcgttttaatgaggatgaggctcgtttcttctttcaacaactcatatctggggtcagctattgtcatgcaatggaagtgtgtcaccgggacctgaagttggaaaacacgttgttggatggaagcccggcgcttcatttgaagatatgtgattttggatactccaaggatttggaaagtatttataagaagaggaaaactagtgagaagagaattaggagaatgataagttggcaggttggttgggggtgtggggtgaatatagggaaatggaggaacagtggaacaatgacttcttcaaaaatgttggatccatgctcgtttgatgaacgaggtagtggaagcaatatgggtgatggtgtgacccttggtagtggaggaggaacttcgttgctggtcaaagaccccattgatgagtattttatggcggtttgtaaggttgagcttcccctaattgatggcatggatcctgttgggtgtataaatggggtggggactcatttcaaagttcaaagtatgtcggatgaagttgaagttaagttggctaagctaagcatggatggtgctaccatccacttgtttaatttgttgaaggagaccaaagaacatttgacttggactagattgaagcaagcactgagagtgtatggagattgtcattacaacaatatgattgaagatcttttttatctttgtcaaatgggaacaattgaagagtatattgcagacattgtgttcatctcgtggctagttgtaatcggttccatgctgggtatcaatgttattggggtaccattttggagtggtctacaagctgggaagagagaagatgacttgtactgcattcatgaggaaggggaattcttgagcctaagtgtagagaacacacttgaggatttccattcaatcatctctagttacattcaagtgatcccgctctacctgattatcaccggcgccactgtttgctgtcagtccgccgtcagctataactccggagaaaccaggtgtgagatccacgcgtcaccttctaccagtcagaattgtgctctgacagtccaaaaaggttctctttgtgcgaatcttctgtctttgtctcttgttgtgagatggcctccacaaatccttctggagcttcctcctgagttggtcccactgtcagttccactgtcctcttctgttgaactttggttccttggccaaggacatcatgagcactcagaagcagtcagtaaagccaaacatcttagtgaccttaagtctgcagttgaagaattaagaatgttcctagatgctgagttagtggaagaaatgagaagaaagcatgacaacctgtatatggtgctggccttgcgggccatgaacccagatttcgatcatattcgtgatcaagttttgactaatgaagaagttccctcaatgaagagtcttcttacatgccttcttcgtgttcctaatccgagaaagaatgaaaattcacttgagcttactgaatcttcagcaatggtgtccagtcaaggaagaggaagaggaagaggccacgaaaatcgtggacgtggaggatgtggtggtggcagaaatgcaaatgtctccacatcgaaaacacatgagccaaagttttttgaagaggagtatcaagagtacctccagctgaagtccaacagtgcttctgatcatagttctctattcacctctctgtctcctcctaaaattcttcatctaatcacactagcaaatggcaccaaagtcacttctaaaggagtcggcaaaggctctatttctccgtccttaaacttggatccagaatgtggtacaggtcagttgattggcgtaggacatgaatccagaggtctctactatttggaaatgagttcatcagtgtcttgttttatgtctctgtctcctaagcttttgcatgatcgcttgggtcatccgcacttgtctaagctgaagaaaatgtcttccgtgcttcattcacaacctaagtcaactgtgggaactccagcatatattgctccagaagtattgctgaagcaagagtatgatggcaagggtaaggctgcgtacaacatccctcccccataccttcgcatagcgaagagcctctgggcaatggggtacgaaattgcagatgtctggtcatgtggagtaaccttgtttgtgatgctagtgggatcatatccttttgaagatcctaatgatccaaaggatttccggaagacaattcagagggttctcagtgtccagtattccattccagacaatgttcaagtatctcctgagtgtcgccaccttatctcaaggatctttgtttttgaccctgcagagagaatcactattcctgaaatattgcaaaatgaatggtttctgaaaaatcttcctccttacttgatggatgaaaagatcatgggtaaccaatttgtagaatcagatcagcccatgcagaacattgatacgatcatgcagataatttcagaagccaccataccagctgcggggacctattctttagaccagtttatggctgataacataatagatgatgacatggatgaattagactctgactttgagcttgatgtagatagcagtggggagatagtgtatgccatataa

SEQ ID NO: 50868 - DNA, 2298 bp, Glycine max
  Peptide Sequence Number=SeqID_142553
atgacagacccgttagctggagctgctgcgggagagttgttgaaaggggctcttgaaatcattcgcagcggttacgagttccgacccaccctcgaaagaagcagagaaaccttcgactctttatcttctcgagtacaaaagattaaacagttgaacaggaacctggatagctccacagaggagatagataagttggaggctcttgtgcgagatggtaaagagcttattgacaagtactccaaagttacttggtggagatttctctgcttcccttgttaccagtgcaagcttaaggccagtgaggatgctctgacgagacacacaactacgattgagccggttcacattaggctcggaatgatggagatccagtccggcatcaaaatcattctccagactctgctcatgtcagggaaggagaatattggcggagcaatcgaagaaccagagtgcattggaatggaacaacatttgaacaagttgaaaattgaactgctcaaggatggcatgtcggtccttgtattgactggtttgcctggatccggcaaaaccacactggctaagaagatctgttgggacactgacatcaaaggcaagttcggggtaaacatatttgtcacagtctccaaaacacccaacttgaagagcattgtagggacagtgtttcatggctgtagacgtccggtgccggagtttcaaagtgatgacgatgcaattaaccgattaagtgctctgctgctgagtgtggggggaaatgataaaaatccaatattattggtcttggatgatgtttggcctggctcagaagcccttgttgataagtttacagtccaaataccttattataagatcttggtgacttcaagggttgcatatccaagatttggcaccaagattttgttgggtcaacttgatcacaatcaagcagtggcccttttcgctcactatgctaaactaaatgacaatagcccatacatgcctgaagaagatcttttacacgagatcgtgagacgttgtatgggttcaccattggtgcttaaggtcactgccggatcactctgtgggcagccttttgagattttagatgcgttggaggatgagttccacatcaacgaaaaggtgtgcttcatggatctagggcttttccctgaagaccaaaggatccctgttcctgccctcattgatatgtgggcagaactgaaagttgcaaaggatgaagacaagtactacaataaccactttgtaattctacatgatctccttagagagttagcaatccgtcaaagcacagagaaaccatttgaacaagacagactgattattgacataacgggaaatgattttcctgaatggtgggtgggagaaaatcagcaaggaaccatcggccaaatgttcccatgtttctccagaatgataagacagaaacagctaaaggttgctgcccgcatattgtgtatttcaactgatgaaacgtttaattcagattggcgtgacatgaaaccttacaacactgaggttctgattttaaatcttcactctagccaatactcattaccgtgttttacaaagaagatgaaaaaacttaaagttctgatagttacaaattatggttttcatcgttctgagataaagaagtttgagctgcttggttctttatctaacttgaaaagaatcagattggaaaaggtttcagtcccttccctctgcgaattgaagaatttgcaaaaattgtctcttcgtatgtgtaatacaaggcaggcttttgaaaactgttctatccaaatctcaaatgcaatgccatgtcttgaggaaatgagcattgactattgcaatgatttgattacattacctgatggactgtgtgagattagcccattgaagaaacttagtatcactaactgccacaaactttctgcactgccacaaggtattggaaaactggagaatctggaagtgctaaggctatgttcctgctctgatttgctagagatgccaaattcttttgaagggcttaacaagctaagctgtcttgacatctcagactgtgtaagtcttaccaaattaccagatgatattggtgagttgaagaagcttaagaagctatacatgaagggttcaaaactgggtgaattaccatactccgtccataagtttgaacaatttaagcatgaaataaatgtgatctgtgacgaagaaacggttaccttatgggaaaattttcgtgcctttcccaatttgaagatagagatatttagagaggacattgacttgaattggcttcatggagttcattcctga

SEQ ID NO: 50869 - DNA, 261 bp, Glycine max
  Peptide Sequence Number=SeqID_142554
atggctttcatgatggaagacaaggactctaacacacttgatggcgtctcaagccagctccagctaaaatcctcgttgtcttccaaagcctcatcgcaaaccttgaacaaacaacaagttctcaatcgcattcgacaccgtaagtccttaaacagaatcagaggtgcttttgaggatcttttgggtagttccaaaggcaatacagcctcagcccaagaccagatttggctccaacaagatgacgctttctcttctccttaa

SEQ ID NO: 50870 - DNA, 96 bp, Glycine max
  Peptide Sequence Number=SeqID_142555
atggcatcagtgatcaacccttgtcttagtgcaaatcacaagatagtttgggatttaaaaaccaataatccaagatttgccagtttcatcgtataa

SEQ ID NO: 50871 - DNA, 4065 bp, Glycine max
  Peptide Sequence Number=SeqID_142556
atggaagtgctgccttgttctggtgttcaatatgctggggaatctgattgccctcagcagagttcaggaacagcatttgtataccaggaacaacctaattgccccgaaaatggtgaacatgtcaactttgtagctgctcaactgaatgaatcatcacataagatgcaagggcctcagatagaaagacatttgtcgactaattcagattgccaatgcattggaacttcatgttgtgattgtcaagtggatgaccaacatgaatattgtggttttcatgattttgaagaagacatgattaatgaaccttgcttgacatctgagaactttatctctgttgtggatacaattgaaattgaatcaccaaacaacagtagggaaggagacttgtcatgttccgaacccaagtggctagagggagatgaatctgtggcattgtgggtcaaggctttgacagaaactgcacgtgatgtgaaggtctggaaggaatttgccatggaggcttctcgttgtaagggttattccaattttggaagaatccttctaaagctgcataaagaattgtttgattctattttgtggaatggggtcaatactctctgggatgcagttgcaccaatgcaatcaacattaggttctgaatggaaaacctggaagcaggatgtgatgaaatggttttctgcaccaccttccttatcgagcagcaaagacacccagcaacagagttctgatgatttgtaccaagcaaaccttcaggtttgtagaaaaaggcccaaacttgaagttcgtcgtgcagatacacatgcttcacaagtggaaatcaaggaccaaactattgctcttgaagctgaccctggcttctttaagaatcaggacacgttgagcacaatagcagctcagtcttgcaaacaggaaggtgttagggaggtgtctatgacaacttcacctagtaatttggcaaataaatggaatgaaattgtagttgaggctaccgcttcggatttcttacatatcaaagaaatggaatcaacacctacaaatgaaatgagtgttgcaaaatctgtagaacctggtagtaagaatcgacaatgtatagcttatattgaagcaaagggaagacagtgtgtgagatgggcaaatgatggtgatgtatactgttgtgtacatttgtcctctcgatttttgggcagctcaacaaaatccgaaaagcctgttccagttgatactccaatgtgtgaaggtacaactgttctgggtactagatgtaagcatcgtgccctacctgactctttattctgtaagaaacacaggccacatgctgaaacagtgcagacctcaaatttaccccagaatacactaaagaggaagcatgaagaaaattatactggttcaaaggacatgtatgcattggtaaatgttgagagtccactgcaagtggatccagtgtcatccattggtggtgattctgtacatgtagaaagcaactttaatgagaagcccaagcattctgaaaatgatcataatgcagtggtgtcaatgcactgtataggttctcctccctatgattacaagaatccttgtagggaaggtcctaaaaggtattgcttgtactgtgaaagacaccttccaagctggcttaagcgtgctagaaatgggaagagtagaatagtatcaaaagaagtgttcacagaacttttgggggaatgtagctcgtgggagcaaaaggtacatcttcataaagcatgtgaacttttttacaggctgttcaaaagcattttatcattaagaaatcctgttcctaaggatgtccaattccagtgggctttgactgaagcctctaaagattccaatgtaggagagttttttacaaagttagttcatagtgaaaaggcgagaatcaagtcaatatggggattcaatgatgacatggatatatcctctatcatggaagaaccacctctcttgccatccactattaatgataactatgatgaggaaaatgccatcaagtgtaagatatgctctgcagaatttcctgatgaccaagcacttggtaaccattggatggacagtcataaaaaggaagcacagtggctgtttagaggctatgcatgtgccatttgtctggattcatttactaacaaaaaactattggaaactcatgttcaggagaggcatcatgtgcaatttgttgaacaatgcatgcttctccaatgcattccttgtgggagtcattttggaaatactgaacaattatggcagcatgttttactagttcaccctgttgattttaaaccatcaacagctcctaagcagcaaaatttttctactggcgaagattctcctgtaaaacatgatcagggaaatttagcccccttggagaataattccgagaatacgggtggtttacggaaatttgtttgcaggttttgtggattgaaatttgatttactacctgacctaggtcgacatcaccaagctgctcatatggggccgaatctggctagcagtcgccctgcaaagaggggagttcgctattatgcatatagattaaaatctggcagacttagccgccctaaatttaaaaaaactttggcagcagcatcatacaggctcagaaataaggctaatgctaatttaaagcgaggcattcaggcatcaaactcacttggcatgggaggaataaccatacaacctcatgttactgaaagtgaaacaacaaatattggtagattggcagaacatcaatgctcagctgtttcaaagattttgttttcagagattcagaaaatgaaacctcggcctaacaatcttgatattttatcaattgctcagtctgcttgctgcaaagttagtcttgcagcctcactagaggagaaatatggaatcttgcctgaaaagctctatttgaaggcagcaaaactttgcagtgagaatagtattttggtaaattggcatcaggaggggtttatttgtcctagagcttgtaatgtatcaaaggatcaagctttgctctctcctttagcttctcttcctaatagttctgtaaggcccaaatctgtgaatttatctgatcctgcaagtgatgagtgggaggtggatgaatttcactgcatcatcaattcgcatactttaaaaataggttcactgccaaaagctgttatcttgtacgatgacattagctttgggaaggaatcagttccagtgagttgtgtggtagatcaagaacttatgcattctcttcatatgaatgggtgtaacagacaaaatataagcccttctatgccttgggagacctttacctatgttacaaagccaatgcttgatcaatcccttagtcttgactcagagagcctgcaactgggatgtgcctgcttatgcagtacttgctgtccggaaacttgtgatcatgtatacctttttggcaatgactatgatgatgcaaaagacatatttgggaaaccaatgcgtggcaggttcccatatgatgagaatggccgaataatcttagaggaaggttatcttgtctatgagtgtaatcatatgtgcagatgcaataaatcctgtccaaacagagtattgcagaatggagtacgagtcaaattggaagtctttaaaacagagaaaaagggatgggcagtaagggctggtgaagctattctacgtggcacatttgtgtgtgaatacattggagaagttttagatgtgcaggaggcacgtgataggcgcaagagatatggcgcagagcattgtagttatttgtatgacatcgatgctcgtgttaatgatatgggcagattgattgaagaacaagctcaatatgtaattgatgctactaagtttggaaatgtctcaagattcatcaatcatagctgctcaccaaatcttgtcaatcaccaagttcttgtagagagcatggattgtgaacgtgcacatattggtttttatgcaagtcgagatattgctttgggtgaagagctaacatatgactatcagtacgagcttatgcctggagaaggatctccttgtctttgcgaatccttgaagtgcaggggacgcctttattag

SEQ ID NO: 50872 - DNA, 405 bp, Glycine max
  Peptide Sequence Number=SeqID_142557
atgactcctaaaattaataataaaattacgcattgttattataccttctttttgttcttgctcttgcattggctcattaaaaagtacaagtcaaaatccagtcacacattgtccccaggcccaaggaagttacctctcataggaacctgcatcaacttgctaacagtggcaggttcacttcaatatcatgctcttcgagaacttgctcataaatatgaacctctcatgcacctgcaactatgtgaaatttctgcagtgattaattgtatcctccccaagatggtggccaaggagataatgaaaacccacgatcttgcttttgtgcagccacaacttctctctcctcaaactttggcctatggggcaacaaatattgcttttgctccatatggtggtgattattag

SEQ ID NO: 50873 - DNA, 297 bp, Glycine max
  Peptide Sequence Number=SeqID_142558
atgtggaatttagaattgatgaatcaagacgcaaaacattttgtaagcttaggctctactccaccaccatcacggttaagcaccctcaacaaggaactggaaatggttcttgccactctgcttgaattaaaaaatgaagagcacgaacactgctgcaaaatggccaagatcatgctgaaggtcatggttgcatcagaagctattataaacactattaacgccaaggaccaggatgaaaatttgcataccgttctctacaaccaagatttggacagacctgccattgtagcagggtag

SEQ ID NO: 50874 - DNA, 600 bp, Glycine max
  Peptide Sequence Number=SeqID_142559
atggcctgtgttctgttgctgaattgctatcaacacccaccgcttcaaaacaaccttgtcctcaaggtgaagcgtagaactgtgttcacggtggctttggtggttgtggggagcatggtggtgggtgtggcggcgggcgtcgacgccggtgagaggcagagcaaaaggctgaggggcgaagacgcgaacggcaacgagaatgacgacatgtgtggcttcattacagagcttccatgggaagctgccatgggaagtgatgctggcttgggtgtgggattaggtggcttgggtgcggggtatggaatcggaggcagcataggaaggggaggaggaacatcggacggcggcggtgatggttgggctgaagaaggaaacagtagtggcggcggcagcggcggttgtggtggcggaaccgatgaaggaaacggggatcgttggcggaatatcatgctatccaattgctggctaatgagatcgagtttgaagagcatggatgcgtggaacgcgtcaagtcggaggctggcagcggaaggtgcggtatctgccattgaagagcggagaggagggcaggtcggaccaattgttatgaatagtaactag

SEQ ID NO: 50875 - DNA, 912 bp, Glycine max
  Peptide Sequence Number=SeqID_142560
atggccacgtcccacatctatgctaaggaaaccaaaactaaggaatacacagtgacaaccgaggaaattgaacttgaagatgcgctcaacttcgacttcaaggctagaatgctcgccaaggcccacacagtggacgcagccattacgctgaaggacccacacaagatccaccaagccatgcgctactccctcctcgccggcggcaagagggtccacccgctactctgcatcgccgcctgcgagctcctcgacggcaccgaggccaccgccctccccgccgcgtgcgccgttgagatgatccacaccatgtcgctcatccacgacgacttgcactgtatggacaacgatgacctccgccgcggaaagccgaccaaccacaaggtcttcggcgaggacgtggcggcgtccacgaagggcgtgtcgccgtcacgggtggttcgcgcgattgggggaacgttgttggaagttgcggctgtgttgggggtattagtgggaagtggaaccgacgaggaggctgagagattaaggaggttcgctaggtgcattgggttgttgtaccaggttgtcgatgatattatagatgttacgaaatcgtccgaggaattgggaaagacggcgggaaaggatttggtggctcataaggttacttatcccaagcttttggggatacataagtctaaggagtttgctggaaaattgatgcaggatgccaaggaacaattgtgtgggttcgatccccaaaggcgggctccgttatttgctttaaccaattacattgctcagagcccagaggcaacattgtattctctgccgctgttggctttggcgataaagcatgacccgccagtggcaatggcgatacaggctgatcccgctattggcacttgcgatacgagcttacgtggacactaa

SEQ ID NO: 50876 - DNA, 195 bp, Glycine max
  Peptide Sequence Number=SeqID_142561
atgaccatgattacgaattcgagctcggtacccggagttgctatgcctgtgtacactacgttcaaggcaatagaaagtaaagatcaagatgctcaacataggtgtcttctctactgggcagtggtgtacccagctctcttttttggggagaagctacctggggtgactacattgccaatgagtggggaggtttaa

SEQ ID NO: 50877 - DNA, 801 bp, Glycine max
  Peptide Sequence Number=SeqID_142562
ggtggcagtggcagaggcagagatacggatattgggtttgagacactaaaacctcgtgatcggaaaaggcagatccatggaagactgttcccgctggggcacgtgatgggaccctgcacatgtggtatgtttcacagccaaaccagctccttctccgtgctcttctccatgcccaaccacaaaccaccctacgaccattccgacaacatctatgactattcttccttcactccctcttcctcttccgttgactgcaccctctccctcggtaccccttccacccgcttctccgaagacgaagaaaagcgaagctgccacgaaccccgctccgtctcgaacttctgctgggacttactacaatctaaacacaaccaccctcaatcccattccaaatcctcccgaaccaccaacaccaccgaccctctcctcgctcgccgctgcgccaattgtgacaccacttctactcccctctggagaaatggcccccgtggccccaagtcactatgcaatgcgtgtgggattagatacaagaaggaagagcgaagagcgagtgcggccgccgccacgccgccggctgcggcggcttccggcggcatgatggattcggcgcaggtgtacaataactcatggtacgcacaccagcagagtcagaagatgcagtgtttctcgccggggatggggagcgagttccgtttcgtggatgacggcgatcgagacgccgctgataacggcattcagtttctctcgtggagactcgacgtcacagacaggacgagcctcgttcacgacttcacgagatga

SEQ ID NO: 50878 - DNA, 90 bp, Glycine max
  Peptide Sequence Number=SeqID_142563
atggatatttcgataagcgagtatatttttatctgtaagctcaaaacggtagagcgatcagagcatttgtccactgacatgctctggtag

SEQ ID NO: 50879 - DNA, 3801 bp, Glycine max
  Peptide Sequence Number=SeqID_142564
atggaggccgacgctattgctgtggactcaacggagttaaagttgacggagctattgaaggaggtcaacgtagaccactcacatcagttctctaagctcgtcgacgacaccgtttccgccattaaaacctccattgacaaaatccccaacgatttcaaggtaactgctgatttagcttcgcgctttgttacggacattggtgctgataaggtcgagttcaagtttaagaaaccagcgtctgttaagattggtggaagttactccatacaaagtattgcgaaacctgaagttaatgtggatcttattatcaggttgccaaaggaatgcttccatgagaaggactatttgaattacagatattatgctaagaggtgtctctatctctgtttgatgaaaaattatttggagaagtctccatctattgatagggttgaatggtccactctacagaatgaagccagaaaacccttgctcgttgtgtatccagctgctaagcttgttgaagttcctggtttttttgtaagaattattccgtcagctaaggctatatttagcatagcgaagttaaacttgaagcgcagcaacattcataatttgagtgatgggactgctcttctggctacaccgaagtacaattctagtattttggaagacatgtttatagaagatgtggaatttatcaacaactattttcttggatggaaggaactaagagaggctttaatcctgcttaaggtttgggctcgacagagaagttcgatacatgttcacgactgcctgaatgggtttttgatttccgtcattttggcatatcttgcttctaagcaacatattacaaattcaatgaaatcaactgaaataattcgtatcacgttgaacttcattgccacctcagagttgtggagtcgaggtctctactttccaaaggaaggccatagcaatattacaaaagagcaaaggatgcaacttaaagagtcatttccagttgtcatatctcatccgtttggaggattcaatttggcttttcgaatgtctaggattggttttactcagcttcaaaatgaggctactttgacacttaggtgcatggaaaagtgtagagatggtggatttgaggaagtttttatgaccaagattgactatgctggtaaatatgactattgtatgagaataaatttgaagggaaagaaggaggtatttgcatctggattttgtttggacgatgagtgctggagatcatatgaggataaaatacatggtattttgtctaaagggttgaatgatagagccaaattcattcaagttacatggagaaatacacattgccagtggagtgtcgatgatggcttgtcggtacttgataaagtgcccttgttcataggaatttcggtgagtactttggagaaagcatttaggatggttgatattggcccaaatgctgaaagtaaagaagaggctcttgaatttcgaaagttttggggagaaaaagcagagcttagaagatttaaagatggtagaattgcagaaagcacagtatgggaaattgagcaatgggcgaagcatcttattttaaaaagaatagttgagcatgtacttagtaggcatctttctctgtccaaggaaaatattgtggttgtcgtggatcaacttgatttctctttgcttcatggttctggagatcctatatcatactctggaaatttgcttggggcatttgatgttttatcaaagcgtttgcgtcttattgaagacctccctttgaaggtgtctagtgtacagcctttagactctgctttcaggtttacatcagtcttccctcctgaacctcatcatctagcaaatgaaaaacatgaatctctcagactgaataagttagttccatcatgcattcaaccactggaagttatgattcagctggaaggttctgggaactggccaatggatgaaatcgcaattgaaaaaacaaaatctagtttccttgtccaaattggagtgagtcttcaaaagatgtgggggatgacatgtactgccactgaggataatgtggatgtgttggtgtctggatatgcatttcgtctaaaaattttgcatgagaggggtcttagtttgctcaacaaggaaattgggaatgatcaagctaagcggattccttctgctgacaagaaactttttatccgaagtcagcatgctaacatgatcaatgggttacaaagtcgttatgcaatatttggaccagtagttagacttgcaaaacgatgggctgcttcacatctattttcatcctgcttggtagaggaggctgttgagctattggttgcatatctttttcttaatcctttgccatatgatgttccctgctcacggatcactgggtttttgagaacaaggaaacagcctctttgcatatgcaagggtaaggctgcgtacaatatccctcccccataccttcgcatagcgaagagcctctgggcaatggggttcctgcggttactctcgcactatgattggactttctctccgctgatcgttgacataaatcatgacttgagccaaagtgatgggaaagaaataaatgacaactttttgctaagaagaaaaggtcagggagaaaatggacaaagtgtaggatcagcaatgttcttagctacagtttatgataaagaatccgaggcttggactggattatcacctagtggaatggaacttaaaaggttagttgcatatgcccgaagcagtgccaatttgttggcaaaactcacatttctggaagagattggtccatttagatgggagtgcctttttagaactcctttaaacaattatgatgcagtaatttttctccacaaggacaaactcccgtatccccaaaggcttctctttccatcagaagttaatcacggaacacatgttgctgaaggacaggccagcaagtgtttccaaccctttttgttgcctaaagatttgaagggcaggccagaggaacttagaaataagttgctgcaagagttctcaaccacattccaagtatggcatgattatctgggaggtgatgttattggcctaacatggggggagtcatatccttccaagaagcggaagcacgaggaagtagtagttgaggaagaatataacccttgcaaggtgttaaaagcggtgggggaagttgggaaaggatttgtgaagatacaactcagtaaccaccttccgttggacattattaacgatttatcgctgtggaattacgttcgaagtcgagtcgaagagttttgggagccaaatgggtcttctgagtatcataaggaaaatcaagcggaaagagaaggaaatgcgaattctaatggtcggattggacaattctgggaaaaccacaatcgttttaaagataaacggagaggacaccagcgtcatcagtcccacgctcggcttcaacatcaaaaccataacttaccaaaaaaaacaataagatcttactggagaaactactttgagcaaacagatggtttggtttgggtggttgacagttcagatctgagaaggttggatgattgcaaattcgagctcgataaccttctcaaggaagagaggctatctggagcatctttactgatattagcaaataaacaggacataaaaggtgcccttacacctgaagaaatagctaaggtgctgaacttggaagccatggataaatctcggcattggcagatagttggctgtagcgcatacactggtgagggtctgcttgagggatttgattggttggtccaggacatagcctccagaatctacatgcttgactga

SEQ ID NO: 50880 - DNA, 1548 bp, Glycine max
  Peptide Sequence Number=SeqID_142565
atgggggacaacaacagcaacaacgatgccttcatgcgcaaccaaaacgccgccgttcaggcccgcaccaaagcgcagaaccgttccaacgtccttcagctcaaactgattggacagagtcacccaaccggtctaacagcgaacctgttgaagctcttcgagcctaggcctccgttggagtacaagccgcctccggagaaacggaaatgtccaccgttatcagggatggctcaatttgtgagcaagtttgcccagcctggcgatccagaatatgctccacctgtcccagaaaccgagactcctgtagcacaaaaaagagccagaatacacaagctaaggctagagaaaggagctgcaaaggctgctgaggagcttgagaaatgtgatgagtcctatattgtgaatttgctaatatttcatgattttgtgttctctggatgccattcttatattggcttctatgcagatgatccacataatgacccaaatgtgtcgggagatccatacaagacattgtttgtggctaaactcagttacgagaccactgagagcagaatcaaaagggagtttgagtcatatggtccaatcaaacgggtaggtatttttgaatatccctcaggggattcggttcgattagttgctgacaaagatacaaataagcccaggggttatgctttcattgagtatctgcatacaagagacatgaaagctgcttataaacaagctgatggtaggaaaattgatggtagaagggtgcttgtggatgttgagcgtgggaggactgttccaaattggagacctcgccgcctaggtggtgggcttggtactactagagttggggggagcaacagcagtctcgttctgaagaaccaagagtgcgggaggaccgacacagtgatagagacagggaaatatcacgtgaaagagttagggacaaagacaaagaacgggagcgatcacgtgaacattctaatgaaagggtcagggatcgcgatcagagagaggataggcaccacagagaccgagataggaccagggacagagacagggaaagagatagagatagagatcgtggacgtgatagagatagagcacgtgatcgtgagcgagggagggaccgtgaccgggatcgagaatatgatcgacatcgtgagagggatagagattatgaagttggcgaaactgatcgaggacgctcacgtgatagggagtctcattataatcgtgttgaatctaaacatggggaaaggaatcatgactatgagcctgaggatgatcgtggtaggcaaaaccagtatgagcatggacataggcatgcagaccctgatcatgacactactgagcattatgacccctacaatcatggagatgatcgtggtgaccattacaatcagtatcctgaccctgataggatggaagatgactaccatgcaggacgtgcaacatctgaatcacatgaaaaggagagaagtcatgatgtggaccgtgaatatcggcgctcagagagatcacattcccgggagtatgattattaggaattgggcatag

SEQ ID NO: 50881 - DNA, 1482 bp, Glycine max
  Peptide Sequence Number=SeqID_142566
atgtctttggaagataaaaacgcaggcggccaacagttcatggaaaacggggacaaccataaagggctcaacaagtatgcctgtgcctctgtgttagctgccaatattgtctctgctatatttggttacgttgtgggggtgatgaccggagcactcatattcataaaggaagatcttcaaatcagtgacctacaagtacaactcctcgcaggcacattacatttgtgcgccctaccaggaagcatggttgcaggaagagcatctgattatataggtcgacgctacaccatcattctagcatccatcaccttcttattgggcacaactctaatggggtatggtccatcgtatctaatcttaatgattggaaactgcattgttggaattggtgtgggttttgccctagtagttgcaccagtttacagcgcagagatttcacctccttcttacagaggcttttttacctctctcccagaactctcctcgaacataggagtcctccttgcctttatgtcaaactatttccttgaaaatttgtcactgagacttgggtggaggatgatgatggtgcttccttcaattccttcatttggtcttgtcattctcatgttgaaattggtggagtctccaaggtggttagtgatgcaaggacgtgtaggtgaggctaggaaagtgcttttactagtatctaatacaaaggaagaagctgaacaacggttgagggacataaaaggtattgttggcattgatgaaaactgcaccctagacattgttcaggttccaaagaatactcgcagtggtgcaggagctctgaaggaaatgttctgtaatccttcaccacctgtgcgtaggatactgattgcagcgattggacttcactttttcatgcggattgatggatatggaggttttttgttatatattccaagggtgtttgagagaacaggaatcactgacaagagcacgctcatgctagccaccgttggtatgggaattaccaaagttgtatttgcattcgtatcaatgttcttgtcggatagagttgggaggaggattctcttgctgattagtgcaggtggtatggttgtgacccttttagggctaggtatttgtttaaccatagtggagcactccaaagaaaaattagtttgggcaacaaccttaaccgttatttttacctacatatttatgggcattgcgtgcaccggagtaggaccagtgacatgggtttatagctccgaaatacttccccttaggttcagagctcaaggccttggtgtctgtgtggttgtgaacagactcacaaatgtggtagtggtttcaagtttcatttcgatttataaaaccataacaatgggtggaattttctttgtgtttaccggtatcaatgctttggctttgttgttctactcatctttgcctgaaaccaaaggaagatcattagaagatatggagattatctttggaagaagttcaaagtaa

SEQ ID NO: 50882 - DNA, 411 bp, Glycine max
  Peptide Sequence Number=SeqID_142567
atggcggttcacggtgacgatgacaccatggtgatggtggttcccaaactctctccgcccaacacctacgaagccgtcgtcaatggtggcaccttcgaccgattgcacgacggccaccgcctcttcctcaccataatgccaaagcttgaaacttgtgtgcaggcttcagcggagttggcaaggcgccggattgtaattggagtttgcgatggacctatgctggcaaaaaaacagtttgctgaactgatacagcccattgaggaaaggataaataatgtcaaaactttcataaagattgaagttgtagatttggtctctggagaatcaggtgaaattaagctgagttcatcaatgctacggaagattgaggctgaaagggctaaacaacaaaacacgataccgcagacttag

SEQ ID NO: 50883 - DNA, 765 bp, Glycine max
  Peptide Sequence Number=SeqID_142568
atgacagtgcaagaacgagatgatagcaagagcgagagcgataacggtgtgactacactgctacagagaatgcgtgagagtgagagtgagaaggagagtgcaagatggatcgatacgcccgaagcacaaggccatgccactgtcttcgttgccaaattctttggccgtgccgacctcatgtccttcatttccaacgtccctgaaccccaaaggcccgctctgtttcaatctctgttgttcgaagcgtgtggaagaacggtgaaccctgtcaacggtgctgttgggcttttatggaccggaaactggcacgtgtgccaggcggcggttgagacggtgctccgcggcggcaccgtcaggcccatgccggagcttctcggcctagacgctcccactcccactgccgatgacgcttccgaaggggaagttacctgtaccgacaagtggagagtccgagatccgaacccgaatttcccgggaacccggttcccgggttcgaggtccgataaggccggttctggtggcaaacgcaagcgatttgaagagctcgccaagcttcagacggcgacgacggatctcaatctccggctgacgccgagttttctgcagaacgcggctagctacggctgccggcaggaaattcgctggccagggtcgccgtcaatgaattccgaggagtccgggacgacgacggcgtgcttggagagcgggatcggagatcactacgctcacgacggagaccggaaagtgctgaaccttttcatttga

SEQ ID NO: 50884 - DNA, 885 bp, Glycine max
  Peptide Sequence Number=SeqID_142569
atggagctcctatgggagcttgccttcaccatagctctttctcttttacttccattggttttcctcaaactcctttccgtgaccccaaacttcgaagcaaatgagaaagtggctgttattcggcgtgatcatgatcatcgagttgaatctgattccaatagttgggaaacggataaagttgttcaaattggtgggaaaattgatgaattcagagacaaacctatagtgggaaaattagtagtcccggaaattgtggatgtgagttgtggatcgcccaagatacacaattcagaaaagattgatggggacagacttcacaacgaaattgaactcgaggatttggcagaggatcctgttgtggatgagggtaatgaaggggttgttaatattaacaaagttgaggtagaattgatggaatgtgattctagagagaacaaagttgaagaggttgagatctcgcagtgcgaaagatattataatgagattgaagaatctagtatgaacgaggaaatgggtgaaaacaagggctcggtggtggatgaggatgattgggaaggaatagaaagaactgaattggagaggcgctttggtgctgcagttgtatttgtcggttccaagagcaatgctaatcttagtaatgatgtgaagatgaagcttcatggttatcaccgaattgctactcagggtccttgccatgaacctcagccaatggctctgaagttctctgctcgagcaaagtggattgcatggcgacagcttgggattatgagtccagaggaagctatggagcaatatatcagccttctatcagaaaacattcctgattggattgtagaaaatccttatgataatgctaaaccggcttctgcaaaactaaccttatga

SEQ ID NO: 50885 - DNA, 2061 bp, Glycine max
  Peptide Sequence Number=SeqID_142570
atggatcagtcatcaccttattataaccgatttcctcagactccaagctcaaccaaaaagggaagaagtggttatgaaccatcagacacagagtcagagcggcaagagattccacggcatgaacgagaaagaagaaacttcactttagaagaaacaaaagattttactctaatgaacaaaagccccatggcactacacaggaggcacccttcaaggtttgaaaacgaagtctcatcagcttcaacagcttcaacagcttcagctccacgaagaagacaccatagtaaatcaccctataagctgcgcgtagcagaagcaaatgttgctgttgctgttgctggtgttgcatcatcatcacccataataggtttgaatacaaggagaaatatcagtcccttgtcgagacctgacattggaagaaccgtgtctcctttcagggagcaaagaattgagaagccacactacaagagatcagtgactgctccaagattgaggattcaagagagcaacaacggagggagaaccaatgaaaaggttaatagacaaagagaagcttctcctttcaaagctccttcggttggagaaatcaacgagatgatagcacaggtgaagctatctcaagatcccaccagtgattattcgtcagtgcttgaaagcactgattccattcatccgggtgaccttttcttttctcgcgaatgcaatgcctttcaagcgaagaattcttcgttgccaagacgcatcgaacaacgtgagcatttcagtccaaggccaccggtgaacaccacgagagtcccatccgaaagaaaaggaaagaatgctgacattaagatgaatatgaatatcttgtctcgatcaaccacggttttaagtacttcggctacgagcagaaagggcagtggcactgggaagccaagtagtgtaacaagcgaaggtagtggaaagacaactgaaagcatgaggaaattcacagccaacagaaaaaagaatcagaaagatacatggttttcttgcatgagaacaggtaactgtagaaccactagaaaatcgcctgaacgtcgaccaattgatgaatcttctttcatagagagggcagtggtagtcgaaagcctcccacaattctgggcagataagcacgaacctgcttcacttaatggcttcatttgcaacagacaagaagctcaacttctcaaggaattggtgtctcagggctcttgtcctcatattttgcttcaaggaccctctggctctgggaaaagagaactagcaatggctcttcttcgagaaatatatggggatgcatgttgtaacgaccaaaggcttaagaaagtatctgttccaataacatccagttctcatcacatggagctcgatgtaaattcagaatcaaatgctaaatatgctttaatgggattaatcaaagaaattagcaatatatatgcagttgcccccgaagtcagcaatattaatttcaagtcagattttaaagttatagttctttatgacgtccacaaagcagtagataatatccggcacattatcaaatggatcatagaccgctattcggatatttgcaaattagtgctctgctgtgaagatgatgcagacattattgaacatgtgaaaaatcgattcaaagttatccaagttgatgctcctcaaaatcacgaaattattgaggttcttattcagatagcaaagaatgaggaaattgatctatccatgaattttgctgcaaaaattgctacaaaatctaagcagaacctcagaaaagcaatcatggctcttgaagcatgcaaagcacacaacttactctcaatacgagggaaatttcaaatgcttctcttggattttgtccacccgaaattgattctccagaaactcgtgggacatctcctaaaaagaattgaggtcagcttaagaagggagctttactactggcatgcttattatgacagaagactccccccaggaataactgctttactaaagttagaagaattcgtggccaagttcatgagcatgtgcagaaaaaactctggcaatcggcaatatgtgtag

SEQ ID NO: 50886 - DNA, 1401 bp, Glycine max
  Peptide Sequence Number=SeqID_142571
atgccttctccatcctcaatcttttctgcctacgcctccatgacagcctccatcatgctcctacgttccatggccaacgacctcgttccccaaccaatccgtggctacctttacagcacgttccgttacctcataaagcctcgctccccaaccctcaccctcatcatcgaagagtccaccggcatagcccgtaaccaagtctacgacgctgcagaagcgtacctctccacccgtgtcagccccgaaaacgagaggctcaaaatcagcaagagcgcaaaggagaagaaattaaccgttcggttggagaagggcgagaaggtagtcgactgcttcgacggcgcgtgcttcaagtggagattcatctgcgcggaatccgagaagaacaaccccaacgaccacagcaacaataacagcatctccgtacggtccgaaaagcggtcttttgagctgagcttcccgaagaagtacaaggaaatggttctggactcttacctgcccttcattctcgaaaaggccaaggagatgaaagacgaggaaagggttctgaagatgcacactctcaacacctcgtattgttacagtggggtcaaatgggactctataaatctcgagcatccttcaacttttgagacgctggcgatggagccggagttgaagaatgcggtgattgaggacttggataggttcgtgaagaggaaggagttttataagagggttgggagggcgtggaaacgtggctacttgctctatggccctcctggtactggcaagtctagcttgatagctgctatggccaattacttgaagtttgacatctttgacctccaacttgggaacatagtaagggattctgacctcaggaaactgcttctggcgactgctaatagatccattttggtcattgaagacattgattgcagtgtggatctgccagagcgtcgccatggtgatcatggacgtaaacaaactgacgtacagttgaccttgtctggattactgaacttcatagacgggttatggtctagttgtggagacgagagaatcatcatattcaccaccaaccacaaggagaggctagacccagcactgttgaggccaggaagaatggacatgcacattcacatgtcctattgctcctaccaaggcttcaagattttggcctcaaactacttagaaactccctctgatcaccccctctttggtgaggtagaggggctaatagaggacatacaaataacccctgcgcaagtggcagaggagctgatgaagaacgaagaccctgaggccacacttgaaggattcgtgaagctacttaagaggaagaagatggaaggtgatgtgtgtgagaactctactcctgataaagcagaacctactcatcagcaatctaagaggcgcaag

SEQ ID NO: 50887 - DNA, 1398 bp, Glycine max
  Peptide Sequence Number=SeqID_142572
atgggattctacacacagaaccttttttcttctttcacctcagcttcatcatggttcgaggtgtacgctgccttctccacattcatgatgctcctcagaacagcattccatgacctcattccccagcaattccgatccctcattgtctcaaagctagagtccttcttcaccaaataccaaccaaataacgaaatccgtctcaaaattaaccaattttgggacgaaaattcgggagaccgcaatgaacttttcgatgctgcccaggagtacctccccaccaggatttctcacacctacaagtcgctcaaagttgggaaactgcaagacgagaagcacattgagctcgcagtggatggaagtgaagacgttgtggacgaatttgaaggcaccaaattcacttggaagctggatgaagggtccaaagaggactctaataatcacaacaagaagtatagctttgaattaaccttcaatgagaagcatagagagaaagcattggatctgtatattccacatgtgcttaaaacatatgaagccataaaagctgagaggaggatcgtaaggatctattccaggttagatgggtattggaacgatagcgagttatcgcatcctgccacattcgactcactggccctgagtcccgagttgaagaaagatatcattgatgatttggaacggttccagaggaggaaggaacattacaagaaagtggggaagccttggaaacgtggctacttgttgtatggacctcctggaactggaaaatccagccttattgcggcgatggcgaactacttgaaattcgatgtgtatgatttggagcttacttctatttattctaactcggacctcatgcgatccatgaaggaagcatctaaccgttccatcgttgtgattgaagacatagactgcaacaaagaggtgcaggctagatcaagtggtctttcagacgatcaagattcagtccctgacaatgaggctgccaaggttaagacaaataggtttactctgtcgggtctgcttaactacatggatggtttgtggtcaagtggtggagaggagcgaattataatattcactactaaccacaaagaaaaaatagaccctgcgttgttgcgccctggtcgtatggacatgcacattcacttgtccttcctcaaaggcaaggcctttcgagtcttggctaccaattatttgaatattgaaggagatcatccactctttgaagaaattgatggactattggagaaattagaagtcacccctgcagtagtagcagagcaactgatgagaaatgaggatcctgatgatgctttggaaacatttgttacatttctcaaagaaatggacaaggatagtaattgccacttagagttaagagggactagtgagtag

SEQ ID NO: 50888 - DNA, 1434 bp, Glycine max
  Peptide Sequence Number=SeqID_142573
atgtctcctaaaggttctttcaagaagaaagcaatcaatgcctctaacatgctgaggaattctttgaccagaaagggtaggcgaagcagtaaggtcatgtccgttgaaattgaggatgtccacgatgctgaggagttgaaaatagttgatgagttccgtcaagctcttattttggacgaacttcttcctgcaaaacacgatgattatcatatgatgcttagattcctgaaggccaggaaatttgatattgagaaaacaaagcaaatgtggtctgaaatgctcaaatggaggaaggagtttggtgccgacaccatcacggaggattttgaattcaaagaaattgatgaagtattgcaatattatccccaaggacatcatggagtggacaaagatggaagacctgtgtacatagagagattaggccaagtcgatgccacgaagatgatgcaagtcacaaccatggatcgctatatcaaataccacgtaagggaatttgagaggacatttgatgtaaagtttgcagcctgttcaattgctgcaaagaagcacatcgatcaaagtacaactatcctggatgtgcagggagtggggcttaaaaacttcaacaaacatgctagggaactcgttactcgccttcagaagattgacggtgacaactatccagagaccttgaatcgcatgttcatcatcaatgcaggttctggatttaggatactgtggaacaccgtaaaatcattccttgatcctaagaccaccgcaaaaatcaacgttcttggcaacaagtatgacaccaaattgctagaaatcattgatgcaagtgagttgcctgaatttttaggaggtacttgtacatgtgctgatcaaggaggctgcatgcgctctgataagggcccttggaaggatgcagaaattatgaggatggttcagaatggtgaccacaaatgttcaaaaaaaagtgtgtcacaaggcaaggaagagaaagaaaattctgaggaacacaagacttccaaattggaggcaaatcacacccctcacctttctccagttgttgaagaggtccctgctactaaagcttcccagcctaaggacttatccccgatggctgataaatctgctgtgaaaaaagttgatgagaaagcttccaagcctcagaacacgcctgataaaactgcagcatcaacagagttttcgactgtgatgaaacgcatggctgagttggaggagaaaatggtcaccatcaacaatcagcctactgccatgccacctgagaaggagcaaatgctgaatgcaactataactcgagccgatgacttggagaaacaacttttggctaccaagaaggctctggaggcttcacttgttaagcaagaagagctttcggcttatcttgacaaaaagaagaagaagaagaagaagagatttttcttcttttaa

SEQ ID NO: 50889 - DNA, 2391 bp, Glycine max
  Peptide Sequence Number=SeqID_142574
atggcactgtttcagacacggaagaagtcttcttcaccttcttacgtatcaaccttgacaatattagtattcatcgcactatgtgtttttggcgtgtggatgctaacctccaactcagtagtgccacctcaaacacagagcgatgaagacacctcaactcgaacagctatagatacctctgcaaccaccaatgatgaactctcttcctccgaagattctcatgaaaccacctcgaaaagcggagaaaaagaaaaggacaatcctactgctgtgtatggagacaaccctggtcatcttcctgatgatgccattaaagccgatgataataattccaacaatgagccacaaaagcaacaagttgacattagtgactcacagctttctgaggaaagctcgttaactcaaaaagatcaagtcacagctgtgatacatgaagctggttcagacagtgatgtgaaaatttctgagcctgagaaacaggatgaagagaatcaagagcaacaagatgtccaaagttttggcactcgaggagggtctaaaacggaggaagatgaagcaaataaggaacaactgagggaggacaaaggtgtggttgaagtggcaaagaaatatgaaaaggtaccagcagacacgtcacaacaggattctgatgcggcttcaaagggcacaagctctcaggaagaggaaactcaaaacccaaaagcagagaagaaaggtggaaagtcaaagaagccgtggtcaacacaagttgatcaatcgcaacaagagaacaagagacagacggttgaatccaacagcgatgagaaacttgaagatcacacgtggtatctctgcaatgtcactgcaggtgctgattatataccgtgtttggacaacgaaaaggctttgaaacagttgcgtagcacaaaacactatgaacacagggaaaggcattgtcctgaggaccctcctacttgccttgtgccgattcctaaaggttacaaaacacccatcgagtggcctagcagcagagataagatatggtaccacaacgtaccacacaagctgctagcagaggtgaagggacaccagaactgggtgaaagtggctggagagttcttgacattccctggaggtggcactcagtttattcatggagctctccactatattgattttgttcaacaggctgaacctaatattgcatggggaaagcgcactcgggtgatcttggatgttgggtgtggggttggtagttttggaggttttctatttgaaagagatgttattgcaatgtcttttgcacctaaagatgaacatgaagcacaagtgcaatttgctcttgaaagagggattcctgccatatctgctgtcatgggttctcaaaggctaccatttcccagcagtgtctttgatcttgtacattgtgcacgttgtagagtaccttggcatctagatggtggcatgttgcttttggaattgaatcgagttttgcgtccaggaggttattttgtttggtctgctactcctgtgtaccagaagcttgaggaagatgtagagatatggaaggaaatgacctcgctaactaagtccatttgttgggagcttgtgactatcaacaaggatggactgaacaaagttggtgctgccgtttaccgcaaacccacttccaacgaatgctacgagcaaagggagaaaaatgaacctccattgtgtaaggatgatgatgatccaaatgctgcctggtatgtacctctgcaggcatgcatacacaaggtgcctgtagaccaggctgagagaggagccaaatggcctgaaacttggcctcgtcgactgcagaaacccccatattggttaaacaagtcgcaaattgggatctatggaaaaccagctcctcaagattttgtagcagacaatgaacgatggaaaaacgttgtggaagagttgagcaacgctggaataagtttgtctaacgtgagaaatgtcatggacatgcgagctgtctatggaggatttgcagctgctctgagggatcttcccgtctgggtgttcaacgtggtgaatgtagattctcctgacacacttcccatcatctttgagagaggtcttttcggaatatatcatgattggtgtgaatccttcaacacgtatccacgaacttttgatatactgcatgcagataaccttttctcaaagctaaaagataggtgcaaactagttgctgttatggcagaggtggatagaataatcagaccgggaggcaagttgattgtccgtgatgaatctaccaccctcggtgaagtggaaactttgttgaagtctcttcattgggaaataatctatagcaaaatacaagagggtatgctctgtgcaaagagaggcaaatggcggcctgattctgtagctttgtga

SEQ ID NO: 50890 - DNA, 549 bp, Glycine max
  Peptide Sequence Number=SeqID_142575
atgaagtgcagatatgagagtgtgcacttcaataggattgatggtctggctaaggtccttggaggagtccttgcttctgttggaggagcttcaatcattaccctttacaagggacctgttatttatactccacatttaggattacatcaggaacaatacttgtctacattgggagatgccacaggaaagaactggaacttgggtggcatctatctctttggtcactccttatgttggtctggttggatttttttgacaaatgcagccttttttgagaaggattacaaagcctggcagttcaattctagtcgagagatctgcagtgttttgttctcgggactggtgacttcagggctggcatcagcaatacagatatggactattggcaaaggagggccaaacacatcacttaagttagctgctgctacacagaaatctgatgagagtgtacacttgaataggattgatgctgtggctaaggtccttggagtccttgtttcttttggaggagctacaatcataatttcagttgggagatctccagcttag

SEQ ID NO: 50891 - DNA, 204 bp, Glycine max
  Peptide Sequence Number=SeqID_142576
atggagcttggaaacgatgtggttaaggttctctacaatgaaaatgaggcaccacagtatttgctttggtgtacccccaattgcattagggggcaatgcgggcaatgcataagttgtactaaagattgtccgatccataatgcaatcggggtgcagcaaatcaaatacaccggtgcattaagtaattgcccaaatgctttatga

SEQ ID NO: 50892 - DNA, 228 bp, Glycine max
  Peptide Sequence Number=SeqID_142577
atggatgagaaattgtcacagaactgcaaattgtggaaggaattgaaagaccacttaagttatattgtgacaacaaatcagttggtacagagtggacagatttccatagaacacttagagacaaactccatgatagcaaatcctcttactaagggacttccatccaagatctttcatgagcatgttgctcacatgggtgttttacagttcgaggaatctttggtttag

SEQ ID NO: 50893 - DNA, 2004 bp, Glycine max
  Peptide Sequence Number=SeqID_142578
atggcggcggcgacgtcgtatctgacggggacgcagaggtacgctgccggagcgttgtttgggctggctctgcaccaggcccaacttcaccagacccaccctctgggcctatcaaccgacgacttcccttctgattctgaaactagttccactctcgctgtttccgaacaccccaacctttgggtccatcacaactccggtttgctccgccccgttttaaagtacctagatattaattccgcagcatggtctggactcgaggaaactgctggcttttcttcggcttcacgtcacgtcggtccgttcttgagactattatcagaagattttgatgatgatgatgatgattcttcccaaaggttggatcaagaacttgctttgtcagaagctgttgatgctatggtacatagcctggaaaagaattctgagtctctcgtgtctagaagggagaagttacgtgaatatgagaatcaatgtcgtgaaaagttttcgactgctgatgttcaaccgaattctgagaaggtagatttgcaattggaaacccaggaggacacaggtactcctttccttgactgtgaagactcacatcagggatcttttgatagtaatattgatgagattccaactgaagaggtaatgattctcagctatccgaggaaagtgacagtgctctacgagcttctctctgcctgcctatcagatttaggtgaaaataacaagaaatatagccggaggagaaagggctacgatgctcgacaacgtgtcactctacgcctgctggcaacttggcttgatatcaagtgggcaaaaatggaggccattgagacaatagttgctagttctgcaatgtctttcattaaagagcaagaggcaagtaaagaagaaactcaatcaaaagaagacaagtgggctaaatggaagaggggtggtatcattggtgctgctgccttaactgggggaactttgatggctgttactggtggattagctgccccagcaattgctgcagggcttggtgctttggctccaaccttgggtactctgatccccgtaattggagcaagtggatttgctgcagctgctagtgctgctggaactgttgctggttctgttgctgttgctgcatcatttggagctgctggagctggactcactggaagcaaaatggctagaagagttggggatgttgaggagtttgaattcaaagctgtaggagaaaaccataaccaaggtaggcttggggttgagatcatgatctctggatttgtctttgaggatgacgattttataaggccgtgggaaggactggatgacaacttggagaggtatgcactgaagtgggagtccaagaatctatttgccctgagcactgcaattcaggattggcttacttcaagaattgcaacagagctgatgaagcaaggggcaatgatgacggttttgcatgctcttttaactgcattggcttggccagctgcattacttgctgcaactgagttcatagacagcacatggacaattgctatcgacagatcagacaaggcaggaaagttgcttgctgaagtattattgggagggttgcagggaaataggcctgttacccttgtaggttactcacttggggctagagttattttcaagtgtctggagtttttggctgaaacagaaaacagtgctgaactggtagagagagttgttcttcttggagcacccattgcaatcaaggacgagaattgggaagctgctagaaagatggtagcaggaagatttgtcaatgcttattcaagaaatgactggatgcttggagttgctttccgcgccagtctactttcacaaggattagctggaatccaacctgtcgatattcctgggatccaaaatgttgacgtgacagatcatatagagggtcattcttcatatttgtgggctacacaacaggtcctagatgaacttgaattagatacctattatcccgtttataacaaattcctttccagacagtga

SEQ ID NO: 50894 - DNA, 1131 bp, Glycine max
  Peptide Sequence Number=SeqID_142579
atgaagatggaaattgaggaagttggcaactgcgaagcacttcccctgctttcactcaaccacgtgtccctcttgtgcagatcggtgtgggtgtctatgaggttttatgaggatgtcttggggtttgttcccatcaaacgcccttcttctttcaagttcactggagcctggttttacaattatggtattggaatacacttgatcgagaatcccaacattgatgaatttgatacctgcgtgaatgaagaaaggcctataaatcccaaggacaaccatatctcattccagtgtactgatgttgaacttgttaagaagaggttggaagagagggggatgaggtatgtcacagctgtggtggaggaaggaggaatccaggtggaccaggtgttcttccatgaccctgatggttacatgattgagctctgcaactgtgagaatatcccaatcattcctatttcttcttgctctttcaagcctcgaggtcatagctttaagaaggctgctcccaacaacgccgcggctatagttttctgcgccgctgatgaggctgcactttgtcgtgcctgtgatgagaaggttgacccttgtagcttcatagatgtgcttcgatccgatttgatcttttttgcggtgttgtgtaaattggaaatccgagttcacatgtgcaacaagctagctagtaggcatgtgagggttggtcttgctagtccaagtgatgtaccacggtgtgacatatgtgagaatgcacctgctttcttctattgcgagacagatggaagttccctttgtttgcagtgtgatatgattgttcatgttggaggtaaaagaacgcatggaagatatcttctgttcaggcaaagagttgagtttccaggagataaatctagtcatgctgaaaatccggcttcacaaccattggaaccaggtgaggctaaaagaggacaaaatccacttcccaaactaaaaatgggagagaagcaacaaaatcacaagatgcctatggttccaacgccaggacctgatgctgatgggcatgccaagatggaaagtaaaatgattgatttgaacatgaagcctaatagaatacatgaacaagcatcaaataatcaggttcgagttcatgagaagtaa

SEQ ID NO: 50895 - DNA, 315 bp, Glycine max
  Peptide Sequence Number=SeqID_142580
atggccataaaaaaatccaataaactaccacaagctgttgttctcaagcaaattgtcaagagatgctcaagttttggcaagaagcagacctacaatgaagagggtcttcccgatgatgtgccaaaaggccattttgcggtatatgttggggataacaggaccagatatattatcccaatttcatggctggctcagccccagttccaaagtctgcttcaaagagctgaggaggagtttggcttcacccatgacatgggacttaccataccctgtgatgaagttgcttttgagtccttaacctccatgatgagataa

SEQ ID NO: 50896 - DNA, 315 bp, Glycine max
  Peptide Sequence Number=SeqID_142581
atggtggccagatcagacgctcgcgcgaccatggggcctagatccgcgtctctaatggttggactcgaagccagagattttgcatgtttggtagcttttacatgttgtctaagaggaggggaagaagagaggggcagaggaggtgagggtgggggaaagaaaaaaaggagggggcaaaaaaggcgggggaaagagagaagaaagggagcgaaggaggggggagcgggaaagagaaaagaagaaaggagaaggaagaaattgaaaggacgaaggggaggaatatcttgcacggataaaggaatatcatacaaataa

SEQ ID NO: 50897 - DNA, 7509 bp, Glycine max
  Peptide Sequence Number=SeqID_142582
atgcccaaagaacttctacaaagcagccttagacctatattggtcaatttggcacacacaaaaaatctcagcatgcctcttctgcttggtctagcccgcctgctcgaactgttatccaattggtttaatgttaccttgggtggaaaacttctagagcatttaaagaggtggctggagcctgaaaagttggcacagagtcagaagtcatggaaggctggtgaagaaccaaagattgctgcagctataattgagctttttcacttgcttcctcctgctgcctcaaagttccttgatgaacttgtaaccttgactattgatttagaaggagctcttcccccaggacaagtatatagtgaaatcaacagtccatatcgccttccacttacaaagtttttaaatcgatatgcaccccttgctgttgattattttcttgctcgattaagtgaaccaaagtatttcaggcgtttcatgtatataattcgttcagaagctggccagccattaagagatgaacttgcaaaatcaccgcaaaagatacttgcaagtgcattctctgaatttccgctcaaatctgatgtgacagtggctcctgcatccacaagtacacatactagtttattaggcgaagaaagtgttgttgctccatcaactgatgcttctaatccaccggctcctcccaatgcaacatctgatgcttactttcaggggctagcacttataaaaaccctggtcaaattaatccctggttggttacaaagtaatcgtagtgtgtttgatacattagtacttgtttggaagtcacctgcaagaatatcccgattgcaaaaagaacaggagctgaacctagtgcaagttaaagaaagcaaatggcttgtcaaatgcttccttaattacttgagacatgacaaaaacgaagtgaatgttctctttgatatacttaccatattcttatttcatagtcggattgactatacattcctgaaggagttttacattattgaggtggcagaaggttatccaccaagcatgaaaaaggctcttctattgcattttctcagccttttccaatcaaaacaacttggtcatgaccatttggtgattgtgatgcaaatgctcattcttccaatgcttgcacatgcctttcaaaatggtcaaagttgggaagttgttgatccttctataataaaaacaattgttgataaacttcttgatcctccagaggaggtttctgctgagtatgatgagcctttaagaatagaactactgcagcttgccactttgcttcttaaatatcttcaaaatgatcttgtccatcataggaaggaactgataaagtttgggtggaatcatcttaagcgtgaagacactgcaagcaaacaatgggcatttgtgaatgtttgccatttcttggaggcatatcaagccccagaaaaaataatactccaggtttttgttgctcttctcaggacctgccaaccggaaaataaaatgttggtcaagcaggctcttgacattctaatgccagcactgcctcgacgtttgccccttggtgattctcggatgccaatatggataagatataccaagaaaatccttgttgaagaaggtcattcaattccgaatcttattcacatattccaacttattgtccgccattccgatctcttctacagctgcagagcacagtttgttcctcagatggtgaattctcttagtcgccttggattgccttataataccacagcagagaacagacgtcttgccattgaacttgctggattagttgttaactgggagaggcaaagacaaagtgagatgaaagttgttactgattctgatgcacctaaccaaatcaatgacgtctttaatcctagctcggctgattctaagcgatctgtcgatgggtctacatttcctgaagatgcaactaagcgagtaaaagcagagcctggtctgcattccctatgtggtgtcatgtcaccaggtggtccttcatcaatcactaacattgaaacccctggatctgccagtcaacctgatgaagaatttaaaccaaatgctgcaatggaggaaatgattatcaattttcttatcagagtgaggcttacttctaacctgcttttttacatttccatggttgctctagtcatagagccaaaggacaaagaagcaagtgccatgtacaaacaagctttggagctactgtcacaagctttggaagtgtggccaaatgcaaatgtaaaatttaattatttggaaaaacttctgagcagtatacagccgtctcaagcaaaggatccatccactgcactggcacagggtttagatgtcatgaacaaagttttagagaaacaacctcacttgttcataagaaataacattaaccagatttctcaaattcttgaaccatgtttcaagcataaacttttagatgctggcaaatctttttgctcactgttgaagatgatttttgttgcttttcctcaagaagcaactaccacgcctgctgatgttaagttgttgcaccagaagcttgatgatttgatacagaagcatgttaccactgtcacagctcctcaaacgtctagtgatgataataatgctagttcaattagtttcctattgcttgtcataaaaaccttgacagaggtacaaaggaactttgttgatcctttaattttggttcgcattcttcaacggctgcaacgtgatatgggttcatcggcaggctctcatttaagacaaggccagagaacagatccagattcagcagtcacatcttctcgtcaaggtgctgatgttggagcagttatttcaaatctaaaatcgattttgaaacttatcactgatagagtgatggttgttaccgactgcaagcgatctgtatcccaaatattgaatgctttactctcagagaaaggaattgatgctagtgtacttctttgcatacttgatgtggttaaaggttggattgaagatgacttctgtaaacaaggaacttcagtcacacagagttcctttctttctcctaaggagatagtttcttttcttcataagctgtcacaagttgataaacaaaacttcatacccgttgctctcgaagagtgggacaggaaatatcttgaacttctttatgggatttgtgcagattcaaataaatatcctttacccttgcgtcaagatgttttccagaaggtggaaaggctatttatgcttggtttacgagccagagatcctgaagttaggatgaaatttttctctctctatcatgagtctctcgggaaaactctttttaccagacttcaatttattatccaaaatcaagactggggggcattgagtgatgttttctggcttaaacaaggccttgatcttctcctggcaatattagttgaggataagcctattacactagctccaaattctgccagggttcaaccacttttggtttcaagttctattctggaattatctgggatgccacacaaggttaatgatgtatctgaaggatctgatgatgctccactaacgtttgaggcccttgtgcttaagcatgcacagtttcttaacagcacgagcaaactccaggtggctgatctattaattccattgagagagttagcccacacagatgctaatgttgcataccatttgtgggtactggtatttccaattgtctgggttacattgaataaagacgaacaagtaacacttgctaaaccaatgattaatcttttgtctaaagattaccataagaggcagcaagccaacagaccaaatgttgtgcaagctctattagaagggcttcagttgagccatcctcaacccagaatgccaagtgagctcattaaatatattgggaaaacatataatgcatggcacattgcactggctttgctggaaagtcatgttatgttgttcccgaatgattccaaatgctctgagtctctggccgagctctatcgtttgctcaatgaagaggatatgagatgtgggttgtggaagaagagatcagtcactgccgaaacccgggctgggctttctcttgttcagcatggttactggcaccgtgcccaaagcctgttctatcaagccatggtgaaggcaactcaaggaacatacaataacactgtacccaaggctgagatgtgtctatgggaggagcaatggttatactgtgccagtcaacttagtcaatgggatgcactagctgactttggcaagagtgttgagaattatgaaattctgcttgacagtctttggaaacttcctgactggacgtatatgaaggagcacgtcattcccaaggctcaagtggaagaaactccaaagcttcgtctaattcaagcatactttgctcttcatgataaaaatacaaatggagtgggtgatgctgagaatatggtaggtaaaggtgttgatcttgctctggaacaatggtggcagctgcctgaaatgtctgttcattccagaattcctctcctgcagcaattccaacaaatagttgaagttcaagagtcagctaggattctaatggacatttccaatggaaataaactctctggaaattcggtggttggtgtgcaaggaaacctttatgccgatctgaaggacattcttgagacgtggagactaagaactccaaatgaatgggataatatgtctgtttggtatgatttgctgcagtggaggaatgaaatgtacaactctgtcatagacgctttcaaagattttggcaccacaaattcagcacttcatcatcttggttaccgtgacaaagcatggactgtcaacaggcttgctcacattgctcgtaagcaaggcctttttgatgtttgtgtcaccatacttgaaaaattatatggccattcaaccatggaagtgcaggaagcatttgttaagataactgaacaggcaaaggcatacctagaaaataagggagaacttacaaatggtattaatctgatcaacagcactaatctagagtattttcctgcaaagcacaaggctgaaattttccgtctgaaaggggatttcttgttaaaattgaatgattctgaggctgctaatcttaactattcaaatgctattagtcttttcaaaaacttgcctaaaggatggataagctggggaaactactgtgatatggcttacagagaaactcaggatgagatttggttggaatatgctgtcagctgcttattgcaaggtataaaatttggtgtgtccaattcaagaagccatcttgctcgtgtgctttatcttcttagcttcgatactcctaatgagcctgttggaaggtcatttgataagtactatgaacaagtaccacactgggtttggctttcttggattccacagctcttactctccctgcagaggacagaagctcctcactgtaaacttgttcttttgaagattgcaacattgtatcctcaggctctgtattattggttgcgcacatacttgctggaacgacgtgatgttgccaataaatctgaacttggtagaatagcaatggctcaacaaagaactcaacaaagtgtttctggtactactagtgttggttctcttggtgggttgtctgatggaaattcaagagtacaaggtccaggtggcagtaacttgccatctgatattcaagttcaccaaggctcccagccaggtggaattggatctcatgatggtggaaactcacatgggcaagaacccgaaaggtctacaattgcagaaagcagcatacacaatggaaatgaccaacctttgcagcaagtttctggaaatgaaggtggtcaaaatactttaagacgtcctggtgctttaggatttgtggcttcagctgccagtgcttttgaggctgcaaaagatataatggaggctcttaggggaaagcatgctaatttggccagtgaactcgagaccctgttaacagaaattggttcaaggtttgtcactcttcccgaagagagacttttggcagtggttaatgctttgctccaccgctgctacaaatatccaacagctacaactgcagaagttcctcagtctctcaagaaagagctctcgggtgtttgtagggcttgcttttctgctgatgctgtaaataagcatgttgattttgtaagggagtacaaacaggattttgaacgtgatcttgatccagaaagcactgctactttcccatccactttgtctcaactgactgagcggttgaaacactggaaaaatgttcttcaaagcaatgttgaggataggtttccagcagtattaaagttggaagaagaaagcaaggtattgcgggacttccacgttattgatgttgaagttccagggcaatatttcactgatcaggaaattgcaccagatcataccgtgaagttggatagggttgctgctgatattccaattgtgcagaggcatgggagcagttttcggcgcttgactctaattggctctgatggttcccaacgccattttattgtccagacatctttgactcccaatgctagaagtgatgaacgcatactgcagcttttccgtgtgatgaaccaaatgtttgagaagcacaaggaatcaagacgccgtcacatatgcattcacacaccgataattattcctgtttggtcccaggttcgcatggtagaagatgatttgatgtatagcactttccttgaggtctatgagaatcattgtgctaggaatgaccgtgaggcagatcttccaataacctatttcaaggagcaattgaaccaagctatatcaggccaaatatcaccagaagctgttgtggatctccgtctgcaagcctataatgaaataacaaaaaatcttgttaatgacaacatcttttcacagtatatgtacaaaactctacctagtggcaaccatagttgggctttcaagaagcaattcgccatccagttagccctttcaagtttcatgtccttcatgctacaaattggtgggaggtccccgaataagattttgtttgcaaagaacactggaaaaatatttcaaactgattttcaccctgcgtatgatgcaaatggattgattgagtttaatgagcctgtcccatttaggctgacaaggaatatgcaagccttcttctcccatggagtggaaggccttatcgtatcttcaatgtgtgcagctgcacaggctgtggcttcacctaaacaaagccagcacctatggcatcatctagcaatgtttttccgtgatgagctactgtcttggtcttggagaagaccgcttgggatgcccattgcctctatggctgcaggtggtactatgagccctgttgacttcaaacagaaagttatcacaaatgtggaacatgttattacaagggttaagggaattgctcctcagaatttttctgaagaggaggaaaacgttatggatccaccacaacctgtgcagaggggtgttactgagttggttgaagctgccttgaacccaagaaacttgtgcatgatggatccaacgtggcatccctggttctaa

SEQ ID NO: 50898 - DNA, 480 bp, Glycine max
  Peptide Sequence Number=SeqID_142583
atgtcattatgttcccttgcttttcaagcttacattaagggatggagcaagaagtctttatcttatgcagataagttagagttgatcaaagcagttagtcaaggaattgtgaatttctggatagagatttttcctttgccgcaatttgttctggaccggataaacacttcgtgccataattttctgtggggcaaagcggatattggcaaaaacaaagggagcgatgtgtggaattacaatacttcttcatcagattcagttttgataaagaaaatcattcaaataagagactttattatctccaaagagctaagtacggaagaggccaaaaagaggattcaatcttggagcaccaatgaacaattgcttattggcatagtctatgaatacattggaggtgtcaagcctactgttagttggtgttctgttatatggaaccgagcaatccccctaagatgtctttcttctgtggcttgctaa

SEQ ID NO: 50899 - DNA, 609 bp, Glycine max
  Peptide Sequence Number=SeqID_142584
atgcagacagaagatactgaagatcacattcatgtgttccttaatttatatgaagatcccaaacatatcagcagtgatttttggaaagattaccttgcaaatggtgcagttggaagaagaattcgtttgggaagcatatctggacttgggagcagtccagatgaaggttgttgttatgtctacaatgataagggtacaaagacccatgtgattatgaagcatagaacattgatggtaaagcatatgcactggtatgaagtgggtgagaaagtttcagtttgtgaatgtagatgcactagagcacgtttacccccaagcaaattttggctatttgagcctcgttgtggcttccatgacatagggggttggtatgttgaaacatatggcaaagataagaatggtcgtacaatgccatcacaaaggttctgggatggcttggactatagcgagcaagctgacagaagactccatccagcaatgtatctgtttgctcttgcatatcggacacttgatcttgaatatgccaaagcaagcaagagatcatttaggaatgttgttggagcacaaatgttccgaattcttcattggtgcaagaaacttgttcaatag

SEQ ID NO: 50900 - DNA, 582 bp, Glycine max
  Peptide Sequence Number=SeqID_142585
atggttattagtcttgaatggtctatttacaaggacaatgatgttgcaaaggcaaaaaaagtgaaagaaactttgttggatgatatttggtggaacaagattgattacattctttctttcattgctcctatttatgatgttcttagaaagacaaatagtgatatgacttgtcttcacttggtatatgcaatcttggattcaatgattaaaaatactaagagtaacataactcttcattgtctagtacattcttcaaacccaagatattatagtcatgaatggttaagtgaagatccatcaagagttcccccacatgaagatgtggaatttactgatgaaaggaagaaatgctttaaaatatactttgatgatgtggatgtaaggagacaagtcgatttggagtttgtatatttttatggtagaagaaaaggctttgatgatgttgactctttaagggatagaggtgaattggttacaaaatcttggtggcttgttcatggtattcatgtaccaacttttcaaaagattgtccttaagttacttgagcaaccatcttcatcttcttgctgtgaaaggaattga

SEQ ID NO: 50901 - DNA, 222 bp, Glycine max
  Peptide Sequence Number=SeqID_142586
atgaaggatgcaactgacaccgcgagtcgtgtctacgcccacgtccaacgtgcttccgacacaggacacgcccctgtgataatagcagtagaatattctcatcgagggtttgatgttgttggagaacgagagtttgatgttgttagaggcttttttgattcaggaatgactcaccaaatgaaactcaatgataaactcgaaagtctatgccaagtctactaa

SEQ ID NO: 50902 - DNA, 504 bp, Glycine max
  Peptide Sequence Number=SeqID_142587
atgcatgatagctacttagcttcttatccagttgagtatgaaactcccagtattccgttttctctcttccgcgaaaaagcttttctcctctcttctctcttccgcgaaattccttgggggtcttcttctccgcgaggcttctccggcttcatcttccatttgcattcgagggtagaggacgccggaaaaaatggcggaagcttggtgacggtgagccttccggaagacccgttaggggttcttccggaagatttccggaagaagggttcttccagaggtaatgaaacgacttccggaagaacaggtcttccggaaagctctcgcaacacctcttccggaatgtttccggaaaatgtacttcttccggaaacattccagaagagggttcttccggatgacatcctccctaggaagggaccaatcactcgaaccatgagcaagaggctccaagaagattgggctagagctgctgaagaaggccctagggttctcatgaaccttagg

SEQ ID NO: 50903 - DNA, 3942 bp, Glycine max
  Peptide Sequence Number=SeqID_142588
atggtgctcgaggcgacgatgatctgtatcgacaattctgaatggatgcgtaacggtgattactctccttctcgatttcaagctcaagcagacgctgtgaatctcatttgcggtgctaaaacgcagtctaatccagaaaatacagtgggagttctcacaatggcagggaaaggcgttcgtgttttggtcacccctaccagtgatctgggcaagatcttagcctgcatgcatggtcaggcgagccctggtgcagcggtaaagttgtgccttggtgacttgttggtcatgggttcgaatccggaaacagcctctttgcatatgcaagggattgcaattgggttaaccttgcgtgagatgggtctttctcctcagcgagagttgggcctgttcacctcgttggagcaggttgagttgagagtggatgcagttgtagactgtagagtcaagtttgcaaggccgaggttgaaggttgtacattcaaatttcatgatgccatgttttgggtttttgaaagggctagatataggtggtgagatgaacctagctgctggcattcaggttgcacaactggctcttaagcatcggcaaaataaaaaacaacagcagaggattattgtctttgctggaagccctgtcaagcatgaaaagaagatgttggagatgataggaagaaagttgaaaaagaatagtgttgcacttgatattgttaattttggtgaagaagatgaggggaagacagagaagctggaagcactcctcgcagctgttaacaataatgataccagccacattgttcatgttccatctggtcctaatgccctttctgatgtacttataagtacacctattttcactggtgatggggaaggtggaagtggttttgcagctgctgctgctgccgctgcagctggtggtgtatcaggatttgagtttggcgtggatccaaacttggatccagaattggctcttgctctaagagtttcaatggaagaggagcgagccaggcaggaagcagctgcaaaaaaggctgcagaggatgctgcaaaacaagagaagggaggtgagcagcaagccagctcacaagatgcaacaatgactgagcgtgccagtgcagcaatgtctgaagctgagaataagacaagtgatttgatggatgatgagaatgccttactacagcaggcgcttgcaatgtctatggatgatcctgccattagccatgatgtaaaagatacagatatgtcagaagcttctgcaagtgatcctgacttggctctggcactccaattgtcaatagcagatagtacaaaggatcaaggcagccagtcagacatgagcaaattgttggccgatcaatcctttgtatcttctatccttgcatcgcttcctggggttgacccaaatgacccttctgtcaaggatttgctggcttccatgcaaaatcagtctgagtacaatactggagctagtgttgtgccaggcaaattgaatgttcatctcattgctcattcccatgacgatgttggttggctcaaaaccgttgaccaatactatgttgggtccaacaatagtattcaaggtgcatgtgtggagaatgtgctggactcggtggtagtgtcccttcagcttaaccaaaagagaaagtttgtgttcgctgagatggcttttttccatagatggtgggtggaacaaactccacagacacaggtgcaagtgagaaagcttgtggatgctggccagctagaatttataaatggtggttggtgcatgcatgacgaagccacgactcactacatagacatgattgatcaaacgactcttggtcaccgcttcatcaaaaaccaattcaacaaggtccctcgtgcagggtggcagattgatccctttggacactctgctgttcaggcttacttgcttggtgctgagcttggttttgattctgtgcacttcgctaggattgattatcaggacagagctaagcgcaaagttgataagactcttgaagttgtgtggcgaagctccaagacatttggctcttcagcccagatttttgccaatgcttttcctgttcattatagtcccccaagtggttttcattttgaaatcaatgatgactttgttcccgtacaggatgatccccttctatttgattacaatgttgaacagcgagtcaaggacttcattgctgctgctattacacaagcaaatgtgactaggacgaaccatattatgtggacaatgggcgatgatttccagtaccaaaatgcagagagttggttcaaacaaatggataaactaattcactatgttaataaggatggcagagtgaatgctttatattctactccatctatttataccgatgcaaaaaatgctgcaaatcaaccatggcccctgaaaactgatgattacttcccgtatgcggatggaccaaatgcttattggacaggctatttcactagtcggccagcgtttaagcgatatgttaggatccttagtggatactatttggcagcacgacaacttgaattttttgctggaaagaaatccactgtaggccacactatagaccttggagatgctctcggcgttgcacagcatcatgatgctgtctctggcactgccaagcaacacacaactaatgactatgcaaaacgacttgctattggagcctcaagggctgaagctgttgttagttcttctttgtattgtcttactagcaagaaactaggggttcaatgctcagcacctacatcggcattttcccagtgtcaattactcaatatcagttactgcccaccaacagaagacggtattccacaagcgaagagtttggtagctgtaccaattcagcaaagctatctctggtatagttccagtcaaggtgaaggtcaggattctggtgcatatatatttcggcctcatacccctccaaatattgtttcaagatcagtgcccttcaagataatccgcggaccattagttgatgaggttcatcaggagtttagttcttggatttaccaggttactagggtctataaagacaaagagcatgcagagattgaatacactattggtccaattcctatagaggatggaattggaaaagaggtgatcacccaaatgacagcaaatatggttacagacaaagagttctatactgactctaatggaagagattttttgaaacgggttcgagatcatagggatgattggccacttcaagttcatgaaccagtagcaggcaactattatccagataagaaatctgaattgtcggtcttagttgatcgggccactggaggaggcagtatcaaagatggtcaggtggaacttatgcttcataggcgcatgctctttgatgatggcagaggagtagacgaacgtcttgatgaactagtgtgccaaaatgatagatgtcaaggactaacagtaagaggaaattattatgtgggcatccacaaacttggagctggttcacactggcgccgtacaactggtcaggaagtttattcaccactattattggcttttgcacatgaggacttaggaaactggaaggcctttcatgtgaccagaggaactgtcattgatcctaattacaacttacctcccaatgttgctctgataactcttgaggtgttggataatggaatggtgcttctccgtttggcacatctatatgaggctggtgaagatgctcagctttcaactttgaccaaagttgaattgaagaaaatgtttgccacaaaaatgataaggggattgattgaggttagtttatcagcaaatcaagagaaggaaaaaatgaagaagaaaacatggaacgttgcaggggacaagggacaagggtctaaatcagttaggggtggccctgtcagccatattaatctcgtagttgagcttggtcccatggaaatacgttctttcctgttgaaattctaa

SEQ ID NO: 50904 - DNA, 1139 bp, Glycine max
  Peptide Sequence Number=SeqID_142589
atggcaggccaacttgcaagatcaagaagactagaaactcagcagcaggaacagtcaagggctaagtggacgacatcactcaccaagatacttgcagcactgatggttgatcaatatactattgtaaagtccattcttgatcaaagtgactttagttgggatgaagccacaggatctataacagctaatgatgaaatttgggctgaatacatcaagaaacatcctgatgctgagactgtcaaaaccggtggctgctcaatctttaaggaactttgcacaatattctctgagccatcaaccaacggcaagcatgaatatttcgctgcatccaagggtgaacatacttatacaactccttgtccagagcccttgaacacacaccaagaggagtcctcttcagaatcccaggacgaggaagatgctaatgatcttcaaacagttcaacctactacacctactgcgatttctacccgcaaaagagggcgtaaaggaattgatgatgctattgcagatgccatatttgagatggcatctgcttcaaagatgagggcagctgccatagagcaacaaattgctagatttagcatggctgattgtattagggacttagatttgatgcaaggtgttgatcaacaactctattttgcagctttagagctgttcgacaaacctaatgcaagggagatatttttgtctctcaaaaaggataaacgcttaacttggttgcgtcgcaatgataatgcgattcctaacagacgatttgtaatggttaaaaaatcgtcggtatcatctaaagagttaaattataatttcttgcggtttaagaacgggaagaacaactgtatcataggatcttcacctcaaatgttggtgtggaagatctgttctttgaagatctcccactatagaaaaatgaaagatcttcattttggaagatcggatcctctacaagaaccggaggctaaggagaggatggaggttgcagaaggggaagggtggccgtggaggtcgatgcggtggccattgttgacggacggcgtggtgacaagaacaaacggatatgagatggagtgcggagaagaggacaaacatttggcatgcatcaatttttgttggggtgtggataagaaaaagattaa

SEQ ID NO: 50905 - DNA, 273 bp, Glycine max
  Peptide Sequence Number=SeqID_142590
atggatcttatcgcatattctacaccaaaaaagtgttcaaggaagtatttacgaagtataaggctaagacaagaaagagggcttcgaatcattgggcgaatcgagctggcgtatggtcgagtcgaagtcaaggcaacaagatttctggacttagcgcaatttctgacaaaacttcacaaaatcagttcgacttcgagcaatgtggataaccgttctaagaagcagttatgtgcatgcaaggtgtacgtggcaggacacttggcgttaggatag

SEQ ID NO: 50906 - DNA, 1137 bp, Glycine max
  Peptide Sequence Number=SeqID_142591
atggcttatctcgccgtcgccggtgccggatacagctcagtcgccggaatcaataaccggaggccaaattttttcataccaattataccaaacaacaccatttcaacgctctattccgtcgcatctctgtgccggtgctgcagagaacatggcttcagtagcgcttccgaatccgcttggacagattttcccgttgagaacgcgtacgagctgttaggagtgtccgagacgagctcctttgacgagattaaagcgtcgtttcgcaaattggccaaagagactcacccggacctcgctgagtcaaggaacgattccactgcgtctcgacgatttgtacaaattctggctgcctatgaggctactacattcaaggagatggaagttgttgaatggttaaaatggtacaggttaactataaataatattttggcagaaaagaaggtggtagttggaacaggctattttgatgtacttgagagagatttttattcagctattcatgcagcatactatggtcctgaaattgattccatggagcttcttcctgactgctttgaggctgaggagaggtcctcctatgaaactcctgaggttttgcacttagtttcaggacgtgatctttttgggatggtttgcctagccaacagggttccagagatatcaattactaacaatgagaagttaacttcttttaggtccttccattcaggcctgtgtcaatctataacacatttgaatgtccacaggaatgcagaaagatcagatgattttgaaactcatcaaggtcacagctctaaaacttcaagtattgtatcagatgcatatagacatctagaattgcacatcagtggaagagtggttgctacagcatctagggcactacctagatgctgttctgatgagatgcagacagaagatactgaagatcacattcatgtgttccttaatttatatgaagatcccaaacatatcagcagtgatttttggaaagattaccttgcaaatggtgcagttggaagaagaattcgtttgggaagcatatctggacttgggagcagtccagatgaaggttgttgttatgtctacaatgataagggtacaaagacccatgtgattatgaagcatagaacattgatg

SEQ ID NO: 50907 - DNA, 162 bp, Glycine max
  Peptide Sequence Number=SeqID_142592
atggttattggttcaaggacgcaaggtgcccctgctttttcaggccaaagttcgagtaccgggtgctacagtgctgaagtaatccatgccatattcctaggaaaagctcgaacgaccttcaacaaatgggtacttgtactcgaaatcgacacaggtggatag

SEQ ID NO: 50908 - DNA, 489 bp, Glycine max
  Peptide Sequence Number=SeqID_142593
atgacggtaaagaatcgtctttactcgttattaaaagaagcttcttcacaccaacgaaaccatggcttccgtgtacagctgtacggactgcggctccaacctgaatttgaactccgtttatgcgtaccctccggacttctacatcgaagccggcaacaagggctccgtctccttctccgccgtcgacgccaccaagttcaaattcgacaaggaggacaagattcgtcccttcttcgaaaccgtcaactactggggaatccagaggaagaggaccaagatcaagtgcaacaccttttaccgatagtcccggtcagtttcacatgggtcccagccaagtcatccccagagcgccccgatataggttcaagaccaaaaccctcagaatcacttcaacttgacccgtgtttgggagtttccaaacatgctgttagaacgcttcttttgatatcttttgtcgtcatacaaatgttattgtacagatcatcatag

SEQ ID NO: 50909 - DNA, 798 bp, Glycine max
  Peptide Sequence Number=SeqID_142594
atggcaaaagcagaacatcctcggagaaaactcgttataaagatcttccctccaggttctaaagtttcttattcttgtggtgccaacactccaaaagattcaatagtgtccaaagtgtgtgagctgaagaataagaagggttattatgccatgacaatgtgggttaacaccgaaaacccatcagaatcttgtgtcactgattcaagaatttcaagaaccgaaatggcaacacgggttaacactaaaaaccagtccaaagtatgtgagtcggagaaaaagaaggaggatagtgtgcgtgtggagtgcaagaacagagagaagaagaagcaaaaggtggagcacgtaatgatgatggaccgttgcaagaagatgcaatgctgggcgatgttgaagcgcttgatggtaggaagagatgcgtgggctttacagaaggatgttcttcatcctaagattttttacgttcttgataagtctgaagccatgaaaaagccaaagggtttggaggatattgagtcaaagttgaagaattcggattactcagaagcttatgagtttgtggatgatgtgaggcttgtgttgtcttatgcattgcaataccctccaaggagtgaggttcacagaactgcaacaaggatcaccgagggttttgaggtcaattggaaaactatgaaggagaagtggatgcgtgaggccgaagagacgaacaagatttgcaagagggaattacatgtgtgtccaaatgaaagaagtcaagtgagtaatcatctcacaaaaaggagcaatatttttatgtgctga

SEQ ID NO: 50910 - DNA, 879 bp, Glycine max
  Peptide Sequence Number=SeqID_142595
atggttaggactagaggcttaggtcttgccttaggtagggttgttaacagaggtctgggcaaaggggatcgtgatgattctgatggtgctccccagcggcgaaggcctactgtatcggcacacaggcatcgagtattggtcactgttactgatgatgagccaatggtaccttcggactcgcctgtggtacctgcgactgagcctgcagtatctgccgatgagccgatggtagatgctcacgtacaggacactggtgtagacattggtgcaggcaccgatgcagaggctgctgcaaatgatcttgagggatttcctggtggactgatcgacccatccatgcttaccgagtatgctgagcatgttgcagccagcgtatggacgggagaggaacgtcctgagtttaagttgtcctcccacgggaggaaggtgcagaaattaggcaggcctgtccttgacattaaagggctagttgctgggacaggactaagtcctttgatcgcgtgttcagtagacactagcgatcagggacttatatcctcgtttgtggagaggtggcaccgggagacaagtagtttccatcttcctgtgggggaggttaccatcacgctggacgacatggcatctcttcttcatctgcccatcattggcaagtttcatagcttccagcctctgcacgtgaacgagacggtgctgatgttggtcgacttactactgatttcaccagaggcagccagggccaagacaggacattgttatggaccatacatacgcctatcttggctacaagatatgtatcagcgtggatgtcaagctggacattggacagctgtagctcgtgcgtatcttctcatcctttctgggttgcactcttttttctaa

SEQ ID NO: 50911 - DNA, 552 bp, Glycine max
  Peptide Sequence Number=SeqID_142596
atggacgaagatcagtggatgtatgaaagtataatgtatgaagaagtggatatggattatcaaaatgaagaagaatgtggtgtgaatgaaccacatgttgattgttcggatgcgttcaatacttctcaggtgtttgacagccaagaggatgttttgcggtgggctcgatccgttgctcatgaaaatggatttgtggcggtaattataaggtctgacacaaacactggtagtagaggaagaacttcagttgtaggaagaaagaatttgttagaagagatactgggactaggaaatgtgggtgtcccttcaagcttcgtggcaagccagtggttggaggacaaggctggatggaagtcaatggtcaaaccaagaaacattctgctaactctaaaggagcacaatggcaatagttgtatgaccatcaaacaaatatacaatgcaagaagtgtatatcgttcttccataagaggaagtgataccgaaatgcaacatttaatgaagcttcttaaacgggatcagtatattcattggcacagattaaaggatgaagat

SEQ ID NO: 50912 - DNA, 282 bp, Glycine max
  Peptide Sequence Number=SeqID_142597
atggcagaacaagctagacaagtattttatgtgcaagacccttatgatgaaaggtggtgcgtggttctaccgggcaaaacaattggtgttaatgtagaagatgatgattcatacatggacacctatgttagtcctttgtccatacaaatcactcctaacgaagaagaagctgacgacgaagtagttgcagaggtggttcaaaagttgcaaccacgtgaagcatcaactttgtttgttgaggtgaaatctgaacatcttcgaagtatttatcccattttatag

SEQ ID NO: 50913 - DNA, 291 bp, Glycine max
  Peptide Sequence Number=SeqID_142598
atgtcagctgcccttatggcagatagatctggtgttactttccatgaggatattactaatgcagttgtagtagaaattacaattggcctagagtgggaatttcttattccattaggagtgattttagccattcttgatcttgcgctcattgctatttcgaaaagtggtcctgcggtcattgctggaaagtcaattgtgttgaagcctccaactcagaactgtttgatttataagcaccacttgttcctgagtacaggacagcttgcagcagcatcttcagcaatgccatga

SEQ ID NO: 50914 - DNA, 1073 bp, Glycine max
  Peptide Sequence Number=SeqID_142599
atggctagaggaaagatccagatcaagaggatagagaacaccaccaagaaggccaacaagctcaccattctctgcgatgccaaggtttctattattatgttctccagcactggaaaactccacaagatcgagcaatcaactaagcagttcttcgatcaataccagatgattctgggagttgatatttggaactctcattacgagaatatgcaagagaacttgaagaaactgaaagaggtgaataggaatcttcgtaaggagtttaggatgggagattgtctgaatgtggaagatctcaggctccttgaggaaggaatggacaaggccgccaaggttgttcgtgagcgtaaggatattggtacttatgactggccagttgaagaatgccactattgctgtcgataccttgtctgtatgattcttgttgctttgacaggtgaaaaagggaagtttaatgagttgcttgaggataagggtgttaatatattgattgatccaaaggcccttatgaatgtcattggaactaaaatggattttgtagatgacaaactaagatttagccacataacaaagggtgaagatggaaactgggcatggcttggtatggggaagatgatgacaagggctttggttgaagaaggggctttgacagccttagcatctattgcagattcttcagaggtgcaatttcagaagtattatgatgttgtgatgccatacttaaaagctattttggtgaacgcaaatgataaatctaatcgtatgcttcgagccaaagcaatggagtgcattagtttggtaggaatggctgttggaaaggagaagttcagggatgatgccaaacaggtcatggatgtcttgatgtcactgcaacaatctcaactggatgctgatgatccaactgcaagttacatattacaagcatgggcacggctttgcaagtgccttgggcaggattttctcccatatatgggttttgtgatgcctcctttgctccagtctgcacaacttaagcccgatgtgaccattacatcaacggattctgatactgaatttgatgaagatgatgacag

SEQ ID NO: 50915 - DNA, 294 bp, Glycine max
  Peptide Sequence Number=SeqID_142600
atgtttgtgccaccatcgactcagtggatttttgtactatacaatggctctattaattgctcatgcactctatttggttgtatctttgatagcgagtatggtagagcaattgaaatgaagaaagatatctctcttgaagccttaaaggacattattgcatctcaacgaacaccgtatgaaggattcaagaaaattgagaatggcaatgacttgaggaccattttcactatatctttcacttatccaaacctaccaattgtttccttaatggaaaatatgactcgtggatattaa

SEQ ID NO: 50916 - DNA, 309 bp, Glycine max
  Peptide Sequence Number=SeqID_142601
gcgtatccacgaagcccttcgtctcgcgcgtttcgtgatgaccggtgaaacctctgacacatgcagctcccgaagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtt

SEQ ID NO: 50917 - DNA, 141 bp, Glycine max
  Peptide Sequence Number=SeqID_142602
atgaaacaagcattggttgaaggtgatgcaaagatttctgggcctaacatgtatgagaagggtgctggttataatcatatgcgattcttaagagctacaaagctagggcaagcatctttcccagtgttcttgattatatag

SEQ ID NO: 50918 - DNA, 954 bp, Glycine max
  Peptide Sequence Number=SeqID_142603
atggcagaatcatcgaagaagcaaaagggaacgtcttccaccaccgctgctgctggccatcgccgccacggaccatctgaagcacccacagcaccaattcattcttccttatcatctctaagatcatctactctattttcttcagatgatcaacgtctacggtacaactctcaattttcttctaggatcatcttagaccctaagtacctagacacagatttctttaatgatgagacatttgactgttatcaagtgtttcaaaactctggattggttgattttatgtccttaaaattgccttactatcctgaacttgttgaattcttttacagcaatttaaaaattcatgatggcattatttcttctgaggtgcatggtatttctatgatcattgatcaatctctattcttttcattgactaaattacccagtcaatgtgcaccttttgagggcaccattgttgatgactggaagtttgattattctagtcatgatgctcgttgtatgatcgactgggctcacttggttaggtaccgaatgcataaggcattacgagccaatgcacctcttccatatcctcaattggtcactctctttctccgacattttcaaattcctcttgatgatgaaccttttgttcaagtcaagcgttcttttgctataggtgctggtacaatcacttcatttggttaccataaggatcgtgatggtcaatggctgaagaaggatgcactccatccacaagacgagcgtactccttctcctcctcctcagcgagatgattcagcccttatgactaaagttctttccaaattacggggtctccgcacatatgttggtgaacgattcgattacttggatggtcgctttgaaggcatggatacccacatcacccagcttgaagaggatgtcacttatcttcgtcggtgctttgaccttccaccaccgtcttag

SEQ ID NO: 50919 - DNA, 1248 bp, Glycine max
  Peptide Sequence Number=SeqID_142604
atgagatataacaacgctgcaagaaaaagaagggaacaagaagcacaaggaagaagaggagaccatgggcttgaaaggcatgaaggatctcaaaaactcagaatatttttagttcctttcgttgaattggaagaggcatcatcgacagaggtaagtgctgttcggcagagtgatcgttattaccaatatgttgatgcagtgaatggcatcgacacccatccttatcagcatggggatgttggtcggcccaaaaagctcaataggcatttggactacaatcctggcaatgaattagtgactcccttatatgttaatccaagtgatggttacactgatgaaatttttggtggaaggtccatgcaaaaggaaatcagagtcttttctgaaaatcctctttcacgcttggatgatctaatctatcaacagggtgaatcttatggaattacagactcccctcatgggatgccccatgccttatctgatccacagttgaatgagagtggagcaaggtctgggtacatctcgcaaaatggattttgtcaatctttctgcattaaccttgaaaagtgtcaattatcttcaatcttaccccataaagtctcacgggtgaaccttatggagaatcagcatgagtacattgtccatcatcctcaaatgcaaagtaagacaccaaaagttgagtcatctgagccacacaaaaggcaagatttggcatcttctccatactatgatgattcattgggaatgaatgatcctgttcatatgatggataacattataactgaaaaaaagaaccttaatgctcaaactgacttgagtggacccagctatgttgctgaggatattcaggaaaattctataaaattagaaaggactaagttaattgaagaaaagaatccaatttttatggatagcaaggttcatgaggtgaaatcaactgtcattgatatgggacatgtgcctgaattgcatcttttggagtccttccctgctaataacttcaatgctaagattaatatgcaaaagaattgggagctaccttctgagggtatagttcctgtttcatcaggcatgatgggcctctctctaaataatctagtgggaagggcccgatctgatcctgacatgagccaaaggactagtgatcacaaaaaatgtgctttggctgaaggtctgaatcgtgaacaagggattgatctttcattgaccagaaactttgatttaaatgctccaattttaaattgtgaa

SEQ ID NO: 50920 - DNA, 597 bp, Glycine max
  Peptide Sequence Number=SeqID_142605
atggaaattgaagccacttgcaggcgtaacaacgctgcaagaaaaagaagggaacaagaagcacaaggaagaagtcaaacctcacctcctccctctccacaaagctatattcaaatggaagaggaacatgcccgacgaatgacgctaaaggactactctagtacaacaactccacaattcttcacaagcattgcaaggtcggaggttcaagcggcctacatttcttatcatcattctctcataactcttccacggtctaccaaacaagtatccctatgctcatctagccacctacatagaaatgttctaatatctgttttctcttatgaagatcttcaaaatatgaaggaggaataccatgggcctgaaaggcatgaaggttctcaaaaactcagaatatttttagttcctttgggtgaatctgaagagacatcatcgttagaggtaagtgctgttcggcagagtgatcccgattaccaatatgttgttgccgtgaacggcatgggagatcctactaggacaaacattggtgggcaaagtttgacaaatgaaaccagtccatttgggacagaaatgaatttggctccagttttttag

SEQ ID NO: 50921 - DNA, 249 bp, Glycine max
  Peptide Sequence Number=SeqID_142606
atggcaaactttaaggccacgagacaagcaccagaaggtatgaaattgcacaagagaaaaaggttcttccgagaagccaccagatggagtggtctctttactatcaaagacattaagccttatggtggtatagagatagaggaccagtcaaaagaccacaattggttggttaatggccaaatattaaagatctaccttggtggagaagtcccacaacacaccatttccttcaagctcaaagatccttag

SEQ ID NO: 50922 - DNA, 372 bp, Glycine max
  Peptide Sequence Number=SeqID_142607
atgggggaggatgagaaaatgcctgagattgatgaagccacgattgaaaatgaaatgaatgagaacaagctaggtcaacacctgtggacactccaacggtggcatgacacactttggcgatggcacgatgttggtcatggtggacgatgtggaatcaacggacaaaagctttgtcggaagttgtgttctattgcctcgatggattgtgcatctgatgagaatcttgaaactggccaaatacaggctaaaggcccaagtggagaaggacgaaggcacaagtggagaaggatgaaggccccaatggagaaggatgaaggcccagaggcagagacattatcaagactattaattgttgctgaaggcccagattaa

SEQ ID NO: 50923 - DNA, 546 bp, Glycine max
  Peptide Sequence Number=SeqID_142608
atggcggcgctacgtggagtggctctaccaacacaaggagttgggactctacctagacgtgcgattaatgaaagacaaggacaaaggaaaacacgaagggttgtcaatgacatacatgggttttttactaagaagaacaaagagtaccaagagaagctaccccttgttgtgctcaaggtagtggaaattatttactctaaagccaactccgagattttgcatgttgtgaaagtccttttgagcccatttatcgaatttctcaagctcaccacttgcactttactaagagaaagggatagtgggcataatccttcaataggtgtcgaatcgttgtacccatgtagtgctggtctttcattgccatctatgttgcattcagttcctcctattgctgctctgatggtttatgatcacagggctgaaagtggagctagcctaggcatgctttcttcaagcagtctttatggtggatatggatctttttcgatgggggataatggctatggatctatgtcctcgtatgccaccaagctatatggcggctga

SEQ ID NO: 50924 - DNA, 426 bp, Glycine max
  Peptide Sequence Number=SeqID_142609
atggcctcatggaaacgccgagtagtgcccgcacaaggaggggattcgacttgggattcttcttgctttacttttgaaactacttggcaccggtaccaagacaacgttcaccttcagaacattctaccaaagaggaacatggagcttgccctggaggacagagctccaaaatattgtagggtgcgaggacaggtcatccggtttgacacagaaatcaatgacttccttgacaccctagtcaaccttgctgatgacattgcgacagccctaggcacacctggtggaggttttgttctgaacgttgatggtgccccatggaagctgttgaggaaggatctaactacgctcgcacagacatggagcgtactttcttactttagtcttgctcttacttctcacatctctgaccttgttttagggttctaa

SEQ ID NO: 50925 - DNA, 201 bp, Glycine max
  Peptide Sequence Number=SeqID_142610
atgctcttgataccacatgacgtagctccatgtggagtttgtaggcctgggatcttcttcatcaatggaatccttagcttctttaatatcaatggcagcagaatgttgaaggaaaagaaatactattggagacaccaattcaaggagaagatgagtcaagaacaagctcaccaccataggaagccatggataagagcttga

SEQ ID NO: 50926 - DNA, 327 bp, Glycine max
  Peptide Sequence Number=SeqID_142611
atgagagaaagatatgtgtcataccctaatttcgtccggggattattgcttgatgacatgcaacctttgattggccgcttcaagatacttggcaccctttgttgcacgatatgtaagtctcgagacgagccagaaatcaaaaggaagcagggttacgcgatccgtgaaattccgtattgtggcggaaaccaaaaggaggtgttgttgcgcaatccggggaggagtgaagaggaaaggggttcagccttcttggcacttcttattctcttgaaattgctgaggaaaattgtttccgtgaagaaaatccaagccgaggtgcttccgtaa

SEQ ID NO: 50927 - DNA, 201 bp, Glycine max
  Peptide Sequence Number=SeqID_142612
atgctcttgataccacatgacgtagctccatgtggagtttgtaggcctgggatcttcttcatcagtggaatccttagcttctttaatagcaatggcagcagaatgttgaaggaaaagaaatatgattggagacgcccattcaaggagaagatgagtcaagaacaagctcaccaccataggaagccatggataagagcttga

SEQ ID NO: 50928 - DNA, 144 bp, Glycine max
  Peptide Sequence Number=SeqID_142613
atgacactagagaactactctagtacaacaactccacaattcttcataagcattgcaaggccggaggggaagcaaaaaggtagctacactcctttaaaggtaatagcttgcagacttgggaagaattcgtacaaaagttcctaa

SEQ ID NO: 50929 - DNA, 621 bp, Glycine max
  Peptide Sequence Number=SeqID_142614
atggcactactaagcaaggcaaagttttttcagcaaatcgtcaacaaggccatcatccacaaacagggatcaaaggacttatcgtataatgcccaaaagacaagaacattgggaaggatctaccatggaatcattctgaccaaagtctttgaggctcatggagtgataaagaagtttttgtacgagactcctgaagaacagactccccaagtggatgattccattcttctgaacttcataaaaaattttggactcaacactaggagagatgaccaactagacacaatgtggaaagttgctgaagaagaagacagggtggatgcagacgcctctcaagctgagaagagaaccaaaaagaacatggatgcacctttgtccaaggttgcccctgtaccactgtgttcaccaccttctctggttgctccgaaggcaataagtgcaatgtaccatcttggcgagattgatgatgatgaagatgacttagtgttcagaaaaaggaaagttgcaccaccttcggatgaagccactgtgcctcaaatgaataaggtcaaaccaactccacaggttccacctccttcaactcaaactcgcaccgacaagcgagagaaaagaggtgcttaa

SEQ ID NO: 50930 - DNA, 303 bp, Glycine max
  Peptide Sequence Number=SeqID_142615
atgacaagcccgacaccgccttcgccattctacattgatgctatcgagaccatatgggaacatgatgactcgctctgtgtggatcacttctacgggttcctatgttgttgtcgtatgccatatgtaccaggagccaggattcacatagtcaacttttatgtttggtggacccaacctatgtcatcttattatcgcttcacgatgctcatgcttgaggtcatcattccttttgagtcgcattcaccacctgccgacatcgtgatatcttctattggatttggctcctcatctaaggatacttga

SEQ ID NO: 50931 - DNA, 229 bp, Glycine max
  Peptide Sequence Number=SeqID_142616
aacttgtaaaaggaatttacaagatagtggaactctcaagcgggttgcttggggactggacgtaggcacaagggttagtacaacagattataggacccaactttgtgggatgctgatgagaatcctgaaactggccaaatacaagctaaaggcccaagtggagaaagacaaagcccccgagtggagaaggatgaaggcccagaggcagagacattatcaagactattaa

SEQ ID NO: 50932 - DNA, 93 bp, Glycine max
  Peptide Sequence Number=SeqID_142617
atgggggaggatgagaaaatgcctgagattgatgaagccacgattgaaaatgaaatgaatgagaacaagctagggccacaactagaagtgtga

SEQ ID NO: 50933 - DNA, 385 bp, Glycine max
  Peptide Sequence Number=SeqID_142618
atggcctggcacttgggaatgcttttgatagggtggcttcatggaaaaaggcaaaggatatcaagaaagaagggcaaaaggaacttttccttggttttcctagaccctagcttgcctgagccaccaaatgacttcaaggttaagaatccagctcgcctgagcaagctcatgactcgattaaaggttgtcgtcccttgtgatgggcacatgggtcgcgctcagcggaccatttgggctcagcgtgcatccgacgctaagcgcaactttagcgcgcttagcgtgacaagggaatttggcagagcacaagaatcaaggccactcgctaagcacaagattagctcgctaagcgagatgttcatctcttgccaagctcagcgcgtggctg

SEQ ID NO: 50934 - DNA, 135 bp, Glycine max
  Peptide Sequence Number=SeqID_142619
atggagaaggagatactagcagtgctttatgcccttaaaaagtttcgatcatatcattgtgtaacaaagggagaacaagctagcatactttggcattgtcagaacttaccatatggaggccacttcaacagataa

SEQ ID NO: 50935 - DNA, 537 bp, Glycine max
  Peptide Sequence Number=SeqID_142620
atggcgcctaccagacaccctctggacccggataagtccaacagggccctgggatttccaactttgatcacaggactctgtcagttgttcggagtccccgtcgcacctagcaaggtgattcggccacccatcacccgggcttttattgagaagtattgcacgcagagacaggcccaggatgatgcaccacaggtcgcagacgcgctgccacctcatcaggctggcccagctgggtcatttgattcggagcagtatttacggcatgtggttcgccagcaggcggccaaccaccgggcgcatgtgcagacccatgactttctttaccagctgagcctcagcctgcaaagcaagggttttacttcttttccatgccctactccggatcagttcaaggcagaggtcgcatggcccggagattggcctgaggcccgggcaggggaggcacccgcagaggctcccgatgaggcagatgaggcccgcgaggacgaggagatgaccgatttgcttgatttcttgggagggagcggagccacatga

SEQ ID NO: 50936 - DNA, 492 bp, Glycine max
  Peptide Sequence Number=SeqID_142621
atgtccttaaaattgccttactatcctgaacttgttaaagtcttttacagcaatttaaaaattcaggatgacattatttcttatgaggtgcatggtatttatatgatcattgatcaatctctgttcttttcattgactaaattacccagtcaaggtgcaccttttgagggcaccattgttgatgactggaagtttgattattctagtcatgatgctcgccatatgatcgactgggctcacttggttaggtaccgaatgcataaggcattacgggccaatgcacctcttccatatcctcaattggtcaccctctttctccgacattttcaaattcctcttgatgatgaaccttttgttcaagtcaagcgttcctttgctataggtgctggtgcagtcacttcatttggttatcgtaaggatcatgatggtcaatggctgaagaaggacgcactccctccacaagacgagcgtactccttctcctcctccttag

SEQ ID NO: 50937 - DNA, 249 bp, Glycine max
  Peptide Sequence Number=SeqID_142622
atggttgaagaaaaccctagaaatggggttaatggaggcaatggaggggagcaaaattgtgagttgagtcatgggctgatcaacatgattgagagaatgcagttccatggcctcccatctaaagaccatgatcttcatctgaagaaattcctgagacacacatatatagtgaggagcctaactaatgctcttgacaacatcagattggttgctttttcattcacattatcgggaaaggctgaagattga

SEQ ID NO: 50938 - DNA, 180 bp, Glycine max
  Peptide Sequence Number=SeqID_142623
atgtcagtgaaaaacctcgtcgggcgcctaggagtacatgacaagacaaatcacacactaataagtcaggtcattctcactagaagcaagcttcatgatgaatcaagattgattcaaggagttttgatgataacaaagatgatgacaaaaagctcaaaagtcaagaacacttcatgttaa

SEQ ID NO: 50939 - DNA, 132 bp, Glycine max
  Peptide Sequence Number=SeqID_142624
atgccgcaagttggaatggcgagatacgtccacgtaggaaccgccattgctgctggcgagaaccttgctgagttggcaccccgtgagcaggtctcgcctatcctattggcgagacaggtattcgaaggttag

SEQ ID NO: 50940 - DNA, 753 bp, Glycine max
  Peptide Sequence Number=SeqID_142625
atgttcaatgaattttacggagagctccaatggaggcaatggcaccgggttctcaccaaaatcctagagaagcagatctacattgctttggtcaaagaattctactccaacatctatgacccagagggcggcgctccaaagtactacaaagtgcaggggcatgtcatccggttcgatacggagaccattaatgacttccttgacaaccccgtcatccttgctggtggagaagaatatctgtcgtactcccagtaccttcacacgtacccagaccatgaggccatcgtggtagcactatgcacacccgaaggtggattcgtcctgaatgtcaatgggaccccatggaagcttttgcggaaggatctcacctcgcttactcaggcgtggactgtactttattactttaaccttgcccctacctctcacacttttgatcttaatgttgacagggcaacgttgatatatggcttagtgatgaagatggacatggacttgggtagcttcattttgggccaaatcacacagatcgcccagtccaacacctctaggttggggttaccagtgttgatcaaaccattttgtgacgctcaaggggttgtttctgacaccccgacctttgagtcactaagccccgagtctgaccctttacttatggggttgagccctctaaggtcagagataccattgaagccagacttggggatgacatcattacatatttggccactaattggaacccatggccaaacttag

SEQ ID NO: 50941 - DNA, 165 bp, Glycine max
  Peptide Sequence Number=SeqID_142626
atggaggttgaagaaccttggctggggttatggctaccattgaattatcgagtagatatgggagcaaggtggtgtttggcattggatgtgcagcaggcaggccttgtggttgatttagggatggcctttgtgtatgattgggtggtgggtaatgagaatgactga

SEQ ID NO: 50942 - DNA, 177 bp, Glycine max
  Peptide Sequence Number=SeqID_142627
atgactgcatacgggaaggacttgtgtgaggggctcaaagcttttgatgctccgccagccactccgatactgggctgctttacagcagcgctttccgcttgtcctaggctaggcataggacgacgacctactggtcgcaaccctagcctctctttgcgtccgtccataagtacctga

SEQ ID NO: 50943 - DNA, 174 bp, Glycine max
  Peptide Sequence Number=SeqID_142628
atgacatcacgattttgcaaactaaaaagatcttggcactttaaatttttgtctggttcaaccctcttctatggaggctggatctttgagcttcatttcaatggtgatttttcaccatggagattcagcggaagacaaaggaaaagaggtggagaagaggcacccatccactag

SEQ ID NO: 50944 - DNA, 243 bp, Glycine max
  Peptide Sequence Number=SeqID_142629
atgggtagtcctagcatgggaggctcaaagagaaggctttcaagcagacgacttggaggagcccttagggagcaaagggcaaggctttattcagttgatacatggcctgaagaaaatgaaagagatgaatttagtcctgctttagattactgtgaactggtgaaaccatcatggaagaaaaatggaaagatacagccatatggtgcaacaaatggcaatttaagaaacccaatggcaacataa

SEQ ID NO: 50945 - DNA, 252 bp, Glycine max
  Peptide Sequence Number=SeqID_142630
atggagatgtacatcaagtccaaccactacaggctctggttgatcattaaaaatggtgagatacccatcaccagtcctgaagcaaaatggacaaatgcaaacatgactataacggagctaaacacaaaagctcattatacactgacatatgctctatccagaaatgaatacaacaagatatacagattaaagatagccaaagagatttgtctattgttagggcacaccttcacaaggcttagattaacctaa

SEQ ID NO: 50946 - DNA, 657 bp, Glycine max
  Peptide Sequence Number=SeqID_142631
atggcacacttattatttgataagattgagaacaaggatgttgtttcttggagcagtatgattaagagctatgataggagtcagttgcttcatgaagcattggaccttttgagagatatgcatgttatgagagtcaagcctagtgaaattggaatgataagcatcacacatgtcttggcaaaacttgctgatttcaaattggggaaagccatgtttgcttattctgtgaaaggtgacaaggtgtttgctaaagcagatggacattctgataaccataaatctaatggtaagaaccacaactccaccaacatgcctagtaatttgacaagtgcaagggatcatggaatggacaagaaaaaacaagaagttgttgctgctgcagggaatggttatgatgatttctatgatggacttgggtgctgccatgttcgggacactagcatgatgggttataggccacctaaaactcctatagatcctaacaaaaaacttggaagtgaagacaaaggagatccagttgatatggcatggtaccaaagattagtggccatgggaagattaatttatttctatcataccgggcagcaaggcatcaaagtattcacacatgtagattgccctggatccattattaaccaaaagttcacttctgcatag

SEQ ID NO: 50947 - DNA, 2577 bp, Glycine max
  Peptide Sequence Number=SeqID_142632
atgtcaacagaaaaaggaggcaaagatgaatcatcaacgtggattcttgagggcattgatattgatcccattgtggagaggcctaaaagggatgatgaagcaccccctaatggaatcatggtgcttaaatctcccaatgatgctgatgtgaacaacaacaacaatagcaatgtgaggagcagggttggcattcaggggaataatggggggaggaaaatgatgagggctgaatcaggagcagctagagggattaagagtttacggtttcttgatagaacggtcacagggaaggaagctgatgcatggaagtccattgagaagcgctttactcaaaatgcagttgatggaaagctcacaaaagacaaatttggaacctgcatgggcatgggggcagaatcaaaggattttgctggggagctgtatgaggccttggcaaggaggaggaatgtctgtgcagaaaatgggataactttggatgaagttaaagtattctgggaggacatgactaacagagatcttgaatcaaggcttcaagtgttctttgacatgtgtgacaagaatggggatggtaggctatcagaagaggaggttaaggaggttatagtgttgagtgcctcagcaaataagctaggaaatctcaaagtgcatgctgatgcgtatgcatctttgataatggaagagcttgaccctgatcataatggatatatagagatgtggcagctagaaactcttctgaaggaaatggctagtgcggaagatggcaccaaaaaacttgataattgtagagccatgactttgagtagagctatgataccgagcaagtatagaactcctgtgagcaaatttctatctacaactgcagaatttgctttggataaatggaaaaaaatatgggttgtcgcgctttggttggccataaacttggtgctttttatttggaagtttaagcaatacagggaaagggaagcctttaaggtcatgggttactgtctatgctttgcaaagggtgctgctgagactctcaagttcaacatggctcttattgtcctaaccatgtgcagaagaacacttacaaaactaagaggatcatttctaaatcgaatcataccttttgatgacaatataaacttccacaagacaattgcagtagctgtggttatagggacttttattcatgtaatgatgcatatcacttgtgattttccaagattaatatcatgcccagaaaataagttcatgtcgatacttgggcaagattttaactatgagcagcctactttctacacccttcttaaaagtattcttggtgtaactggaattctgatggtcttgcttatggcctttatcttcactctagcgacacattatttcagaaaaagtgttgtcaagttacctttgtcgttgcatcgattggctggtttcaatgccttttggtatgcacatcatttgcttattgtggtttacatactcctgatcatacatggctactttctatttctcaccaaggaatgggacaagaagacgacttggatgtaccttgtagttccgctagtactctatgcttttgagagaattcacccattttttaggggtaaagatcaccgagtaagcatcattaaggcaataatatacacaggaaatgttctggcactatacatgaccaaacctcaaggattcaagtataaaagtggaatgtatatttttgtcaagtgcccagatatatctagttttgaatggcatcctttctccatcacctctgcacctggagatgactacttaagtgttcatatacgaaccttgggagattggactacagagcttaaaaacaaatttacacaggtttgtgagcctcacagtgctcaaccaagaaagggaaaccttatgaggatggaaactagagcaccaagttcaaactataaccattcttcaaactcaagcattcgatatccaaagatcctcattaaaggaccatacggagccccagcacaaagctataagaactatgatgtcctcatgctcataggtcttggaatcggtgccacaccaatgatcagcattctaaaagatatgttgaacaacatgaagtcagaaagccctaaagagggaacctatatgcaggactcagaccatagctatcacttagacgatcaaattaagaaaggtcctgaaagagcatatttttattgggtaacaagagagcagtcatcatttgaatggttcaaaggtgtcatggatgatattgcagattatgaccacgataatatcatagaaatgcacaactatttgactagtgtctacgaggaaggtgatgcacggtccgctcttattgccatgattcagaagctgcaacatgctaaaaatggagttgatgtagtttcagaaagccggatacgaacacattttgcaagaccaaactggaaaaaagtcttcactcaattagcaaacgcacatcaaagctctcggataggtgtattctactgtggaagccctactcttacaaaaacattgaaggaactttgtctcgagttcagcctaaactcatctacccgttttcagtttcacaaggagaacttctaa

SEQ ID NO: 50948 - DNA, 468 bp, Glycine max
  Peptide Sequence Number=SeqID_142633
atgccttacaaggagatagctccgaagaagctctccataaagaggtgcaggagggatgcccttggagaaggcttcagcgcccccgtagagtttgacaatcaccggttccggagtgtcgagcaccagcagtgtttcgaggccatcaagggatggtcgttccacagggagaggcgcgtccaactcatagaggatgagtacccgaacttccaagaggagatagctcgcaggcattgggaacctctagtgactcccatggccaagttcgaccctgagatagtcctagagttctacgccaatgcctggcccatggaggagggagtttgggacatgcgctcgtggataaggagtcagtggattcccttcattcaacgtagatgccctcagccagttcttgggccacccactgatcttggaggaggaccagcagtgcgagttcagccagaagagttaccaggcctctggctttga

SEQ ID NO: 50949 - DNA, 234 bp, Glycine max
  Peptide Sequence Number=SeqID_142634
atgtcagtgaaaaacctcatcgggcgcctaggagtacatgacaagacaaaccacagactagcaaggagaccaattagggtcatgctgttttgcgagaatactccaaccatgtgggaatggcataggcttaaaggagcactcaaaccgggtgtatttatctccaaggcctacactccgaagagtccatcagggtctctccctcctgattcaggtccaacccagaaaacattttag

SEQ ID NO: 50950 - DNA, 483 bp, Glycine max
  Peptide Sequence Number=SeqID_142635
atggccaggtatgccactctggttcaagtttctagagaagtttgcgaagctgcgtactttgatgaagacgagtatgacaaaatgttgcatttcctgtcaaatgaggttagaaggctaaagtcgaacaaaaacagtgaaccatgtattgatgacaatgatgagcaagcaaatcagcagggtcataattatgatggtattttagaccctattgttgttcgaactaaaggatgcggacaagttggagtagatgaatccgggaaacgaaggagaatccaaaagtgtgggcaatgtggtggaagtggccataataagtgttcttgcaccaatcgtcctcgaaatgcaaatgtttgtgttggtggttcatttatttcattcagcgaacaaactaacactatgtgtcaacctacagatgaatataactatcaactgttgatgcagcagccacatacatttgttgctggtagtagtcgtcctggtccataa

SEQ ID NO: 50951 - DNA, 528 bp, Glycine max
  Peptide Sequence Number=SeqID_142636
gatatgccctgcaccttcaagccaactgttgacatgaatcttacttttaaggagacacagattatactcttcatggctctgaaggttgcttacagccaactataccgcacaaggagtgtttggtgtatgcccccaacttttgtgctggatgtaattgatgggactcccgtggaaattgtcatgttgcattatggaaaggattggatgccttcattttcaaacttaaagctggccaatgtgatgctcagtgttctggaaagtgtgtttgaaacacaagatttaatttttggatttgatggaatggataattgggatattgtggaacccaggggaatacctaattgtggatccagtgaaaagtcagcattatgggtcctagaatggatgcaaatggaggagtcatttgtgaatctcttgtatggagtgctagatgaaaaggccatcagaatgaaggtcgcaatgatcctacttttagggacacacaaccagtacaagggagagttgattagaaatgcagagcgcacctga

SEQ ID NO: 50952 - DNA, 637 bp, Glycine max
  Peptide Sequence Number=SeqID_142637
atgtacatttgcagagagaagcgggtgatgcgaagcgcacgcggtgacttacgacgaaggaaagcggtgacagagaaagagaaaagaaccccctttgagccaaatttgcaaggggtggttgttgaattgaagttggatggtttgagaaatgttttgaaagaagaaaactttgagaaggatgaactgaaaaatagaaataataaaaaggaagatggaagtgtcttttgtttgcaaatcgttgaagaagaatggggttggaatgtggatactatgttgtatattgacttcacgaagatgtttctggctttgatgtggttgaagtgtatgtggacgagggggtgtttgacaaatctgaaaaaaaagttgaatgattttaagggagatgaggttgttgtaattgatggagtggaggttgaagcagttgtggagggtgaagatgaggctgagattcaggtggaggatgaggttcaggttcatgagcaaggtttggtggaggttcaagtgcaagctgaagatgaggctagtgttgtaggtgagatggcgattgttgttgagggtgtggtggaggatgatgttggggccgaggaagatgatgatgatgttggggctgaggaagatgatgatgatagcagtgatt

SEQ ID NO: 50953 - DNA, 225 bp, Glycine max
  Peptide Sequence Number=SeqID_142638
atggagttttgccccagttgtggtaacatgctacagtatgaattgccttatatgggtcgcccttcaagatttttttgttctgcttgcccatatgtttgccacattgagaatagggttgagatcaaaagaaagcaaaggttggtgagaaaagagatagagcctatattctccgaggatgacatgacaaatgcaccatcaactgaagtttggcttgacaactcctaa

SEQ ID NO: 50954 - DNA, 720 bp, Glycine max
  Peptide Sequence Number=SeqID_142639
atgaagcaaaatctcggcttcaaaatcggaattgcacgaaaccatataaagcacggcctctcctcgatgatcagcttcttcgagccaccaggtcgcagtggtggtcgtggtcgtggtcacgacggtggggacggtaggggaggaatcgaggtcgtcggaaaagtaattggagaagaggttgttactgtccatggtggcagccacaacaatgatcagctcctgatcaaatctagaaatggatcaaattcaaagaagcaacttgaaggaagggttgccaaagtagaaggaaaagatcaagcttggagagattttttgaaagaatgcaaggacattacccataaaggcttagagaataatagggagcttgtggaggcttcaagaaagaaagaatgttgccaagtatttagtcttaatggaacgcctacagaaagaaattcccaaagtagggctgttctggagatatttccaagggggtgctttttttgcatgtaccctgcatgggaagcgccagcagaactggcgacttcatgcatgtgcgacaagtgtcaagtgctggaggaaagcgcaaacctcattggcgatttcatgtttgaattgcaacacgtcattcccgttagcgctttgactggtgttgtcccgtcaagcagcagcagcagcagtgcagggctaggccataggtgcagggaaacgccattcccattggcgcttcctgcctcctga

SEQ ID NO: 50955 - DNA, 624 bp, Glycine max
  Peptide Sequence Number=SeqID_142640
atgccttcatggtcgtcttcttcttccgctctaaccgctcccaatttgcgtcttcgcactctcagaatttggtcctccaaggactatgcaatcgccgcattcattttcctcattctcttctctctccttctcttctcccacttggattcccgttacgattcccagccccatcactccaagctcgttccgttaaccctcctccgcaacgccaaccaaacgcgcgcgctttgcttggacgggagcgctcccggttaccatttccaaagcgggttcggatccggatcccgcaattggctgatccacattgagggaggagggtggtgcaattcgataccttcttgctaccagcgaaaattcactcatttggggtcttccgatcatatggagaagcttattcctttttcaggaattttgagctctgaccctgctcagaaccctgatttctttaactggaacaaggtgaagatacgttattgtgacggtgcatcttttgcgggtcatccagagagtgagagaggaagtgggttgttcttcagaggccaggtcatatgggaagctattatggatgaactcttatcaactggcctgtctaatgcaaagcaggttatacttccaccacaataa

SEQ ID NO: 50956 - DNA, 420 bp, Glycine max
  Peptide Sequence Number=SeqID_142641
atgaacaaccaattcttggaaatgttgcttcatcaatcggttcagcgttggtcaagcttacagactacaaagggtggaataagtagagctatgaggcacttaatgggggtgaagggggatgttggtgcttgccagaaagttccacttgaaatcaaggaagcttctgagaaaaataaggttgtaaatgatgtagcagttgggcaggagaaagatgatgatgaggtagaagcattggaagaaatttacaacataagggttggaaaaagacttgcagcaacaggttctactcctgctgccaagggaaatactgtgaaagaccatatggatttgcatatgcctatagaagaaaacaggattgcttctttaatacaacagacaattgcggaatctgttggtgattggtactttgaccgagaagcg

SEQ ID NO: 50957 - DNA, 273 bp, Glycine max
  Peptide Sequence Number=SeqID_142642
atgggaagaatgaaaaaatggaaagaaggaacagagaatggggagatagcaattagggagagagaaacaaagaaagtgaaaatgaacaattcaagagttcaagataagaatcaagaagaattcaagactcaagaagaaagtttagagtcaagaatcaagattcaaggttcaagatctcaagaatcaagatcgagattcaagactcaagattcaagaatcaagagaaggcttaaccaagataagtatgaaaagcttttctcaaaaattgagtag

SEQ ID NO: 50958 - DNA, 1197 bp, Glycine max
  Peptide Sequence Number=SeqID_142643
atgggaggtagaactgtagctagagatttagctcctatcaacttggaaattgaagccacttgcaggcgtaacaacgcggcaagaaaaagaagggaaaaggaagcacaaggatgcagtcaaacctcacctcctcccactccacaaagctacattcaaatggaagagaaacatgcacgacaaatgacgctaggggactactctagtacagcaactccacaattcttcacaagcattgcaaggccggaggttcaagcggccaacatttcttatcctcattctcttgtactactaatacaaggaatcctcttccacggaaacgatgggcttgaaaggcatgaaggttctcaaaaactcagaatatttttagttcctttaggtgaatctgaagagacatcatcgacagatgcaagtgctgttcggcagagtgatcgtgattaccaatatgttgttgtcgtgaatgacatgaatggtattaatgctttaaatccaaatggaattttgaatgattccatgaatttccaaaggcccttgccaattcctcccactccaatccagggaagtattgagagcaatgcatcattttctactgctcagctacatcctgagtactccaatataagaactgcggattgcagataccctcaacaagcggctgctactttgtcaagcgacacccatccttatcagcatggggatgttggtcggcccaaaaagctcaataggcatttggactacaatcctggcaatgaattagtgactcccttatatgttaatccaagtgatggttacagtgatgaaatttttggtggaaggtccatgcaaaaggaaagaagagtctactctgaaaatcctctttcacgcttggatgatctaatctatcaacagggtgaatcttatggaattactgactcccctcatgggatgccccatgccttatctgatccacagttgaacgagagtggagcaaggtctggttacatcttgcaaaatggatttggtcaatctttctgcattaaccttgaaaagtgtcaattatcttcaattctaccccataaagtctcacaggtgaaccttatggaaaatcagcataagtccattgtccatcatcctcaaatgcaaagtaagacaccaaaagttgagtcatctgagccacacaaaaggcaagatttgacatcttctccattgcattacatctga

SEQ ID NO: 50959 - DNA, 261 bp, Glycine max
  Peptide Sequence Number=SeqID_142644
atgacatcaagaagaatcaagattcaagagaagggcacatcctttgtggtacaagtagagggtacttctacttgggttattgtaactaagaacaagagagggtacatctcttgtggatcagctcaagtggagggtacatccacttggttgttcaaagagaacaggggagggtacatcccttgtggatctttgcttgtaaaggcttttacaaggttgaaaagaaatctcaatgaccacaggtcgcttggggactggatgtag

SEQ ID NO: 50960 - DNA, 378 bp, Glycine max
  Peptide Sequence Number=SeqID_142645
atgaaccaagacgcagaacattctgtaagcttaggctctactccaccaccatcacggttaagcaccctcaataaggaactagaaatggttcttgccactctgcctgaattaacaaatgaagagcacgaacagtgctgcaaaatggccaagatcatgctgaaggtcacagttccatcagagatttacggtaaagttagtaggtcatttgctgtgaggtggaaagacgtgcttgaccgttactggcatttgcttgacaaggatgggaatttgcatattgttctctacaaccaagatttggacatactagccattgtagcatggtggacaacactgagggatttctatcatatgactggagagattatcaagtgccgttaa

SEQ ID NO: 50961 - DNA, 585 bp, Glycine max
  Peptide Sequence Number=SeqID_142646
atgcaatcacagggactcgcactacctcctgagcctgaggttgggaacgacccagacacgggtaactcagagaactacgggttgtacgtcgaagaaaatcatccctgcctgattgccctaggaagactttatgaggggtcaacaaacattcacaacatccttttgcgccatgatcaagtcaaggttggtgttgaggaagttagagatgcagatgctccttttcctgtacccactcaagaggttcagttagtggggcagacattaacaccttcgttgcttggccgacacatcttgtcaagcgtttatcagaataggcatatgactgagacaagtatgcgagcagggaatgccaatgtgtatggattcctcgagccacagtccatacagagacctgggcaatcacagtcaaagagggatgtgtacctaggagcctacttgaatggtgcagatttgcaaatggtcgtcattttgcctaagaaaaatgttgtcatttggttttgttcgttgcataataggtcagacaactacctcaaaggaataattaacagtgctttgaaaggacttgacgatactccacaaaactaa

SEQ ID NO: 50962 - DNA, 510 bp, Glycine max
  Peptide Sequence Number=SeqID_142647
atggaaaaatctgacaggaaaaccctcaatgataagaaagcaaagaaagtttacatcacttgggaagataacgatatggattcatccggagactcagaaaatgaagtcgtgaatctaagtctcatggccaaaaactatgaaagcgaagaagaggattctttgaagaaaagttggtacattgatagaggatgccctaaacacatgacgggagatgcatcagagtttactcatatttctcccaagaatagtggacatgtgacttatggcgacaacaacaaaggtagaattcttggagtcggaaaaatagattatttagaagatatgcatattcatgaggaaaaacacaaaggcaaagaaaatggaaatgatgaagactttcaaattgatgaaacaaaaacaagtacagatcttccaagagagtggagaacttcaagataccatcctcttgataacatcatcggtgacatatctaaaggggtaacaactagacagtctctcaaagatgcatga

SEQ ID NO: 50963 - DNA, 642 bp, Glycine max
  Peptide Sequence Number=SeqID_142648
gggaacaacttaaagatgtgggaggaagtagtagaaaaatttctgaagaagtacttccctgaatcaaagacaactgagggcaaagaagctatttcatcattccatcagtttcttgatgaatgtttgagtgaagcactagaaagattctacgacttgctgcggaagacacctactcatggattcacagagcctattcagttgaatatcttcattgatgtccaagcatttggtaaatgcttctactggggaaagattaagttgaagactccagaggaagcaatggagctcattgagaacatggctgctatatttgtggaggagctcatgaatctgtctgttgtattccctaagatgatgctgctaaagaggttaccaacaatgagggaatttcaatcaaaatcaagggcaaggatgaaggtctcaatgtctaatcataagagcactgagtcagccatcaagaacctggagatccaagtgggacagctggccaagcaaatagctgagagttcgtctagaggttttggagctaacactgagaaaaatcccaaggaagaatgcatggttgtcatgaccagaagcaaaagggagatcattgtggagaatgagagtaggaccaatgaggagaaggagttaggagcttag

SEQ ID NO: 50964 - DNA, 246 bp, Glycine max
  Peptide Sequence Number=SeqID_142649
atgggccaccaagacgttgagcaaggaagtttaactagaaggggtagcaatggacgtgaaaagggtgatggaagggagcaagtaggtgagggaagggtagtgctgccaattgggacgagggagaattgtgaacaagtgagggggagagatcgagtgcaaggcggagatgggcttggtgaggtgaaggagcaaaaatgtttctctggggattgtgagggatgccaaaaatctcatcttgggacatga

SEQ ID NO: 50965 - DNA, 183 bp, Glycine max
  Peptide Sequence Number=SeqID_142650
atgacaagatttcagaagatggcaaaagaagatgcactttctcttgacaacattgaaggtggtgtatgtgctgagtacaccaatgccggtgtttatggaagacgaaactctggatcaaacaaggaagcgttcgaaatgggagaacgacgattacatttgtcatggacacaggggatcctctag

SEQ ID NO: 50966 - DNA, 360 bp, Glycine max
  Peptide Sequence Number=SeqID_142651
atggataacatctttgaggtggtgccaactactgaggaacagaaaatggtgtatgacacattcatgttgaaggatgaggcaaaaaattggtggaaggacacaagggagaggatgatggccttggagactcctgtcatttgggagaacttcaagatcacattcttggagaaatactttccccacaatgataacttgaacaagttgaaggcagaccaatgtctagtcctcaaaaggaagagtgaagaaatgacgcatcctcccactatcaagtacaagatggaaggattcaagggcaagaaagtgatgatttttgggactcctaaggtggaggcatgccccaaatgtgggaaaactcactga

SEQ ID NO: 50967 - DNA, 141 bp, Glycine max
  Peptide Sequence Number=SeqID_142652
atggtggcaatcgcagcacagcttcctctgtctcaattgggtcggatctcagtatctgacacagaagaagaagaagaagaagaagagcacgggcttggtgtcatccttagctggcttgaaaggaggtttgcgtttcggtga

SEQ ID NO: 50968 - DNA, 726 bp, Glycine max
  Peptide Sequence Number=SeqID_142653
atggtagatgaacttgttgaaagtggttcagtaaatgtgatattgtgggcacgtgcaccaactgcaacaaggcacattacacccgagagaagtgctggaaagaagaatagacatactcatgctgctgctgctggaacaaatgaagaaaataagcctgaatccaccgatcttgatcaggaagggatagaaaggataagaattttccttggcagactagaaaaaccaacagttatggatattggattcatgagccacagatcacatgatgacactgacacccttatccaaacacttcgccacatgttcaccatgtcccaagaccaacgtaaaactttgtcgaatctctacgacatggatcaattacgtaataatgtgaatgctaggtcgttgcccggaagcaacgcgctgtacggctcgagtacagtgtcaaaagagcaagggtcgctgcatcgccgcccggatgtagtgaaaagtaagcaagggttcccacattttcgtgaacgggtgtgggtaaagaagctagttcatgacaggaggattcgctttggtacatggaatacaggcacacttactggaaaatctatggaaatagtggatgttatggtgaggaggaagatcaattttatgtgcctacaagaaactaagtggacaagtgaaaaagcgaaagaattagacaactcgggttttaagctgtggtatacggaaaaaatcagatcaagaaatggg

SEQ ID NO: 50969 - DNA, 285 bp, Glycine max
  Peptide Sequence Number=SeqID_142654
atgtgggaggaagtagtagaaaaatttctgaagaagtacttccctgaatcaaagacaactgagggcaaagaagctatttcatcattccatcagtttcttgatgaattccaagcatttggtaaatgcttctactggggaaagattaagttgaagactccagaggaagcaatggagctcattgagaacatggctgctagtgatcatgctatcttgagtgatagaactcatatacccaccaagagaagcttattggaactctcttcacaagatgcactgttggcataa

SEQ ID NO: 50970 - DNA, 378 bp, Glycine max
  Peptide Sequence Number=SeqID_142655
atggcaagcagaaatgaaaacgtccctaccattgtctactatgatgcctatgtaaccgattgtgatgatggcgtagagtttaagggtggaaataatgtacttgtttcaatgaagagaggcatgaccttcaatgccttgaaaacaaaaattcaacttaagatgggcctaaaccgagttggtgacttcaatgacgacgaagatgaaattttagcagacaacaacaacatcaacaacaatgacaataatgacatacatttccttttccaaccaacatcaactgaaaatgcctatcatccatatccaaataacgttgatgttggtgacaaccaagtggctgacaaacccgattgcagacattttttggaccaacaacaataa

SEQ ID NO: 50971 - DNA, 132 bp, Glycine max
  Peptide Sequence Number=SeqID_142656
atggtctggggtttcatgatactcaaagaattgtgttattttgaagatccaaccaaaaggatccatgccgccgaagtgcggaacatcgagtttcatgtggttgtgttgtgggctcatcaagcttggtcgtga

SEQ ID NO: 50972 - DNA, 234 bp, Glycine max
  Peptide Sequence Number=SeqID_142657
atgggtcatgaagaagaggaggaagatgatgataacaacaacaccaacaataacgacgacgacaacgatgatgatgatgacaatggtgatgatcatgttcctcaacaacaacaagaagaggacaacaaacacatgcaaatccagtccaacaagataagagacctcgatgtatatctagaagaactcgttgtgggacatcagctcattattaatttttcgttaaaaaacatgtaa

SEQ ID NO: 50973 - DNA, 438 bp, Glycine max
  Peptide Sequence Number=SeqID_142658
atgggtgaagattcgtggtcattggtgcgcaaacatctgcataaagaactcacaagctggtcaaaagagtatataaacttgcttggtggcatagagaaatttgaggaattaaagtattccctacttgttgctggattatatatggttaccatagacaagtcgataaatattacggatatgggatatgtcattgcttcacaatacaaaggttttgatgatgccaaagtagaatcaaacaaggttgcttcaacaagcattccaagattaattcaaggtcaagcaaacaagatcatgaaaaagataaggcctcaaacaatctcattggttgatcaagcttttgtctcaaaacacattgtttccaacatccaaggctctggtaatcgattaccaggcagtgtaatcgattaccagaagacaattttgaaaatcagcttttag

SEQ ID NO: 50974 - DNA, 243 bp, Glycine max
  Peptide Sequence Number=SeqID_142659
atgaagacatacaagaagcaaagtcaggtaaagggagtagagtcattagaattggtttgccagcacattgccttctccaagtactcttgcgttctgcaaaagccaattccactgctttttgccagtatagtttctaagatagcagagaattttcgggcactctgtacagcatgcatatgtatattgggtaatgtgagactggagtttcttgttgaccaacaagaatgtttggtccaacagtaa

SEQ ID NO: 50975 - DNA, 219 bp, Glycine max
  Peptide Sequence Number=SeqID_142660
atggttgggaagttactctcaaacaattctttcaatgtgagagcttttaaaacatcaatggaaaatgtatggaaagagtggaattttcatcaaccgctgatcattatgaatgacctaggaccagatgaagcgcttaacaaagttgacctcccctggagccctttctggatcaggattgaggattttcctttagggtttcaaacccaagctataacataa

SEQ ID NO: 50976 - DNA, 225 bp, Glycine max
  Peptide Sequence Number=SeqID_142661
atggagctttttggagggttggagatggctccaatgtggagatcttcaatgacaaatgaatcccaaactgtgctaatggccttattcattaggaccataatcgtgggattgataaggatactcccattttgtgaaatgttgaaaccacttcaatttcaagccaaaagaagggaaggtcgagcagttggtgtctcgctaagcgaggcatatgcgcttagtgagtga

SEQ ID NO: 50977 - DNA, 588 bp, Glycine max
  Peptide Sequence Number=SeqID_142662
atgatcatcggattgacttcattttctcctaaaaacacatacttcaaatgttctggaagagtcttcaactccactttagtcttttctaccggattgtccttcttctattcttcaaaaaccattcttccagagggattctcttctacaccttctaattcctctaaacaactctgcacttctttttcttcctccgttgtcagacactccatagttaaaaagaggctaagtcatgaagtgcaaaaagtgacagttgagctcagctcatcagttgggctaagtgcgcatccattgctaagcgcagcttcagtgtgcttagtgagacagaagaatttggcagagcatcaatatcaaggttgcgcgggtatatcctttgtggtacaagtagaggatacatctacttggattgttgcaactgagaacaaaagagggtacatctcttgtggatcagttcaagtggagggtgcatccacttggttgttcaaagagaaaaagggagggtacatcccttgtggatctttgcttgtaaaggtttttacaaggttgaaaagaaatctcaaggaccgtaggttgcttggggactggatgtag

SEQ ID NO: 50978 - DNA, 1062 bp, Glycine max
  Peptide Sequence Number=SeqID_142663
atggcctttaggaagaggaaatcgaccgccttcagaccccaggagccctatgacaccactagattcatatctgaaggcgcctgggaaagatatgcacaaaacgttcactcccggaacatccttccggagaggaatgtcacgttatacatttctgaatatgatgaaatccgaagggagcttgagcagcgaagatggcacaaggccttgagcaggcagcctgatggttacatagatgtggtcctggtcaaggagtttcatgcaaacttatatgacccagaggataaatcaccaaggcaagttagggggagtgttacaccgcctagaccaggagcgccctggaagctcctgaggaaggacctcaccactttggcgcagacctggagcgtcttatcctattctaacctcgcccccacttctcacacgtccgatcctaatattgacagggcgaggttaacatatggattagttatgaagatggatatgaacttggggtcgctcatttcaggccagatctcgcagatggcccagtctaactcctccaggcttggatttccggcgcttatcactgccttatggatcgcccgaggagttgttctagattctttgactttcgagtccttgagccctgccattaatttggcatacatccgaaagaactgctggaacccagacgatcccacgatcacattttcggggacccgcaagacttgggctcgaggacctgaggcttcttcttctactccctctgctccaactccaccatcagcaccctccggcacctccgctcagagcacaaagattttagtgtcaatgctgcaaagccttcaccatggcttatccctggatttcatggctcaagtggcctggctaggagtccagccttctcctttgcagggaggtgaggcttctacagcccaggagctacagctagaggccgagccagagccgaaggtgacaccagaagccgaggagacaccagaggatacccttgctgccacacccactgaggacacggattatgttgcagatatggcggcggtgcagagcacctgggatccctag

SEQ ID NO: 50979 - DNA, 414 bp, Glycine max
  Peptide Sequence Number=SeqID_142664
atgagtcatataaagatcagaagatcctatccattaccatccctatcaacaccacttctcaaaacggttcttcttcatcatattgtggctttttccttcaaattaggcacccaccctgatgaaacaaatttattcccgaagattgcagctttgtgggagaaactaattgggcaacaagttttcaagggtcgagaccgaggcagcaatagtacaaagcaattttggaggatccaaaggaagaaaagggagagggtccgtgaagagtggtggcatgtcttagtgccaaagacgtcaccctcttatttgccgacgctatcgtcatgccatcgcgaaatccataactacccccctcaacctccccatgcagatgcgaagaatagatggagcctgaacaacaaccaccaaaccctatga

SEQ ID NO: 50980 - DNA, 492 bp, Glycine max
  Peptide Sequence Number=SeqID_142665
atggagcgtggtcatggaatgtattacacgccagcaacattttccgaatatccttcacagatgtatcagtatccttttgcaggtcatcatactgatacttctgagacctcacattcgttcggtggtgttgcggaaacacaacctcatttttcatggcccactatgactccttcacagcagcacgatgcccccatggcaacacctaacgccccatttactccgcaatggaatgtacccggagcaataccttatatgggcgacttattaggtgttgatttgcgtaaggagttttctgcagaggctgagcaagagaagcggggagacaacgcggcggcagaagaaatcctgatcgtcaagcgcgaagatgggatcgaccatgtggcacatcctcacgacatcacggacaccataatgactgattttgatgttttcgagttagggcaaggggttagggttaggttttatgcattagggttaggttttggggccaag

SEQ ID NO: 50981 - DNA, 384 bp, Glycine max
  Peptide Sequence Number=SeqID_142666
atgactatactcgtggatgataaaagacttccactagagggggaggctaccatgtggaagagactcacacttgagggggagatgtcttgggttacaagtgtgagtgtggtgttagatctccttatgtggtggctcgtggtccacaggtgtacccctcgatacaagtgtgagtgtggtgtcaagcttccttatgtggtggctcgtggtccacaggctcggggtcagacggatatcactaatcccatctccgcccctacctctattttggattattgggaaaaatctgaatctgactccaaatccggtcaacacgatttttctctgtcaaagtcggaacgggttcaatttgattcccatgaggtcagattctgctaccatgcctag

SEQ ID NO: 50982 - DNA, 2160 bp, Glycine max
  Peptide Sequence Number=SeqID_142667
atggctatagttgaatccgtggggaagattcctttgcaagacccacctgaggaggagttttgtgctgctgacttgacttggaccaagtttggtaatgctgagcaccatgatgaggttgccctcattccctatgacagagttgatgcttttataattggtgaatgcactaatgtggagtgcccgactcggtttcatatcgagagaggaaggaaacggactattggaaacttgaaggagtacaaggacgatgagtatctggagtacaggctgtactggtgctcgtttggccctgaaaattatggggagggaggaggtatattacctagtcgaaggtatcgacttaatactcgaaatcgtgctgctagacctcaatcaatgcgaggttgtacttgtcattttgttgtcaaacgtctttatgctcagccatcactggcacttattgtatacaatgagaggcgtcatattaacaagtctggttttatctgccacggaccacttgatagagatgccattggcccaggcgccaaaaaaattccgtatatttgcaatgaaattcagcagcaaactatgtccatgatatatttgggcatcccagaagagaatatcttggagaaacacatagaaggaattcagcgatattgtggttcagatgcaaaagtcagtagccttgcttctcagtatgtccacaagctagggatgattatcaaaaggtctacccatgagctggatctagatgatcaagctagcatccgcatgtggattgaacgcaatagaaagtctgtattttttcaccaggatacttcagagtctgaccctttcatcttggggatccaaacagaatggcagctgcaacaaatgattcgttttggtcatcgaagtgttgttgcagcagactctacgtttggtgtgaagagacttaaatatcccttgttcacactacttgtttttgattcaagacaacatgcacttcctgtcgcatgggtcattacacgtagctttacaaagcctgatgtgtctaagtggttgaaagctttaattgatcgagctcgtagtgttgagcctggatggaaagtcagtggatttttaattgatgacgctgcagctgaaattgatcttttgagagatatattttgctgtcctgtcctattttcactatggcgtgttcgtagatcatggcttaggaatattgttaagaaatgtagtaatattgagattcagcgggagatttttaagcgtcttgggagaatagtgtacaacatttggggaggtattaatgcatcgcttgccttggaacaattcttgctggattttgttgaccaaactgctttcatggaatatttcaaagtcatgtggttgcccaagcttgaaatgtggctttcaacgatgagaaattttccattagcaagccaggaagcttctggagcattagaagcctatcatgttaagctgaaagccaaactttttgatgattcacatcttggagcattgcaaagagtagattggttagtccacaagttaacaactgagttgcattcaagctactggcttgaccggtatgctgatgaaagtgattctttccagaatgtgaaggaaaaatatatagcttctacatcatggcatcgggcacttcaaattccggactatgctgtttccttggatgataaagaccacctctttgccaaggttgtgagccagaaagatagtagcttaacacatatagtgtggaatccaggatctgaatttgcattctgtgattgttcttggtcaatgcaaggtaacctttgcaagcatgttgtcaaagtaaacatgatttgtgaaaatcttaaaggttatcaaccatccatgtctttccggtcttttcaagaggttttgatggatctatggaaaaagccagtggatgattcttttgcgttggatctgtcattggcttggacccatcagatgctagatcaaattcaaaaacaagttgaactgaataattctactgatattggcactgtagttaacaatatgccactgaaatgggtttctaagaaaggcagaacctacattggcaaaccatcatcaagtttggctcttcctcatggtagcagtaacacaaaaagtgtggttgtgtataagaagaatcggaaacggaaaagattgtctcgattaagatga

SEQ ID NO: 50983 - DNA, 354 bp, Glycine max
  Peptide Sequence Number=SeqID_142668
atggttaaggaggagcgtaaggaggtaagtgtctcctccaagatgttagctaagaaggaaagtcattttgcaataaagacaaatattaaagaaacttcccctcttagacaacctccacatcttctactttgtaaaaagaaacttgttagcactgccagacctcttgggtttgatattattcctcaagtaaaggagttgttggatgagggtttggttcataagagcttaaatccttgtgctttgttggtgcccaaaaaagggaatgatgcaatcctacccccccaagggcattggataaaagactccaagaagattggaccaaagaggcaagagaagaccctagggttctcatga

SEQ ID NO: 50984 - DNA, 108 bp, Glycine max
  Peptide Sequence Number=SeqID_142669
atgtctgatgagtcttccattgagaggtttatagcctcattgattgaggggttgaatccctcgaatctatcagatggaggaatcaggattgattccaaacatctataa

SEQ ID NO: 50985 - DNA, 615 bp, Glycine max
  Peptide Sequence Number=SeqID_142670
atgtcaagtagaaatgaaaacgtccctgtcgtagtctactatgatgcctatgtaaccgactgtgaggagggcattgagtttaagggcggaaataatgtacttgtttcaatgtggagaggcatggccttcaatgccttgaaaacaaaatccaacttgctcgtacaatatgaacaacaaccttcttctaccactaatgtcgaaacaaccgttcaatcaccacaaattcacgaaacatcatacacagactaccatactcaaacctaccatgaaggctcttcctcttacacaccaatcccatacaagaccacaaatgattattacgtccctcattttgaacccaccgaattcgatacccacattagttcatacacacaactacttggtggattgtcaaactattgtgagacgactccccaactaaatgagccctcccaactaaatgtcgacccaactactgatattcatgttgctcagtctaaaagtaacaaaatatcacatgactatcatgctcaaaatgggttggcgaacaaagtagttggtgacttcagtgacaacgaagatgaaattttgatggacaacaacaacaatgatgacaactatgataatgacatatag

SEQ ID NO: 50986 - DNA, 192 bp, Glycine max
  Peptide Sequence Number=SeqID_142671
atggggattttcaaccatggagttgcagcagaagataaaggagaagagtctagcacatgggaagcttccttgagaagcaaggaaggtagcttccttgggaagctagaggaagaaatcttccttgggaagctaaaggaagaaagcttccttgagaagctagaagggggctactcacacccctctaatagctaa

SEQ ID NO: 50987 - DNA, 381 bp, Glycine max
  Peptide Sequence Number=SeqID_142672
atgaggtaccaagtcgcttgtattttaaacaacgaaaaaaaggttcttccagtagaacaaattgttctaccggaagaactttcttccgaagaagctaccggaagaagttcttccgataacttctccggaagaaggttcttccggatgaataaattgttctaccagaagaaccttattccggagaagctaccggaagaagttcttccagtagctttgttcttctggaagaaccttcttccggaagaagttcttctgaatagcttgggagcaatgagcacggttgaaagtgctttctacgtcaagcaatttctatttatattgttagaatttaaaactacatttacgtggaaggagccactatctgctcattacaccggctga

SEQ ID NO: 50988 - DNA, 297 bp, Glycine max
  Peptide Sequence Number=SeqID_142673
atgaagcttgcttctacagacttaataagagaaactcatgacacaaaactcttccagccatcatacaatgggaagttcttcattcctttcccggttgatcacaacaacaaattggctcaattcttccaaatagagaataaagataaagagatttacgaaaccaatggatgtcatggacaacaaacttctccttttctatccattgatctctcgatggaagacccatcagacattttctgttctggatatatccaagacgaagaaaatgttactattacaaaatcaacaaagaactaa

SEQ ID NO: 50989 - DNA, 390 bp, Glycine max
  Peptide Sequence Number=SeqID_142674
atgagaaaagtgaggcgaaaaacgaagatgtttgtcgacccaaagaatgcaaacatagctacattggttgaagttgcagagacattgcagtatatggtgtcaccacgagggaggaacacatggacagttgatgatctcgtaccttatgtggagaagataacgattttatccgaaaagcaagagagaatcactgagcctgtggcacatggtccagcatcagagcgtcgatttccaacacaagagtttcacattcttcagtcaagtgttgaaactcggggttttggcagacaaaaggaggttgttgaagcggaagaaatttcccaacaaatggaggagcgtggccatggaatgtattacacgccaccaacattttctcagtatccttcatag

SEQ ID NO: 50990 - DNA, 255 bp, Glycine max
  Peptide Sequence Number=SeqID_142675
cccgtccaagtgatcgaggtaacgtcatccgaggaagaccctgaggaggatcccgaggatctacctcctgagcttgttgtggatgctcttgactttctagagggcgatgaggacccacttcttgaggtggattctcccgaggaagtcatgtcggcatctgaggcagactctacggaggatagtggcccgggggagatggcgatcagcggaggctcttcatcataccaccactatggacacctttgctctggatga

SEQ ID NO: 50991 - DNA, 198 bp, Glycine max
  Peptide Sequence Number=SeqID_142676
atgacattaggtgctgaattcaatgtggaaagcttaacatgtagagattggaacacatcattgaaagtatcccaaaaggtatgtgttcggttctgtgcaagaaagaaaaggactacctatataagcatgaagtttagccgcttcaagaagctgggacttggctttgatatgcttatgaaggatagggacacaggctag

SEQ ID NO: 50992 - DNA, 291 bp, Glycine max
  Peptide Sequence Number=SeqID_142677
atgactattgaaatggatatagagcccaagttcaatgaaaaatgtaagattcataggaaaaaccattttgatgacattgttaatgatgagatagctcatttgttgaaggtggtcatggtggagatcacaatggtgatggtggcgatgatgacaatgataacaactatgttggtggtggcggcgatgattgaggatcatggtggtggttacggtgacagccatgacagttatggtgaaaacgatcattatgatggtaatagtcatggtgatgatagatttgagatattatag

SEQ ID NO: 50993 - DNA, 279 bp, Glycine max
  Peptide Sequence Number=SeqID_142678
atggtctatgtgcggaatgataggctctctcgccagcatcacgaatcgtgtgacgttgctcggatcatcttggatttcgtccgccatcacgttcaggccatagagctccgccgcttgtgcgctcacaatggtggtgtaagggctgttggaggcactgatgtactgcctgacctcctgttgatggagttgatagcaccaagtagaaacatgatgaaaaagaatgatcatctccctgctgaattccttttcaatatcgtgaaggtgaccaagtttgtttaa

SEQ ID NO: 50994 - DNA, 399 bp, Glycine max
  Peptide Sequence Number=SeqID_142679
atgctgcgagaagagcaagaaatacaagggagcagtcaaccctcacttccaccctctccacaaagctactatcaattggaagaggagcacgcaggacgagtgacactagaggactactttagtataactaccccacaattcttcaccagtattgcaaggtcggaggttcaagcggccaacatatcttatcctcactctctcatacagctaatacaagaaaacctcttccatagtctgtcaaatgaggatccttatgctcatctcgccacctacatagaaatttgtaacacggtaaagatagtcggtgttcccgagaatgccatacgcctcactttcttttcttttctttggcagaggaaacaaaaaggtggttacactccttcaaaggcaatagcttga

SEQ ID NO: 50995 - DNA, 1020 bp, Glycine max
  Peptide Sequence Number=SeqID_142680
atgaatgaaaacgatgatcccgctaagcgcgtctgtgtgctaagcgggcttagtgttcagacattaagatttttgaaattttcgttcagcgctaagcctgccctatcaagattccattctcaggaagcttgggacagatataataacgatattgtggtgccgaggaaactactaccagagagaaatgtagtagtatattacactgagtttgatgagttcaaggaggaactcaagagaaggaaatggggtgaggagctgactagttttgctgacggcagcatcgatgttgccattgtgaaggaattttatgcaaacctctatgacctggaagacaagtcacctaagcaggtgagggtcagaggtcatctgatcaaatttgatgaagatactttgaacacttttctgaagacccctgtgattgtggaagagggggagaatgtctgtgctcattccaggtttgcactcctgaggcctaatcctcatgagttggttgctaagctttgtatcccaaggaggggatttgagttaaacgctaatggtcagccattgaagattttaaggaagaacatgaccattttagctcagacatggagtgttttttccttctttaacttaattcctacctcccacacatctgatgtcatattagaaagagccaagttaatctatggcatcatcatgaagatggatatgaatgtggggtacctcatctcccaccagatctttattactacacaacatgattcatccagacttggattctctactttgatcacaactctatgcaaggctagaggagtccaatcagattctagatccctaaagatcctgagccctgccattaacttggcatacattaagaagaactattggaatctggatgatccaacagtgacatttagagggccaaagaaggccaggggtaggagatcagaggcccccactactccagcagtgccggacacttcagctccttcttcttccacagctctagcacctcataattcgacaccagcatag

SEQ ID NO: 50996 - DNA, 327 bp, Glycine max
  Peptide Sequence Number=SeqID_142681
atgcagagccttcagggcttaggcctgccatccatcatgagcatggatgagtttgacacacaggtggcctggccaggagcccagccttctccttctggaggggatggggcctccgcagcccaggagcctgaaccaaaggagccggcagcagcagctaaggggccagcagagggggaggatgagctcacttctcctgagcctttttattttgatacagatgtacacatggctcaagaggagacttttacagatcagataccagagccatctcctgcacctgttcctaaggagaccttgccatgttcaccagtcatggagccagagtag

SEQ ID NO: 50997 - DNA, 150 bp, Glycine max
  Peptide Sequence Number=SeqID_142682
atgccttataggctgcatgaaggcatggcaatggagcccgaacccgccctaattttgacagggaaagcccaagttgactggggtcaagttcgagttttccctaatagccaaagtcgggttcgggtaggggataggattattaatacctga

SEQ ID NO: 50998 - DNA, 288 bp, Glycine max
  Peptide Sequence Number=SeqID_142683
atgaagctagatgaggatttgagtcctaatcgcgaggatgatttccaaactaataatgaagaaaatcaagcacaaaggggtgatgaaggtgcaaccagctcatctaatgatcctttacattggattggaggtcctatgataaggtccaagactaagaaaatgaagcaagcttttcaaggcatgattctaacgatcaaagagaaagaagactcgtgtgaattaagggctacacctaattgggtcgctttgggaatcccaattgatgaagatgcgctgagcccaacttga

SEQ ID NO: 50999 - DNA, 663 bp, Glycine max
  Peptide Sequence Number=SeqID_142684
atgtcactacatgatgttcatgtttgtaacactattgactacgatattcatcatgttcagtccccagatttggaaaatatgactgtcttccagaatatcattgaggtaccctcactttatcataaacaatgggctctagattacccaaattatgtggtgttggactacaatggaaacaagcaccatataagagttagaaaatttaataatcgagtctacattgctgatggtctcaaacacttcaggagggatatgagaatatatgaaggtgtgatgatcacatttgctgtgccggacaagaattggaagtttgatatccacttctcaccaccactccatgcacagacatgtggcaggcctccatattctgccagagaatatgtgtttactatggatgtcgacaatcgcatgattgttagactttatccattggtactgtcactcgatgctgtgagttatgttaatgcaggagacgagtatattactgtccttggtgttcgtgagcgtcgtcacttttggaagttgagtatccataatgggcttcaatgtcttgctgagccatggttccaattcttaacagaaaatgatttgatggccggtgacgaagttgtcttttatttcaggccgaatcaacttctttgggaggtcattgccagaaagtag

SEQ ID NO: 51000 - DNA, 189 bp, Glycine max
  Peptide Sequence Number=SeqID_142685
atgatcatcatcaaaacatcaaagccaattgcatctacagcacgttattctgttgttttccagatcggttccttcgccaagtataagaaaaaagaagaagtagagatgagagtcgtcatcgcgaaaagggcaggacggacgaaatcagtgtcctatctttgctttcctcttatctccgatgagaggtaa

SEQ ID NO: 51001 - DNA, 87 bp, Glycine max
  Peptide Sequence Number=SeqID_142686
atggcgggtcacagcagctacacttcttggagatgtcacacagggagagatgagtttgagggagagcgaggtttgagggagacctag

SEQ ID NO: 51002 - DNA, 912 bp, Glycine max
  Peptide Sequence Number=SeqID_142687
atgaatgcgaaaggggttgcccctgtgaattccacttatgggaccttgattgatgcttatagtaaatatggactcaaagaggaagcacttgcttggcttaagacgatgcaaagtcaaggaatggagcctgatgaggtcaccatggggattgttgttctcttgtacaagagggccggagagtttcaaaaagctcaagagtttttcaggagatggataagaggtgcaccttttagattagcatgtgaaacttttgctaggatcatcagacaaggcagatccttgaatacagttacacttaatacaatgattcacttgtatggaaactgtggacggttacgacaagcttgtttgttgttccagaaaatgggagagtttcgaggcctccttgaggcagacgttgtgagttaccaaaccctgttgtatgcatactcgactaggaaaatggttcgagaagcagaagagcttatacaggagatggacgaaagggatcttgagattgatgaattcacccaatttgcgttgactagaatgtatgtagaatcaggtatgcttgagcagtcgtggttgtggttcaagaggtttcacctagctggaaatatcagttctgattgttattctgccaatattgatgcatatggagagcgggggtatactttagcagccaaggaagtctttattttctgcaaagaattgaagaagctcactgtccttgagtttaatgtgatgattaaggcttatgggataggaaaatgctatgataaagcataccaattgtttgatagtatgaaaaaatttggtgttgttgcaaacaaatgcagctacaattctctcattcctattttggccagtgctgacaagccacacattgccaaatcttatcttaaaaaaatgcaggaggcaggacttggatag

SEQ ID NO: 51003 - DNA, 315 bp, Glycine max
  Peptide Sequence Number=SeqID_142688
atggattctggaatgggaacaagttttgacttttactacgagtatccttcaagatcagtaatgggaattggattgttgaaacctctttggaactacatgaactgctttctcctctttttgttcatttcaaggactaaattgagtttcctacctcgtatggatgaggatgatctcattgagagggagctggaagatggaattgaattagcagtcgaggatgacaaaataactgattggatttggagtaatataacagattggggagtgaaattgcacaaaaggaatgaagttcatgacttcaatgaaccattttaa

SEQ ID NO: 51004 - DNA, 165 bp, Glycine max
  Peptide Sequence Number=SeqID_142689
atgagatcacgtcagaatgggttgttcataaattcatgttttggtcactgccaatctgagaggcaggatacatggtttgctgacaactctcctgccattgggaagaaggcacatcaacaaaatcattgtttaaggggattgaaacatggaaaaaggaaaccataa

SEQ ID NO: 51005 - DNA, 954 bp, Glycine max
  Peptide Sequence Number=SeqID_142690
atggagcttagcggaaaaagcattttgttaatgaaggaagcacgagtctgggtaagctcgctaagcgcgatgcaatgcgctaagcgacctcttgcatcccaagcagaagaatttagtgcactaagcatgatccttaacccgtgcccacacccgaaaaggaatccacctgggattcttctcggttcacttctgaagttgcttggcacaggagctcgagaggagatagtggcaccaggtcctcaccagactcctggaaaaacagatagatgttgctctgagacaattaacgacttcctcgacatccctgtcatcctggctaatggagaggagtatccagcttattcccagtacctccacatgcatcccgaccatcaagccatcgcagcagctctgtgcacaccaggatttgacgacactcgcaacgacatggacctggacttgggaagcttcatttctctacagattagccagattgcccagtccagcacctccaggcttgaattcccggtgttgatcacagtgttgtgtggcatccctgtgatcaacttggcatacattaagaagaattgttggaaccccactgatccatccatcacatttcctggggcccgacgcactcgcaccaaagccacagcaccagcaccagatgcccctcttccttctcagccaccttctcaggccgcttctcattcgcagacatccacttcagcaccacccgacatgcacagccagatgctcaggtccttgtaccagggacaacagatcattattcaggacctgcatcggctgtctcttcatctgaagatggactcgccactcatgactccagaggcctacattcaacaaccttctggagccggagatgatgccggagtcgatgaggacctcattgcagacctggcaaccgccgactggggggcatgggcagacttaggtgaagacacaaggccttag

SEQ ID NO: 51006 - DNA, 186 bp, Glycine max
  Peptide Sequence Number=SeqID_142691
atggcatcatgtggctcaagcacctcctccacatccatcagccaacaacagttggctgagataattggaagccttaaggaagagttgaggaatgagattatactcaaccttaaggaagaaatgaggaatgaaattgaagaagaaaacaagtggactctagagaaaatgaaacaggagttgaaggat

SEQ ID NO: 51007 - DNA, 291 bp, Glycine max
  Peptide Sequence Number=SeqID_142692
atgacaccttcctattctccaccaacacaagcgacagtgcgagtgcataaggatgtagttgtcgctaattgcgaacaagaaccgacaacaaaggcatggctgttgacaatggcgatggtcgacatagggagagacatgagcaccatgtggggaggacagagggagggaggtgctttagggtttgagagtggggtgaggtgcctgggtgcaggaagaaaaattaggtacaggaagcaatggcccaatcatagaagacaaaacaacaatgagacaaatgcccaatcatcttag

SEQ ID NO: 51008 - DNA, 318 bp, Glycine max
  Peptide Sequence Number=SeqID_142693
atgcactctgtcacatataaccaagatctggtgagcccaactttacttgctggatggacagaacttaaagagttctgtgggctcattggaaatcatcaggtcaccttgacccattatggacatagtgttttcctcctcacatctttaaaagtagctctgaaccaaaagctttccctaaatgacactccttgtaccatcaaatttctaactcagtcacttttaaggtcatcaagattcatccatctaaacttggaagagacggagtgtagaatagtttataatcatcataggaagaccgcaaaaattggaaatggatga

SEQ ID NO: 51009 - DNA, 393 bp, Glycine max
  Peptide Sequence Number=SeqID_142694
atgcccaccctctccaactctgtttctaccccctctcgttgcccctccgctctagccacaaaactccgccgcaccactccaactccgccgccgacaaccacaacaacgcatgcctcgaaaccgccacaaatcggaagagtgacagtggataccgcgcggaacctggcagcctcatccagatctgcttttagaaggtacacgatgatgaaggagataataaaatgccacagcaacaggcacaccagaatcaaaggtagacggcggcggtgccctcacgtctcattgccggatcgtcgcaccttcgccggcgtggcgaagtttgaagatgctctcttgttggggtggttcctccgaagtgaaaatccgtcaacatatgcaacccattttgtgtaa

SEQ ID NO: 51010 - DNA, 447 bp, Glycine max
  Peptide Sequence Number=SeqID_142695
atggaagaaccatcaaagaagagaaagggctcatcctccacaaccaccgttgcaggacaacgccgccacgacacatccagtgacccaccagcaccacctaatccttctttttcttctccatggtcattgaatctattttcttcagatgaacaacgtcaaagtcagggtgttccttttgagggcactttggttgatgattggaagcatatctattctagtcatgatgcccgtgaaatgaggatgaaccattcgttaaggtcaaacgatcatctgctattggttctggtgtcgttgcctccattggataccgaaaggatgtggatggccaatgaggatcttcaggctttcgtcggtgatagttttgatgctatggaatcacgcatcacgcgtcttgaagatgacacgagcttcattagtcgttgctttgatcctcttgcggatccttag

SEQ ID NO: 51011 - DNA, 342 bp, Glycine max
  Peptide Sequence Number=SeqID_142696
atgcctctatttacaggggtaaggctgtgtacaactacactccctagaccccaaccccatccccaagtggggagtcttgtgcaatggaccaccgcttgtaggggacctaccatagtgtttcatagtttcatttcgtcaaaagggctatccaaagagcttaaggacctaaaaacatttcatgagttgaaggggccaatgacaaggtctagagtcaagcttctacaagaagatatggccaagaggatcaaggatggactactcttcaaagacaaggaaggagaaaattacaaggagctgaattggagcatgttgaagatggttgaacaacatgcatgggtttag

SEQ ID NO: 51012 - DNA, 930 bp, Glycine max
  Peptide Sequence Number=SeqID_142697
atggcttcttcaagagccatcaaatggctacaaatatgtgatcatggtacgaattttaaaaacaaccaatttctcaacatctttctaagagtttttgttcaacacttgctttgtcaagaaaagttcattgggcaaaagcttgtgctattctattttcttcctctcctccattcttacaaaaagcttttcaagagaccgactcttggttgtaaaagtttcaagagacagtctacttggttgaatcactggacacaaaggagtaatgtcctttggggttcattgcaagaagtggaatttgcttcttcctataatcactggacacaaaggagtaacgtcctttggggttcattgcaagaggtgggattgcctcttggtgtaatcactgaacacaaaggaggaaggtcctttggggttcattgcaagaggtgggattgcctcttggaggttactcctgctattggagttgatgcgccagttacttcagctggttctgttgtggtgtcttcatccaccgttaccacatgcttgctaagcgttggtgtggccaccgctagcactcctgtgatgctggaggaatccaagctgcgagtggttaaggagagggaagtcggcaaggagcttgaagatgagctgataatgaacaagaagaaggttatagagcaacatgaaaagggctttaacagggtcgttaggcaggccgggttcttcgctaaggaccttgacttgggtctttcttaccttttcaaggatatgaaggatgatgtttttcttgacgaggaaaatatcactactgatgaggaggtgcttgtagagccgcatcgaggcttaccaaggacggaccttgggttctatgagcttgtgaaactcaccaaggcagaccttgggtttggtgagcttttggagaatcaaccaaagatgcgtgcatcctag

SEQ ID NO: 51013 - DNA, 969 bp, Glycine max
  Peptide Sequence Number=SeqID_142698
atggaggagggtcattgttggatcaagactaagagaaaatactctattaactctagtattgattcacctactaattacccctcctcctatgatgactactcatgggaagaacaagcctttgcaaaagatgcagcttggtctggttgcatatggccaccacgatcatattcttgtaggttttgcagaaaggaatttaggtcagcacaggctttaggtggccatatgaatgttcatagaagagatagagcaagactgaagcagccatatagccctgatcagaatgaaatcctcagtgatggtcttgagaaaaccactcaacagcagagttcagttcagatttcttttacttctttgggttacttatacccatcttctcttgatggattggctcctaacactagccctaattctgatccttattctcatgctcctgcttcaccttccaagtttttagcctcatcaatcaacaagagaggaagagagaaaccccagattccactttacaaaggatgtcttgagtcttctcctgatcttccttccaaatccatgtcaaatttaactgaagacttcagattttgttcacgtaggctcgatcctgaagctggtgttgagaaaatgttgaagggattggattctgggtgtaggagtactgagagagatgatgctaaaactgatgtggctgtgatcttaaacctgtttatgaatcaacctcacccacctgtgaagtttgagactaaggagaaatatacaagtttcaagaaggggaaagcagatgcttcatccattccattcttccccaaatcatgctcagctgataggcatcatatgcagtcacagatgtatgaatttagccctagttccatagaagaactagatctggagctaaggcttggttataggtccaaggatcctactaagaactgcatggaatattgcgagcccgtgttcctatattcagtacctcactga

SEQ ID NO: 51014 - DNA, 285 bp, Glycine max
  Peptide Sequence Number=SeqID_142699
atggctaaggcaaagccagcatgtcctctcacaatggccatattgcctcccaccacaaagtcacaaactagtgatgtctcacataagtttgggttatcaaacgaggtcgcaatcttcactagcacatcgtatgagagcttcgagaagtcatcactgggagaggactgtggagtgtgtgcagatcatttgaaatgtgcgacagagaattgggaagttgttagaagggaaagaaaatccttgtggtggcatcgatcgattctagacaatgaggatcaaaagggttaa

SEQ ID NO: 51015 - DNA, 568 bp, Glycine max
  Peptide Sequence Number=SeqID_142700
tgttagagtactgcctctgaacattagcctacgtgttcttgaatttgaagatgaagcttacaaccttaaggttatttctctgatatcgtcgtgtgccgtcagtgagatcgtggccgtgccaccccgccgaagtcagccgcacaatctcaaaggtggttcttgtgtcgcgcacacgccggcatgccctgccccgccggtgaaggtttttatgattttgagagttgtcaaccttgatgtagttggagataggcattatttcccctacactgttgatggcatacctttgcttgccattgatataaggaccagagtttgcgagcatgatggttcaactcagtttgatcaatccatagtggggatgcagaaacaaaatttggatgtgaatgctataacatttaccggtgttgtttctgcaagcactcatgttggcccaattgacaaagttcaatactacttcaatgtaatgatcaatgatcatcaaattaagccaacgaagaagcactactgcaatatagagcttggaaaacttggtgctgaaaaaattatttcacttgagccacaaaactga

SEQ ID NO: 51016 - DNA, 582 bp, Glycine max
  Peptide Sequence Number=SeqID_142701
atggtatctcgaagactaggaaacatagatttttacatcaataataacaaattaggtaaacggagtctcgatcgcagccacaaaccaagccgcacaacggattccgacagagacgctaccgttggagtccttgacgaaaatgatggtgttgctagcgacgagcttcttgtggttgacaaacttgctccagccggtgctgaagaggtggcgacacggtgtgccgtgatagatgtggcggaagtgccactcgacgccgcggatgtcggcgacagagaggagctggacaggcggattggcacggaagtccagcgaagggaagcacgagtcggtgcagaagtgcagcacggagaagccgtcgtcgttgttggcatcggagggagtgaggatcttcgcgaacgaaacgacaccgttgttcacgcagtcctcatcgtcatcgtcatttcgaacctccttgtgaggaggaacttggcgaagacatcatcggagaaaggatcgacaggggacgaaggggagagagcagatgagaaggctgaggtaatgcgagggagaggtacgcttcatgtgaccctggggaaaaagtag

SEQ ID NO: 51017 - DNA, 1266 bp, Glycine max
  Peptide Sequence Number=SeqID_142702
atgagtcatcattcatctagtgttaatggaaagggtactattcataaagatcctttatctagaatcttagatgagttgagttccctcaagttatggaaagaaaaacaagagagaaaagaaaaaggaaaaaaaagagtggaagaaataagtcaagatgaaagaaagaaaataagagaggaagaaagaagaaaaataatgaaagaaatgaaaagagaaaaacatgcctcctatagtagtcataactcttgcaaaagcctaagtgaagaacttcgtgactattacgaaggaagacataggtcacatcttagacctcactcccatagaagagaaaaggaaagaaagcctcaagaggctaacattaaactctcatacttccatggtaaggacaatgtagaggctaacttagattgggaaataagggtagaacaacaacttaaaaagaagtctacttcaaaatcttatggctctcactcttatccaaagaaagaccaaggtcaaggcatcttaggggtgacaccttctaagcccgaagatgataaggggaagacaataaaaaagcaagcccttaaggctagtatgcaagagaaaactagctttataaaccaagatgaggctactacttcaccttcctctagtgaaagtgaaaaagcaaaaggggaagaatctagtgaagaaatctacccccaagaagaaggacaaccattagtggttaaagataagtgtaaggaggtaagtgtctcctccaagagtttagctaagaaggaaactcattttacaataaagacaaacattaaagaaactttccctcttagacaacctccacattttctcttttgtaaaaaggcacttgctagcattgccacacctcttgggcttgagtttattcctcaagtaaagaagttgttggatgagggtttggttcgcaagagcttaaacccttgtgctttgttggtgcccaaaataggtattattacgcaccaagtccctaaaataggtggtatgatgaaagttttgagtggtgcaaccctcttttgtaaaatcactcgtacacctaacatctccatggtgtgtgtacatagggacccattaggtagtgatcaaggggttcccatgaaccctaagagaataaaggtcattcctgagtggcccactccaccaagtgttgagggaaggagcccagagtatgaagaaccttgggatttgaggtcaaatcctttccaaggtggagggaatgatgcaatcctatcccgcaagggcattaggtag

SEQ ID NO: 51018 - DNA, 378 bp, Glycine max
  Peptide Sequence Number=SeqID_142703
atggagttcatacagagtcacgtggagccatggatgaaggaccagcgggcgcagctgccggggttgaaggagaaggtgtcggatgaagtggccgtgggtgtcgcatcgcgagcacaagaagcggatccaagaagagtaccagtgcctctggaacctctgtcgcgccctcaaggtggaatccgtctccgatttacaggaccttctctgctttatggtgctctccaagtgcctgtcatgtgggaagatgatgctggctcaatagacataaatggaacacttttcttcctccaacaagcccattggcattggcctgccgaacataccatcaattgccgaaggttaatttcccctaagttaatccgtactttgagttcatag

SEQ ID NO: 51019 - DNA, 219 bp, Glycine max
  Peptide Sequence Number=SeqID_142704
atggtggttttgacaacatgcgaatcttgcttctttgtcatgaaatcagcaacggtcaaggcgaaaccagaggagttagcaaaatatgttgtttcggtgcagcggaagaatggagagaagaatggcattgcggaaaaagcgaccgaggagaaaaagaaagaagcgaagcagcgagagtgtttatcaaatgaatcgaagtcattttatcttaatagatga

SEQ ID NO: 51020 - DNA, 1047 bp, Glycine max
  Peptide Sequence Number=SeqID_142705
atggttgttaatgaaccaacatacaacaactttaataatagaggtgatatcggtggtgacaatagtgatagtagcagtgatggtggtggtagcggttacaactacattggtggaggttgtgatgacgatgacattgacagtggtgctagcaattccgataacgattgtgatgtcagtaacaatagtggtgacaataacgatggtagtggtgttggtggtcgtggtgatgcagcttttcagaggcatagcttttttagggcatatagccagtggtactggcgagatgacatggaaatagccagtgctactggcgagatcactgatatagccagtggcactagcgagatcatcagggtatatgaggagaatgatgatgtaatatttgaaggcagtaaaaaagcgattcagattaaactttctggaaaatatgttgctttgcaaatttgtgatgacgaagatgttgaaaccatgcttgaaagttttcaacaacaaaatcaaatgtcagttttggaattgtacatagaaaaggatgtggctggtggttctatgtttcattctgcaaattctcttacatcatgtggaaataatttatctaataatgaggcgcaaccgccaagaaatgtgagcaacttacatggtgatgaagatgatgatgatgatgatgatgattatcttgtatctaactcatacgttgaagagtctttagacgaagatgatagtgttgacggtatatctgatacagacgatgaagtcaccgacatgattcaaccagtaagaattgttcacccaacagaatgtgtacaaggaattcaaaatccattttggaatgatgctttgcattataacaatatcaactggagtcatcctgatgaggaagacatttgtggtttggagatgccatcgagttttaatgttggacaagaattatatgttggcatggattttgatactaaagatgcgattaacagtgaatttgcctacaaggtgtcgtacaaaaaagcttggttggcgaagcaaaaagccactgcacttgaatatggcgattag

SEQ ID NO: 51021 - DNA, 393 bp, Glycine max
  Peptide Sequence Number=SeqID_142706
atggccatttcttctgttgagaggcatttgaaagataccctcagggtggacgacgaggaaggtctagagggcggtggcgatggtggcggcgtgaacggggagaacaatggagaaggcacaaaacgggactacaattcttggagcattgttggccataaagtgaggaacccaatccaggacatgcacaggtacttgcacaggtatgatggtggggtgggtgttgttggagatttgggggaagtcaaagtggtgagttttttggccttgggtgaggcgattaacggcctccttaaggcagttggtgatggtttggtgagtgttgtggtttggcatggcaaaggcatgtcggaccaattattagaccttagaactgaagcaagaagaagaaaataa

SEQ ID NO: 51022 - DNA, 540 bp, Glycine max
  Peptide Sequence Number=SeqID_142707
atgtttggtgtagtggcctcgggccacgatgtggtcaaagagctcctcgccctcgcagagctccatgacgagatgcacgacattgttgtcctcgtaggtatccttcaaagtcatgatgttcagatgctgtggcaagtgatgcatgatcttcacctccctcctgatgtcgtcaatgtctatcgccgttcgaagcttcttcttcgagatcgacttgcatgccagctcctcccccgtctccttgtccgtacagaggtaggttatcctaaactagccgcgccccagctcgtagtgggcctcgatctcgcggtccgttggggacttcaaaacgatgagcttcgacccattcacggcgacgttaaaaccgtaatcgatcgcaaggggttttccttgttcgggggctacgagaaatctttgggaggggataagactgtgaatgaagcagtgtctcaaacatttgttggttgcatgggagaaactaaagagatatcggcattagttgattttctttgccttccggctgcatcatacatcactggatag

SEQ ID NO: 51023 - DNA, 159 bp, Glycine max
  Peptide Sequence Number=SeqID_142708
caatcagcgtccaagatcttgcaggaaacctgctgttacattaggaagctgcaggaagaggtggaacagctcagtgagagactatcagagctcatggattctgtggatatcagtgacattgacagaagaactttacaaaaccttttgcaacaatattaa

SEQ ID NO: 51024 - DNA, 576 bp, Glycine max
  Peptide Sequence Number=SeqID_142709
atggcaacatgggttagcactaaaaacccgtcgggagtatgtgagtcgaagaaaaagaaggaggatactgtgtgtgtggagtgcaagaacagagagaagaagaagcgaaaggtggagcacgtaatgacgatggaccgttgcaagaagatgcaatgctgggcgatgttgaagcgtttgatggtaggaagagatgcgtgggctttacagaaggatgttcttcatccaaagattttgtacgttcttgataagtctgaagccatgaaaaaaccaaagggtttggaggatattgagtcaaagttgaagaattcggattactcagaagcttatgagtttgtggatgatgtgaggctggtgttgtcttatgcattgcaataccctccaaggagtgaggttcatagaactgcaacaaggatccccgagggttttgaggtcaattggaaaactatgaaggagaagtggatgcgtgaggaagaagagacaaacaagatttgcaagagggaattacatgtgtgtccaaatgaaagaagtcaagtgtgtaatcatctcacaaaaaggagcaatatttttatgtgctga

SEQ ID NO: 51025 - DNA, 342 bp, Glycine max
  Peptide Sequence Number=SeqID_142710
atggagatgtatgacgcctccatatttatcaatacaacaagtagaactgcagttggagatttagctcctatcaacatggaaattgaagccacttgcaggcataacaacgctgcaagaaaaagaagggaacaagaagcacaaagaagaagtcaaacctcacctcctccctctccacaaagctacattcaaatggaagaggaacatgcacgacaaatgacgctagaggactactctagtacagcaactccacaattcttcacaagcattgcaaggtcggaggttcaagcggccaacatttcttatcctcattctctcataactcttccacggtctaccaaatga

SEQ ID NO: 51026 - DNA, 216 bp, Glycine max
  Peptide Sequence Number=SeqID_142711
atggcggacacgtataaaaaagcaagagtcatgaatcaagaaacaagaaaaacatttgttaagaaatacactgagcttaagagaaaagtcaaagcatcttcaacatgcaaggaatcttcatccagacctgcgtctaaaagctcatccaaagttatcaacattgatgcaccttcggatggtgagtcaaatgatgaaggctcagatgaagatgattag

SEQ ID NO: 51027 - DNA, 108 bp, Glycine max
  Peptide Sequence Number=SeqID_142712
atggctatttataagaaaagccattttggggcaggggaagcttgcccagacgccagaggaaatagaggaagtggaaccggaaaaaagcaaaaggacattgacatttga

SEQ ID NO: 51028 - DNA, 111 bp, Glycine max
  Peptide Sequence Number=SeqID_142713
atgagtgaaatagaggagatgcaagagcagacgaaggtcaacatagatgccatgaaagagcaaatgaccataatgatggaagccatgatgagtatgagaaaaatgatggag

SEQ ID NO: 51029 - DNA, 156 bp, Glycine max
  Peptide Sequence Number=SeqID_142714
atgcatcatttcatgaacttagttgcttgggctgcacaaatgaacatgcgtcatctcaatcatcttgctaaaaaggacttagtgattgctattcccaaactcaagtttgagaaaaataaattgtgtgaagcatgtcaaaaagaaaaccaagtttaa

SEQ ID NO: 51030 - DNA, 873 bp, Glycine max
  Peptide Sequence Number=SeqID_142715
atggtgagcaatcctcaagagcacaaaagaaagcaaaaacttccaagagaaattaaggctatcaaaaatgtgacggtccccaagtatttggacttggaatggttctctcaacaagggttcacctttcctaatatgctggaagcacaaggattatcacagttgatgcagatgaaaagacctttttatccagagctagtcaaggttttctacaccagcgcacgtgctaaccttgaaggtatactcttctctattgtaaatggagtagatatggtcattgatgttgtttcatggaaggaagtagcttgtatgtacatgggtggagtttgcaagttcgatgaaatgcctgatgggtacaacaagatgcagacatataggagaatgcttcttgacccaactaggaacatgaggaatcgcttaggagttggtggactgaatgcagaagatagtatgttggtttaccttattacctacattctcactccaaggtcaagcaatcatgctcagttcaatgtagatgtctctaatgagattgtggactttaccaaagcgtctagtgagattatcgaaagacatctcaagaagcttggaatgaggtttgttgatcatgaatggataatgattgaagagctaacaactggaaactttgaccagatggaagaaaatgttgaagttgaagctccacaagagcctgcacatcaatggagtccttttgagtcacttatgattcagaagatgggcgttatgcttcacctccatcaagagaactcaacaaaatttcatagttcattggagaatataattgcttggctggaaaacattgagactaggctaacccttggcaacctccttaaccctgatgaggatgaagcttag

SEQ ID NO: 51031 - DNA, 294 bp, Glycine max
  Peptide Sequence Number=SeqID_142716
atggaccaattaaagcacctaagcatcccctcaggaatgcttagattctctaaccacgctagttacccacgtctgggccatccgacaagaaaaatcagcatgcaacagggacaggtagatatcctcatagttaggttccctgaccctaactatggtgttaaaatgaccaaatttcgagaagatccaacggttaacgaaggctgggcagcgtttttaccgaggcagcttcatgtagctttctctagaagcttcattaagaggcttcctccagaagcttcatcgtggcttctttga

SEQ ID NO: 51032 - DNA, 705 bp, Glycine max
  Peptide Sequence Number=SeqID_142717
atggactgtttaaaaaaatcagtccgttaccctcgcggaccgtgggccccaggggccagtccatggactcgagcccgtttacccactcctaatgtttttaaagttaccttatacaagagactacttggcatgatatcaaggtatgctttaaatcagattgctgctgagtttgagcatatacattatgctggcaaaaacccttctcgttgtggatgtgtcatgagaaatgctcacggtctttcatgttcatgtgagctatctagatatgttgttggtatcataccacttgagacaatccatatgttttggtggaggctaagtttttcaggccaagggttatctgagcccgaggaaattgcctaccctgatctaaactctatgtgtcctcctccagaaaagtcaaacgtagtgcatcatcatcagaccaagcaattccaagaaggactatgccgatatatattggatcaatttcatctatgctttcatgattccattgaaaacattgtcaacgtcaaagctgacggtaattatggatatcgtgcaattactgcgctattaggtataggtgaagattcatggtatttggtgcgcaaccatttgcttaaagaactttccaaatggtcttatgagtatatcaacatccttggtggcatagacaaatttgaggaattaaagcgcttcctatttgttgatggattatccatg

SEQ ID NO: 51033 - DNA, 120 bp, Glycine max
  Peptide Sequence Number=SeqID_142718
atgaatctgaaaagtgaaggtggagaagagagagagttttttagaggctgcaaaatagaggagttgcaggaaattcagaaagttcttaaaggaggtagtgagctaggttctacaacttag

SEQ ID NO: 51034 - DNA, 399 bp, Glycine max
  Peptide Sequence Number=SeqID_142719
atggtagcctggcccgggaccaaatcttctcttcataaggaagacgaaggccccacaacccaggtacctcagcatatggagaatgagtcatctgaggccactatccctgagccatttgatataggagaagaggcagaagagacacaggtgggacaggtagctgctaccactcctgagcgatccctagaggctacttcagagccttctgcaccagtggtaaatctaccctcacctcaacctacagcagaaccctccactcctcttctacaaatgctagaggacccaactacaccagtcctagctgtggacacttctcctcccgctactccagtgcttcagttgatagatgaggaggatggtcagacacaggacatacaggaccagtcacaggaattttaa

SEQ ID NO: 51035 - DNA, 300 bp, Glycine max
  Peptide Sequence Number=SeqID_142720
atgtgtgcgccatactcaattcagtatacaagcttacatagccctaatcttaaactaattctagcaaaacataaaaaccctaaaaatctaaagctacagtcaaagtcttctaccctagagttaagacatgaaaaagagaaaaagaatcaaggaacttacttggatgaaactcagcttaacgcgagggtatgtccgcttagcgagacctgcagattagaaaagctgcaactctcgctaagcctggccctgaccagcttagctaaaatgatgcatcttaagtacagagaagcatgtgcttag

SEQ ID NO: 51036 - DNA, 396 bp, Glycine max
  Peptide Sequence Number=SeqID_142721
atggaatggagaaggaagagagagaggagacgccacttcaaggagaagatgagtctagaagaagctcaccaccataggaggtcatggataagagcttggaggaagaaggagatgaatgaagggagagggagagaagagcacgaaattttatgctctaaaagagctttgaaatctgaaggtggcgaaggagacacccaagttggaagttctagagtcccacatggtggaacccaacccattaataaggacgaggttgtcgatagggaggaactggagggatacaatggagtcgatgacaacactgtttctgatggactagatggcaattcgtggtggctggggttcatggtggtggcgctacttggtggaagggttcctctttccactcagatatag

SEQ ID NO: 51037 - DNA, 615 bp, Glycine max
  Peptide Sequence Number=SeqID_142722
atgtatgttgcatcagaaaatggaaggaaaatctatcttgtagtgggttgggaaaatgaaggaaagtacaagcaatacaaggataagttagtccacaagagcactgggaccagaaaatatcaagataagaaaaatgtcaccatcattaagactccatacaatgaacgacaaagatatcagcacaaacaaaaggctcgaagaatagaggtgattgtcattgatagagatcttgctctaatgaatgcattggaggttgttttcccttattcaactaacttgttatgtgaattcgacatttctaagaatgtcaaagcaaaatgcaagatcctcgtgactaaggcagaaggctgggagattgtgatggatgcttgccatatcaatggctcaatacccctgtcgtcccttcatatgcgttggaagatgatatccattagtggtacgaatggcacatgtgattcttggggggacttaactctcacaaatgaggagcaagttgaggaaatgaacacgatgattggtggtttagaaacttcaagtgtggcccgcaaagatgttagtgacaaaaaaatcccttatatggatgaattttcgatttgttgcaacagttcatcgtaa

SEQ ID NO: 51038 - DNA, 927 bp, Glycine max
  Peptide Sequence Number=SeqID_142723
atgcagataatgggttttccaagcggaccctatgacacatcaattctcagagatttcaaaaatcacattgctttgagagtctggaatggagaggaacgtcctgagctgaagctatcttcccatggaaggaagatggctaagttcgggaggcctactccagagattgaaggccttgtggtggccagtggactaagtcctttgatcgcctgttccctagatacgggcaattggggactaatgtttgcttttgtggaacgctggcataaggaaactagcaatttatatttgcccgtcggagaggtgactatcaccttggatgacgtcgcgttgttgctacatctgcctactgtagggcattccatagcttcgagttacttcatgtcgaagacgctgtcaatatgttggtggaattactcgaggtcagcgctacagaggcgagagttgagacgattctgtgtcatggctcttacgttcaactatcgtgagtgggggttacgcttggggcactactgcacttgtgcacattgttggatctacgagcatttttcatccgttggttctgatgttcctgccgaggattatgatgaaaggagaccgtgtgcatgtcgatggacctctggcaaggcactgcccgtttccacgtatcgcaggcgtttggatagattgacccctgacgtgagtattctgccacatcctgttgtgtcttcactctctgttgaagaaagtgatgatagatggatgcaattcggtgagcatattgcacctgtaggccaattatgtgcagtgtctggccactgttcgccagattacatggattggttttacatgatctcgcacccattcatgagtttgacacagctaggggatcctcctagagttccatcggttcagcaatatgaggaatttgttgaagcaaatgtgtattag

SEQ ID NO: 51039 - DNA, 306 bp, Glycine max
  Peptide Sequence Number=SeqID_142724
atggactggggaaagagcatggagagaagagagagccaagagtggggtcagagagataaagggggagagtatcattttttttgtagtcaagagtgggatgccgaggatgcaagatttgatgatgtcatcgctgaggatcgaactaatcagtcggagttagatgcccttgagaacaagaaggatgattttattggcgacttcagcaaggaggtgagcttagctattagagagcttctcaaggaagttttctcaaagaagcttctcaaggaagttttctcaagaaagcttctcaaggaagctacctag

SEQ ID NO: 51040 - DNA, 291 bp, Glycine max
  Peptide Sequence Number=SeqID_142725
atggaaggcggcacggtttgcagagctgtggtactaaacaagcttaatagacggtgtcgggtactcgcaaaatcaatagctggtggcagcgacgacgatggtggtggctgcattgaagaaggaaaccatgggatccgggtaccacacaaggctagcaagcggatccaggagaaggtgggtgctgaaacggaagggatggctcctgcaaagggtgatgtgttatggcatggccggagtaggagtagaggcagccacgccagccatgggccaaacaaatcaataattagatag

SEQ ID NO: 51041 - DNA, 1092 bp, Glycine max
  Peptide Sequence Number=SeqID_142726
atggtttatacttctatcccatcatatattgatccagccaactggcagcaacagcaaccaaatcaccagcagcaaggcaacaacactgctgccagctcccaccttattctgccaccaccaatacaaccgccgccgcctccgccatcgcaacctcatggactcagcggtagcactaccgccgggtccatcaggcccggttcgatggcagatagagcgaggatggccaacatacaggaagctccacaaaagtgtccaagatgtgaatccaccaacacgaagttttgctacttcaacaactacagcctctctcagccccgtcacttctgcaaggcctgcagaaggtactggacacgtggcgggaccttgaggaatgtccccgtaggcggcggctgccggaggaacaagaggagcagaggaagctccagcagcaacaccaggtcgccggcaaactccgatcgccaaaccgcgagtgccggctccgcttcaaccaccagtggctcctcttctgctgacttggtggccagcctcggtggcggcaccggggtgccaccgtctcttaggttcatggctccattgcatcaacttggggaccaccaccaccttggtggtggtggaggagaaatagggttaagctatggcttgaactatggcgcaatttctggtccaatgggaggaataggagacttgaatttccatataggaggcactttgagtgggggtggttctatgttatctggtttggaccaatggagggttccacaaactcaccaatttcccttcttgtctggtttggaagctacttcatcacatgggttgtacccttttgaaggtgctagtggcagtgatggctatggtggcactcccattaaggtttcaacttctggcattatttctcagcttgcttctgtgaaaatggaagacaatcgtcatcatcatcatcaggaacttggtttgcctagacagttcttgggggtcaataataaccctaacacaaatgagcaatattggagtggtggtggtggtgccacttctacttggactgatctttctgctttcagttcttcttccactactagtaataacgcactatag

SEQ ID NO: 51042 - DNA, 2018 bp, Glycine max
  Peptide Sequence Number=SeqID_142727
atggcggaaccggaagcggagtcttttcggatgctccggaacctgacccgaatcgtgatccaaatctccaccctctcctccgccgcatcctttgtgcccatcctcaagccccaatgctgcgacctcgctcgccgaataaggttcctcgctgccctcttccaggaactgcacgacgacatcgtttcgagccgcgcggttcacttcctcgcgctcgaagacgcgctcttcaaggccatggaactgctccgattcgccacacgcgccagccaggtcttcacgatactggatagagagcaagttatgttcggattcactgatgttgctgttcggtttgaacatgcattaagcatgatctcctttggcgagcttgatgtttctgaagaaattaaggagcaggttgcacttgtgatcactcagtttagaagagccaaagcgcagtttgatccgcctggttttcagctttacgagcatctgttgtttgtttacaaccagagctatgatgtgaatactgaaactgctgaactacgtgtaatctgtgaaaagctacaatttctcaatgtggatgacatcaagcaagagtcacttgctctgcaaaagatggttgtagacaagggtggctattctcagaaaaacatacatgatatgtcattagtagtgctgaaaaaaattcaagatttcttggtgatggaatctggaaacaatattgtgtcaccaagtgaggatttctctcatcatactgatgagccatatctaaaactatgcccacaatcactggttatacctgatgagtttcgctgcccaatatctctagagctaatgaaagatcctgttatcatttgcacagggcaggatccaatggctgagaagagtgtgacttttggggtggtgatggtgacatatgatcgatcttgcataaagaaatggcttgaagcagggcatagaacatgtcccatgactcaacagattctttccacctccatcctcatacccaaccatgctttatatggcctgatatcaagttggtgtgaggcaaatggagtggaaccgcctaaaaggtcaggaaatttatggctctgtaagacaacatcagatggctcttctgaattcatagatcttgatatcttagtgagcaaactttcttccaatgatatcgaggaacttcgatgtgcagtagaaataggtatatggaaggatgaaggggcgagccctggtgcagcggtaaagttgtgccttggtgacttgttggtcatgggttcgaatccggaaacagcctctttgcatatgcaaggttccaagtatgatggcacctacaactggtggcctggtgaactccattgtgggtttaatgcagagacagcgggtgctataccccaccttgttgatctcctctatgcacctgatgctggcacccaagagcatgtagttactgctctcctgaacttgtctatcaatgtggataataaagagcgcatcatggcttcagaggctgtgccaggcatccttcatgtgctagaaaatggtagtatggaagctcaggaaaatgcagcagccacctttttcagcctctctggggtggatgagaacagagtggcaattggtgcgtctggagcaatcccagcattagttactctattttgtgagggaagtcaaagagggaaggtggatgccgcaaaagcactattcaatctgtgtttatcccaagggaacaaaggacgagcaattagggctggtattgtccctaagttgatagaaatgctaacagaacctgatggggatatgagggatgaggcaatgacaataatggctgtagtggctaaccattctgatggacaagcagcaattggatctatgaatgttgtatccactttggtggaattagtcagtaacagatctcctgggaacaaagagaatgcaacttcagaaatggttcagaagggccaagcggaaagcttcccagcttctagagttgataggaaaccattgagactatacttggaaaactgccagctagattttag

SEQ ID NO: 51043 - DNA, 432 bp, Glycine max
  Peptide Sequence Number=SeqID_142728
atgtcacacgactatcatgctaaaaataggttgttggatgaagtagttggtgacttcaatgaccacaaagatgaaattttgatggacaatgacgacaacaacatcaatgacaacgacgataatgacatacaatttcttttccaaccgacaacaactgaaaatgtctatcgtccatatccaaattgcactgatgttggtgacaaccaagtggtcgagaaccctaactataggcattttttggaccaacaacaacaatctgattcgcaggatgagaatgatttcaagattgagtcaagaacaattcaagaatcaagagaaagattcaagagaaagtttcatcaagaagattcaagattcaagaataatcaagatcaagattcaagacttaaagattcaagaatcaagagaagacttaatcaagataagtattaa

SEQ ID NO: 51044 - DNA, 564 bp, Glycine max
  Peptide Sequence Number=SeqID_142729
atggcttccggggcttccgggacacctgattgcttctggaggaagcaacccagctcgcctgggcgagctgggcgacaacctcctcccttttttcctataaaaaggcaaaaggggactgttctaagggtccctgattccccttggctatgcatttcagctattttgggtgaaaaaatgatttccgtgaagaaaatccaagccgaggttttcctccgttcttcaccgttcttcatccgttcttcatccgttcttcgttattcaacgggtgctaaagttgatgtctcgctaagcgagctcaatgcgcttagcgtgtgtcatctgctaagcgaggcatcaacgcgcttagcggataggaggaatctggaagggaatttgtcacgcaggcacgtgctcagcgcgtcatcagctcactcagcgagtcatttgtcaccttccaggcttagcgcgagtttggcgctgagcgaaaattcacttactcgcgctaagcgcgacgtcaagatttgtgagtttttgagtgattgtgagattcctagaggtggaggagacatccccacttctttgtaa

SEQ ID NO: 51045 - DNA, 396 bp, Glycine max
  Peptide Sequence Number=SeqID_142730
atgggtgcaagggataaatcaatcatgcacaagggaaataagaatcctgatcttgtcaatgatcctgcgcatgctcattcaggtccaatgctggtgcagatgatggatcctgagaaagaggcaggattaggaagaactagagttgctggagctggagggaaaggagaggtagaaggagttgatgtagaaggagctaaggtaaggggagttgaagtagatggtgcctcagatcctctagccctagatttgcgggttccccaaaaagtgactgaagggtcatccagggattcaaaggtcagagaatcagatgtgactcctcgggccttgcataaagcaataataagggctggaatatctagcctcgaggagtcatgctgtgcgatcagagaaatctga

SEQ ID NO: 51046 - DNA, 210 bp, Glycine max
  Peptide Sequence Number=SeqID_142731
atgagtgacatagagcaagtacaagagcaaatgaaggtcgatatggaggccatgaaggagtggatgacaacgatcatggaagcaatggtgagcatgaggaaaatgatggaggtcaacgcagctacaactgttgctttagtactgctactgagagggactcgattcactcgttcaggttcaatcaagatagtcatccagtctcagatgtag

SEQ ID NO: 51047 - DNA, 444 bp, Glycine max
  Peptide Sequence Number=SeqID_142732
atgaaggatagggtgtgggaagagaattggagtgttaggggatccttagcttcaagggagaatccattcattgctctaaccccctcgaatggtcatgttgaggaattggtggtaagtgatctcattaatagagaaggagtatttggtgggctaggaatgggaagctttgggaagatattgagaattctaagacgggctgccggacatccccgtcttagaacttacgacagactacgacggctatggggacaacaccgtcgtagacctaatcgtgttctacgacggttgtctgctacggaccgtcgtagaatcgtcaacaattcaaagacggctacccgacagccccgtcgtagaactaaggaaggactacgacggccttggggacagcaccgtcgtagacataatcggggttctacgacggttgtctctaaaagaccgtcgtag

SEQ ID NO: 51048 - DNA, 510 bp, Glycine max
  Peptide Sequence Number=SeqID_142733
atgaatcaacatattgcagcgattccaagctcggaacgacggatcgaaggcatcaaccggcatcggaattgttccgtcaagaaattcgaacttgagtttggctccgagagcgcgtcgcagagacctcgcccaagaatggtagttggaaccatcgaggagtggtgtgaccttgacggaggagggaccgtcgctaggatgaacaaagaacggactagtaggatcagtagagggatccgccggtggcggtggtgctatacgcggtggcatagtggcggaagcaaaaggaatggatcgttagaaaattcaagccaccaacgggaagtcactaaccaaatccagctccactgcttgccaaataaggatactaaaaactctcaccataccatgtctatgtctataggaacttggactaaccataaagcctatccagcttttgtcaaggacccatttgatggatctttcggaaaagccaatttaaatttcaaaatttttgagttgtgcttccaataa

SEQ ID NO: 51049 - DNA, 867 bp, Glycine max
  Peptide Sequence Number=SeqID_142734
atggaggctaacagagaggctgagaatgatataattttgggagagaagaatgggagacatgatattggtggagtcaaaacatatagtggcgggaaggatgttattatgaaggcgagaaaagtgtacatggaactgctatggtttgggtcactagagggaagctccaactttgaaagacttggagcgaataagattgatgatgccaggatgaagttagggtttgatggtgcttttgcagtggatacagatggttgtggggacacaaatgagaaatggaggatgaaagcgtattatggtttccctgtgcgatcaagaaggaagaaggcttggaatcttctaagaagtttagcctctgatgcatccctaccatggagtgtcaatggggccattgatttggaagaaaggttggatcgtgctcttgtcacgcatgactggcgtgcattgtctggcttgaaagagttcaagtttgataaatggtggttgaaaggatcttgtgtggagttgatggaaagaattgggcagtgtagaaatacactgaatgtaggagagaactggagattagccgttgggaggataatgagaatagccattctcgttataaggaggtcaaagaactctgttgagaaattattccaagctactccaattagtatggagctagtactggatacgatattgaggtgtgtcaacgaggaagggattatcggggttgattcggtgtgtagaaggacaagggaaattcaaggagtgaaggaaagtgtgacaatcgagaatatccttaattcttataggcttgcatcgggccaactcataaactatcagaagtcagacattgagttcagtaggactaagaagacgaggtgttaa

SEQ ID NO: 51050 - DNA, 882 bp, Glycine max
  Peptide Sequence Number=SeqID_142735
atgaagtgtgttccctctaccgtgtttcatttgctcttgttcatcttccccctagtactctctgttcacttgatttcagctttatctccaactgggtcagccaaacattccataaagtttatcctagggggtcagaatttgggtccatggaagaatggcgtcacacaagtagctcaagcagcacgtcctagaactaagggtactcttgtgctagcagcaaacaggaccaataggcctgacattctacacggatttcgacgttatcaaggtggttgggacattgcaaatcgtcattactgggccgataaattccatggtgaggcagtggataccctccattatgtagtcaatcagtcagactacacagtgcagactctaagaaatgtcacagagtatctcgcgcttgccaaaactatcgctgtggcagagatgtttcttccatctaatatcatggatgatattgataaattgaatgcgtctagctttgattatgatgtcagcaatgatgcttctactggctctaattgggttaatgcaatttgtgacacatgcatggccatgggagaatgggtggagaatccgcatgctgaatctgctcttagcaatatacttccatgtgttgatcagagaaccacaaacaagacactttttcagagtaaacaagttgttaccaacattgttagtattgtcaaccgtttcatctatgacactgcagatgcaagtccagcacaaggaagtatgaattattacaatcaatctggacctgcaatgccacctttgtgctatccctttgactctcagtttcgagaacgccagtgtacgcctcaagaagtttcctcggccaatgcttcattggtatactttttctatgttcacttttga

SEQ ID NO: 51051 - DNA, 684 bp, Glycine max
  Peptide Sequence Number=SeqID_142736
atgagaattcaagggactaaccgcctaagaattctttgtcctaacacattggagggtacatcctttgtggcacaagtagagggtacatctacttgggttgttatactgagaacaagagagggtacatctcttgtggatcagttcaagtggtggatacatccacttggttattcaaagagaacaagggagggtacatcccttgtggatctttggcttgtaaaggattttacaaggttgaaagaaatctcaagaaccattggttgcttgggaactgaatgtaggcacgggttgttgccgaaccagtataggtcaaatctaaaatcatttcaagatcatgatgaagatcaagccaacttatgtctcatgaaaaaatctcatgagaacaacaaggaaggatctgtaaggaagaagtggtacattgacagtggatgttccaagcatatgacgggagatgtatccaaatttacaaccatttcccccaagaaaagtggacatgttacatacggtgacaacaacaaaggcaaaatcattggagtcggcaaaatagacttggactttaacaacactgcaacaatagggatgttgatggattggcaagtgcaccaattcctcaagagtagtaaagttaaaatggaggtccgagtgtcgaatccacaagaactttgtttgtacttaggtagatga

SEQ ID NO: 51052 - DNA, 117 bp, Glycine max
  Peptide Sequence Number=SeqID_142737
atggaggaggagcttgccgcccagctcgcccagaagggaatgaaaggtaaacagaattgggcacatgagtttgtgccaaattattgccaatatggcaatatcagagccacaatttaa

SEQ ID NO: 51053 - DNA, 771 bp, Glycine max
  Peptide Sequence Number=SeqID_142738
atgccttacaacacttctcatattcagttggatgctcgggtggttccaagggaatccactacacatacccaaactgcctcaaaagcctctctgatagatacaatgagatgcaacatcaatcatatgcaattgatccaacaactccctggtcgcaacaaccttgttggtatccatcaacgacaaccacttagccacaagcagttgcttgtggtggaaggaggaggtctcattatgtcatctcttgataaaggcattgattatgcctttatttgtagacgtgtaccatgcattatacaagctcttaagcgtgaacctatccacgtaccccttaattgtcagttaggtagggtggtatttgtggctatgcctctgactcagcccgtgcctctagctgtccctgaggctttgctattgtcaccgagccaactctgcatcatgattaatgatgaagaatttgaagaaggaagcgggaagagagacaaggagaacggagtttatcttagaggaaggggaggagggagttgggcttggctcaagggaagggtaatagggtgttttgaaaggaagagagaaatgaaagggaaagggaaagggagagagaagaaagatgttcggagggaagaaggagagagatgtttggagggaagggtaaaaggtggtgagaagaatggaagaaggaaggggaaagggtggagggtgacacatacatcattgcccggcattgttggtgatatgaccaggctagggacaaatttacatggtggggtttag

SEQ ID NO: 51054 - DNA, 315 bp, Glycine max
  Peptide Sequence Number=SeqID_142739
atgcagagccttcaaggcttgggcttgccatctttcatgagcatgcaggagtttgatgcgcaggagcctgctcctgaggagccaacaacagcagcagagggggaggatgagctcacccctcttgagcctttttattttgatgcagatgcacacatggctcaggaggagggtacttccagatttcagatacctgagccatctcctacacctgctcctgaggagacccagccatctacaccagtcacggagccagagcagcctatccaggattcatcagcagctccaacactggatcttaatgaagatcagccatag

SEQ ID NO: 51055 - DNA, 360 bp, Glycine max
  Peptide Sequence Number=SeqID_142740
atgactgtgaggtttggttttatgaccccctttttgatttctgccatccttactagcttatttcgttgtgactctaatgtgcatgttcctatctttgaaaagttgcatgtttgtgaaaatcaattgattgaagcagttcatgatattcagttcatatggttgaatttctctgtgaaaaagaggctaagtcatgaagtgctaaaagtgacagttgagcttagtgtgacagaagaatctggcagagcatcaatatcaaggttgcgcgctaagcgtgagatcagtgcactaagcgcagcagttgtcttcagccagactcagcgcacgactagcgctaagctcaaatccacttacgcgtgctaa

SEQ ID NO: 51056 - DNA, 531 bp, Glycine max
  Peptide Sequence Number=SeqID_142741
atgatgatggaagcaatgatgagcatgaggaagatgatggaagataacactgctacagttgttgctgtgagtactgctactgagatggacccgattcacccagccagtttcaatcaagtgaatcgtccaatctcatatgtagtaggtcaaggaggtgaggtagaaaaaaatgcatgtgggccttgtcatgttcaagttcagagcaagaattcattcccaccatatgggtttcctcctaattatacaccgcccactattgtatacgcttttggggaaacacatgaagttccccaataccacactttggtcgtgttcggggtttatccaggatataccactgaaggagaggcattttctggcatccctgtgctgagcgctctcagaatatctcaatgtcgcctgttatcacaacccttgcattttgtaaggggagaggagtcttccacactacttgagaaggaaaggattgagcatatggaggagaggctacgcgccattgaaggaggagaaaattatgcctttgctgaatga

SEQ ID NO: 51057 - DNA, 186 bp, Glycine max
  Peptide Sequence Number=SeqID_142742
atgaacaataaggccaaacaacttgaacaggcactatcccaaaaagctataggatatgaagcatggaaacaaaaactagagcatgaaagaaaggagtacacaacaatagtgaaggaagaaaaacaaagagcacaaagaccacatatgccgaagcacaaagttacaatgaagacacgaaggcagtga

SEQ ID NO: 51058 - DNA, 186 bp, Glycine max
  Peptide Sequence Number=SeqID_142743
atggttgttgtggttgttttcattggtgacaagattgggatggatatggtcagatttagtagggcgaggcaggacaaggtgggggttgcacggtgcaacaagaagggagggggaagtgacaaggaaaggggaagagtgtggggatttgatgagtgggcaaaagagatatttcaaaaaacatggtag

SEQ ID NO: 51059 - DNA, 69 bp, Glycine max
  Peptide Sequence Number=SeqID_142744
atgagaagggtagggttcactgaaaagggtagaggctcaaatgcgaaagctacaacgagaagaaattag

SEQ ID NO: 51060 - DNA, 600 bp, Glycine max
  Peptide Sequence Number=SeqID_142745
atggcgtcaattatgtccttatctcttagttatgtttccctccctaaatctcaattctcaatctctggcatctttgccggaaccttgtgcaacattccactcaccggaatttctttggcagctgaatttgccgatatgccagcgcttagagggaaggattatggaaagacaaaaatgcgatacccagattacactgaaactgaatcaggactccaatataaggacttgcgaccggggaatggccccaaacccaagatgggtgagacagtagtggtagactgggatggctacaccagaggttattatggccgcatatttgaagcacagaataaaaccaagggtggttcctttgagggcgatgacaagaactttgtcaaattcaaaataggttataatgagatatggcatgctttttcggccaaaccacaaggtgtcctgtgccctttgactgtgggattaaaccctgcttgggcattgtcttcccttgtccacaagatgcttcatgtaataccagcttttgaagaggctgtttcgggcctggctcttggggcattagaaggtgtttcatctatattgctagaaatatttgatgcattctag

SEQ ID NO: 51061 - DNA, 639 bp, Glycine max
  Peptide Sequence Number=SeqID_142746
atgatttgcagatcatggctagaacacgaggatgcaactgatgttcccgagaggcgtaggcctactgcctcagcccgtaggcaacgggttcatcagatgattgcggatgcacgtgacatgactgacgatgtccctgatgtggctgcggaggcacctgagatgcgtgcggacgtagagtgtgctgatcgtgctgaggggtcagatgctgatgatgctgctgagggattccctggtgggccacgtgacccgtcagtgctgacatcatttgcggaccacgttgcacatgctgtttggagtggacaggaacgtcctgatttgaagttagtgtcacatgggaggaaggtgacactgattgggaggccagtgcttgagattgaaggcctggtgggtgccacaggattaagtccactgatcgattgttcagttactattggcgatcctggactgatatccgcattcgtggagaggtggcacggtgagactagcaccttccaccttccgtttccatgctctttctatggaggaggccagatttttgctgatagagttgttggaggtgtctgccgaggaggccagagcggagacatcactcacacgtggggcatatgtacgactaaaatgggttcgagacatttatga

SEQ ID NO: 51062 - DNA, 3918 bp, Glycine max
  Peptide Sequence Number=SeqID_142747
atggacgtggagagatcttcgctgtgcaattgcgtggtgaactttctgttggaagagaactaccttctcaccgcattcgagcttcttcacgaacttctcgacgatggccgcgacgaccaggccattcgcctcaaacagttcttctccgatcccaatctcttccctcccgatctcatctctcgcctcaactctctccgagtggctgatcctcaaactttgctggaagagaaagaagcagcagaagaaaagttagctattagtgattatgaattgcgtttggctcaagaagatatctcaaaactcaagagtgaattgcagaagaaagcagaaaatcataatgaactaaaggctgaaaagataagtggagatgtttcagtgaatgatgggcagcaaattcagcaaaagaagaattcttccttcaccgatttgggtccattaaaagaaacagaacgtcgagatcttaattgtgctgtaaaggaatatttgcttatagctggctatcgtcttactgcaatgacattttatgaagaggttacagaccagaacttggacagttggcacaacacacctgcatctgtacctgatgccttacgtcattattattatcaatatctttcatcaacttcagaggctgctgagcatgtttctcattgcatactacctaaactagtgctgagattgtactcaagaaacaaaggtgctgagaaattgtttgactatatggttttgctccacatgactctgttatatgggcttcgtgtacttatcttgatgatcagtctgagtttggaaactataatccaaccttccaaacttctctttcacagacatttttctttatcacatggtttctatatgttatttgtcacaaaccaactatcccaaaagctgttaggtcttcaatggcacatcgatatcatggccatgctaactagttcattggttttcaagttgaattggtcagtctatgtaggttttagaactactgaacaggaaaaattttccctacttagagaaaatgaaactttgctgaatgcaaataagaggctgaatcaagaaaaggagaacttgttgaagaacaaagacatggcggatgctcaaatagtcacattaactaagtccttggatgcaatgcagaaagatcttaaagacaaagaaaacctggtgcaagttttgaagcaatccttggagcaccaaagaaaggaactcaatgattgcagagctgagatcacttccctgaaagtgcatattgaagggtctcacttgggaaataatctggttatcagtgatgttaataatgttcaatctgaatctcttgaaaaatataaggaagaaatgaagaaattgcagatggaaaatgaatggttgaaggaaaagaatataagatctcctgaacctggaaattttgttggttctgaaaaggaaaatttgcagataaatgataaagtgattgagattcatgaagaccaaggtgcaatctctgaccctattgatgtggctttgggtgctgtacacaatgaagatgctcaatcaccagttgttcaaactcttgctcagtatgctgataaacatgaggatacattgcctgagttatttaatcctgcaaatacaaataatgcttttaaaaatataaaaaatgtctctgaacaaaatgttgggcaacaagcagaggatagcagcttgcttgtaaaatcagacagtgtgaatgatggagcaatatctgagaggacggcaagttctttgtactcttggcttgaggaaatccttaaacattattacttgttggggttaggaaccattcagatacttgcagatgctttgcctaaaattgttccctatgtcttgatcaaccatcgagaggagctccttcccttaataatgtgtgcaatcgagcgccacccagatagcagcactcgagattctttgacccacacattgtttaatttaataaagcgacctgatgaacaacaaagacgaataataatggatgcatgtgtgaaccttgcaaagaatgttggagagatgagaacagaaacagaattgcttcctcagtgttgggaacaaatcagtcacatgtacgaggagcgtagactgcttgttgctcaatcatgtggagagcttgcagattttgtacggctggagattcgcaattctcttattttgtctattgtgcagcaactaatagaagattctgccagtgttgttcgagaggctgctgcccgtaatctggccatgcttcttccacttttcccgaacatggataaatatttcaaggtggaggatatgatgttccaattggtatgtgacccatcaggagtggtggtggaaactactctcaaggaattggttccagcagttattaagtgggggaacaaattagatcatgttttgagagttttgctttctcatattgtaaactctgccctgcgttgtccacctctttctggggttgaaggatccattgagtcaaatctccgtgtcttgggtgaaagagagcgctggaatatagatattctgttgagaatgctggcagaattgctttcttgggtgcaccagaaagtaattgagacatgccccttttcatccaccacagaaactacccaagctgtgttatctacggctttgcttgaattgtatgctagggggcaagttgaatggggtgcctttgaatggatgcatgttgagtgctttcctaatttgatacagctggcttgtttgttacctcagaaagaagataacttacgaagtcgaatttcaaagtttttgttatctgtttctgaaagttttggggattcctacgtgacatgcataatgcttccagtatttttaatagcagttggggatgatgccgatctgacattttttcctacttccatccattcaagaattaaaggtttgagaccaaggtctgctgttgctgataggctctctacaatgtgtgtccttccgcttctattggctggggttttgagtgctcctggaaaacatgaacaattagcagaatatttgaggaagctgctactagaagaaaattcgatgcagaatcaatcaaccaagcacactcctgagattattaatgctatccgcttcatttgcatatatgaagaaaaccatggtatgatatttaatatactatgggaaatggttgtcagctctaatgcgagcatgaaaataaatgctgctaagttgctgaaagttattgtgccacacattgatgcaaaggttgcttcaactcatgttttgcctgcccttgttactcttggatctgaccaaaacctgactgtaaagtatggtagcatagatgcatttggtgctgtggctcaacacttcaaaaatgagatgattgttgacaagatacgtgttcaaatggatgcttttcttgaagatggttcccatgaagctactattgctgttattcgtgcattggtggttgcgatttcccaacttacagctatgccaaattcatcaagtgatttgatgcgtcgacgagaacgagccaatgcattttgtgaggcaatccgtgctctggatgctacagatcttcctgcaaatagcgttcgggacttgttcctgcctgctatacagaatctcttgaaagacttggatgcattggatccagcacacaaagaagcccttgaaattattatgaaggaaagatcaggaggaacttttgagtcttttagtaaggtgatgggtgctcatattggccttccatcatcagtgaccagcttctttggtgagagtggattgcttggaaagaaagaaaccacagagccaccatcagaagcaacagtgtctcccaaagctgctgcaccatcaccagcagaagacacaagattcaagcgcatcatgctgggaaattttagcgagatgcttcgtggcaaggcaaaagccccagaggaaggtcagaaccaataa

SEQ ID NO: 51063 - DNA, 312 bp, Glycine max
  Peptide Sequence Number=SeqID_142748
atggatgtctatgatacgtttttggttactagtactaccacgtgggtagctgtggtggttgtagcacttcttcttctggcggaggtggggcccatggctgaggctgtgacatgcaccccaacagagttgagtccgtgtcttccagcaatcacttccggtgctaaaccttccaatgcttgttgcacgaagctgaagcagcaaaaaccatgcttatgtggctacctcaaaaacgctagcttgaagcagtatgttaactctcctaatgcccgaaaaaccgttgcttcttgtgggattccctttccaacttgttaa

SEQ ID NO: 51064 - DNA, 1353 bp, Glycine max
  Peptide Sequence Number=SeqID_142749
atggagattccaaaatctaaaagcttgcaaatcacatgtccatttggtggaaaaatcttaagaaggaacgaggacatgaaaagaacagtagcagcaacaatcatgctctttctttcctttcatccttctctatctacaaattcatattcatattctcgctttcacatttcctcttctctgcccccaaactccaacaatggccataatcatcaacacacttcaacttcaccttctgatgttcccatcaaagcccccattcctccatggatgaagaagggtcctcttcttctccaaccccacgagctctttcacctctccaaccccaaatccaagaagttcaagccggaaaaacatgaactttctgataaagctttgatgggaaaggaggtaagagggaagagggcaatgaagaagattgtggagagggttgaaaagcttcacaagactcagaattcatatgagactcgagttggttccctcaatgttgaaaactttggaggatatttgaaaaatttgaaggaaaatgatgaggatgagaagtttggttttgtgaaagtgaaaagggaaaaggttgtcactgctgcggagttgactcttgataaggtgctgcttcgaaagttgaggaatgaagctgaaagaatgagaacgtggatcaaggttaagaaagctagagttacacaagatgttgtggatcaaattaaaaggacttggaggagaaatgagcttgccatgactaaatttgatatccctttgtgccggaacatggatagagctcgagaaattgttgaggttttgacaaagacaggaggcttggttgttttgagtaagaaggattttcttgtggtttaccgaggatgcaatcatcagttgaccactaaaggttctcctagtctaagaacaaatcgttttgaaatgaatagggtggaattagctaccaaaggtgatatttgctgggttgtatccaacaacagttccagtaagatgctgagttggaatgctgatcataaggattctatatcaactggcatccaagatgtgaattgtcaactgccacttccagtagatgccgacttacttcctgtagaggttcctagatttcagcctccatttaggctttgtccacctcattctagtgctaaacaaactgcttatgaactaacatacttcaggaagcttgctcaacctttaccaactcattttgtccttggaaggaacaaaggactcaagggattagctgctgctatcttaaagttgtgggagaagagtcttatagcaaaaattgctatcaagtatggaattccaaatattgacaatgaaatgatggccactgaactgaaggcaagtttgatataa

SEQ ID NO: 51065 - DNA, 144 bp, Glycine max
  Peptide Sequence Number=SeqID_142750
atggctatgcaattacatttgaggactctttctctactagacatctgggtacttatggtgcttctatgtttactattggaagaggaaccaatctatatccctcaagtgttcaaagcaaatggaaggaaaataagaccaaattaa

SEQ ID NO: 51066 - DNA, 354 bp, Glycine max
  Peptide Sequence Number=SeqID_142751
atgacacccacctacattgtacaacactctgtcgcaacctacctttcggcgggagggcgacgcgagactcaagggtgcgtcttccaaggaaagagaacgtgcaaagtcaacaccaacacttattcaaggaaaatgtcgggaaaaaccaaaacatgtggtctgcgaactttaatcgtgaaaggttcgggagttgtttttatgcacgaggaagagttacgagaattttatggaagcattacggaagctccggaagccatttttcaacaaaacgggggaggaggttgccacccagctcgcccaggcgagctaggttgcttcctccttaagcaacccagcttccaaaatgctctgtaa

SEQ ID NO: 51067 - DNA, 294 bp, Glycine max
  Peptide Sequence Number=SeqID_142752
atgaaaggtcagattaaggcttcattctctaccaaaaccgcgaggcaagtttggaagattttgcttcggttgaagggttcctcttggtgtggggtttcaatggagcacaatggcgatttgttgtggctactggtggctgtgggtgatagagaaagagcttggaacagcaaatttcgagaagatccaacgattaacgaaggttgggcagcgtttttatcgaggcagcttcatgtagcttccttgagaagcttcattaagaggcttcctcgagaagcttccttgcggcttctttga

SEQ ID NO: 51068 - DNA, 1323 bp, Glycine max
  Peptide Sequence Number=SeqID_142753
atggctgaaagcgcggtgacgaacaggaagcgcagcagcggggacgacgccgtttcggagaatgacagaaagcggaagaatatggtggcacgcaacatggacccggctgaggcgttggccttgacgcggcacgagttcggggagcacggtggcgtaaacatgtcgatcgaggcctcggcgacgttcacggtgatggagccggagaccctcggtcgcatgttcgccggcgagctgggcccggaccgcgatttcttcatttacagccgccacttcaacccgacggttgtcaacctgggccgccacatggccgccctggaaggcacggaggccgcctactgcacagccagcggcatggccgcgatctcctcggtactcctccagctctgtagcaccggcgggcacgtggtcgcctccaccactctctatggtgggactcacgccctcctcacgcacttcctccccgggaaatgcaacatcaccacgacgttcgtggacatcgccgatttggaaagcgtggagagtgccatcgtggaagggaagacgaacgtgctgtacttcgagtccatggcgaatccgagcctgaaggtcgcagacattccggaactgtgccgcgtgggacacgcaaagggcgtcacggtggtcgtcgacaacaccttcgctcccatggtcatctcccccgctcgtctcggcgctgacgtcgtcgttcacagcatctcaaagtttatcagtggcggtgctgatattattgcaggggctgtgtgcgggcctgcgagcctagtgaattcgatgatggaccttcacgacgggtccctgatgctgctgggtccaacaatgaatgcgaaggtggcgtttgaactgtcagagagaatcccacacttgagccttaggatgaaggagcattgccaccgtgcgttggtgttcgccacaaggctcaagaaattagggttgaaggtgatctacccaggccttgaagatcacccacagcacaaattgctgaaatcaatagccaacagggaatatggctacggtgggcttctttgcattgacatgggaacggtggagagggcaaacctgttaatggctcacttgcaaaatgatgctcaatttggattcatggctgttagcttggggtattatgagaccctcatgtcctgctctggtagcagcactagcagtgagatgactgaggaggaacagaagcttgctggaatctccccaggcctggtaaggatgtccattggatacattggcacattggagcagaaatggagtcagatggaaatggcactcgaaagattccaggaaaaggagccactagtttaa

SEQ ID NO: 51069 - DNA, 3036 bp, Glycine max
  Peptide Sequence Number=SeqID_142754
atggaggaacaagagaagggtttgtgtggagcatcagaaaccacagtgactcacgaggagaaagtgaggattgaaaccctagaggggtctgtggattgtgggggtgaggttctgatggagggttcattcactgaagacttggttggggagggtggtacatgtaatgggaaggatgtaatggtggaggttttggggtctgatgtgtacatagacggtgtttgcactcatgagaatggtgctgagttgagtggtgaagtgggtggtggtggatcagttgagtgcggggaagatttgggtaaggatttcaggtctggaggagtaggttgtggggactctcatggtgtggaatctgaagaaggtaggagcgagaatgtggcaatgaaattggatagtgtggtgttggggagggaagatagagatgaagcagtagttggtagtggtgaagttggtgccgcatcttttcagggggagtctcttttggataatagagctcataaagaagtgtggattgaggttagcaatgttgaagatcttatggtggcagatgttggggttgagtgcacaaatgcaccggatgctgagaccacagatcacaaggtgaataatgctgtaggattcccgttaggaggagagaatgtacaggttagttcagatacagggcagggagttgataaggattcaacaatagaagaggaattaaacaagaatgtttttgatgctgaaaaatgtgatttgcgtaagggggtagaagtagaagccgaaggtcaaccagaagcagaaagtactaaaacaacaaaccacacttcagatattgaaggagaagacactcaaattgctgaccaggataaccttgcactgatggatgctggacaggaagaagtccatgatgagtctaatattaggcaaaatgttgaagtacatactggcatttctgagcagcttggttcaaatggaggtcaggaagttgaagagtttattaaagctgaacagagaaaactagagggaagagtcacgagacgtacatcattaatgaagtcaatgagttcggaatcatttcatcatgcaagatatttgctaccaatagaaaaggaaggtgagttttctgtgtctgatatggtttggggaaaggtgagaagccacccatggtggcctggacagatatttgatccctcagattcatctgagaaggcaatgaagcattataaaaaagactgtcatttggtagcatattttggggatagaacatttgcatggaatgaagaatcccagctaaaaccttttaggacacatttctcctctattgaaaagcagagcacttcagaatcatttcagaatgctgtagattgtgctgtggatgaagtcacaagacgagcagaatatgggctggcatgttcttgtatacctaaagatacctatgactcaattaaattccagaatgtagaaaacactgggattcgaccagaattaagtgtcagacatggggcggatgaatctctaaatgccaactccttttcacctagtaatcttgtagaatacttgaaaacactatctgcattgccaactggtgggtttgatcgtttggagcttgggattgctaaggctcaactgcttgcattccatcgctttaaaggttactcttgcttgccagaattacaatattgtggaggctttgacgatgacatggactccttagttcatcatgatgagaataatcatgccgctcctgtaagcaagaatgatggtccagctggttctgcaaatttaaaaaaccaaagcagctctcgtcgtaaacggaaacataatctgaaggatattatgcatgaaaagaaggaaagaagcttgtcagaactaatgggtgggactctagactctcctgatggtgattattggtctgatgagaaggtaactgataatctggtttcacctggccgttccaagaaaaagaggactgtagatcactatgctgatgactttgggaagccagatggaagaaaaacaatttcggtcgcaaaagtttctaataccacaaagtcgtcatttttaattggggaccgtattcgtagggttgctagtaaacttactggttcaccctctatggtgaagagttctggtgatcggtctcagaagaccgatggaagcgctgatggtttttctgggaatggacctgatttttcttttgaggaggctcagaggtcaaatatggttgccccaacagagtattcatctctggacgatttgctatcttcacttcgtttggtggctcaagaaccccttggagattacagcttcctgaatcctattgtaagcttcttctatgatttcaggaattcgatagttgtggctgatgattctgtaaaagatatattttgtaaagaaaaagttggtactaaaaggaagaaaccgctcacggctggattgcccgaaacatttgaatttgaggatatgagtgacacatattggacagacagggtcattgacaatggtagtgaagcacaaccagcgcaaccgtgtcaaccaccacaaccagcacggagaaaccggaaaaaagaccatcaacttgttcctactgagccagggaagcctgttcaagttagtcgtaggccatattccaggaaacagtattctaacaacaatcacattgaggctcctgcaaaacctcctggttatatagatgagaatgcccctgctgaacttgttatgaactttgctgagttgggttctgttccctcagaaacaaaccttaataaaatgtttaggcgttttggacctctaaaggaagcagagacagaagttgatacagtaagcagccgagcaagagtggtttttaaaaagtgtgttgatgcagaggttgcttgtagtagtgctcaaaagttcaacatatttggcccaatacttgtaaattaccagcttaattatactcctagtgcattgttcaaagcttcatctgttgccacaacacaggaccaggagatgcatcttgatctctccaattttgaggttaatataattggcattcttggaaattttgatgagtaa

SEQ ID NO: 51070 - DNA, 186 bp, Glycine max
  Peptide Sequence Number=SeqID_142755
atgaagagagaagaagggcgggagatagatacatggactgagatgagaagggttatgcgaaagaggttatcccaggaaagtttgattgttgaggacaaggagatggagatgacactagtgagggccaacattgaagaggacaccaaagcagtgcatgatggcttcaccaacaagatttctttctag

SEQ ID NO: 51071 - DNA, 201 bp, Glycine max
  Peptide Sequence Number=SeqID_142756
atggacaacacatggaacaattcgaaagttgaattcaacctccaacaactaactcctgatcaagcctataaattgatcaaattccaaggagcaactcccaaggaagggttgccaaagaagaggttttctgagaacacaacaagtagttgtgtgggtcctatagcaggtgctaccgaggtgaaatctgagaagattttttga

SEQ ID NO: 51072 - DNA, 318 bp, Glycine max
  Peptide Sequence Number=SeqID_142757
atgcctcctcttctccttattttcgtttttccctcttctcctctcaaaaccctctctttttcccacaaaccaccaaatctgtctcagaaaaacaatgatatcggacttattcaccgttggatcattgtgaaatttaagaacccgataatattcgtggagggagataacagaatcgcacgaagacagtacaaatggaggcttcaatcccttctccttctctataacgtttgggaaccttatcagagcaatcagaggaaaaaattgaggaatctcaggaaattgctagagatgccgctatcgctgtcggaagacatgtaa

SEQ ID NO: 51073 - DNA, 2649 bp, Glycine max
  Peptide Sequence Number=SeqID_142758
atggtgtcaaaatcctattcaaacctattggagttggcctctggagaggctccgtcatttgggtacatgaacaggagaattccaaggattatgactgtggctgggttgatatctgatgttgatgatgacccagtggagagtgtgtgctctgatccgtcgtcgtcaaccgcgcaccgagaccggataatcatggtggctaatcagcttcccataagggctcagaggagaccaaatgggaataataggagttgttggtcttttgagtgggatgagaatgcacttcttcagctgaaagatgggttaggggatgatgatattgaggtcatttatgttggatgccttaaggaggaggttcatccaagtgaacaagatgaagtttcacagacacttcttgagaccttcaagtgtatcccgacttttctccccgctgaccagtttactaagtactatcatggtttttgcaagcagcagttgtggccactgttccattacatgttgcccttgtcacctgagctcggtggcaggtttaataggtcactgtggcaggcttatgtgtcagtcaataaaatttttgcagataggattatggaagttattaaccctgaagatgattatgtgtggatacacgattatcatctgatggtgttgccgactttcttgaggaagagattcaacagggtgaaactgggcttcttccttcacagtccattcccttcatcagaaatatataaaacattgcctgttagggaagagatcctgagagccctccttaattcggatttgatcggcttccacactttcgattatgcgcggcatttcctctcctgttgtagccggatgcttggccttacctacgaatccaagcggggatatattgggattgagtactatggtaggactgttagtatcaaaattcttcctgtcggtattcacttgggtcagcttcaatcggttttgaggatgcctcagactgaagaaaaagtttgcgagctcattagacagttttctgataaaggcaggacattgttgcttggtgtggatgacatggatattttcaagggaataagtttgaagttgttggccatggagcagcttctcattcagcatcctgagtatcgggaaaaggtggtgctggtccagatagctaatcctgcgagggggcgagggaaagatgtgaaagaagtgcaagccgagacgaaggccacggtgaaacgaattaatgaaacatttgggaaacccgggtatgatcccgtcattctgatcgaggagcctctcaagttttatgagagagttgcttactatgttgtcgcggagtgttgtttagtcactgcagtaagggatggaatgaatctcataccgtatgaatatatcatcagtcgtcaaggaaatgaaaccttggataaagttttgggtctagcttcctcccctaagaagaaaagcatgttagttgtgtctgaattcattggctgttccccatctttaagtggagcaatcagagtgaacccctggaatattgatgcagtagctgatgcaatggactcggcgctggaaatggctgatttggagaaggagcttaggcatgaaaagcattatagatatgttagtactcatgatgtcgggtactgggctcgaagcttcttgcaagatttggaaaggacctgtagtgatcatgtgcgacgaaggtggtgggggattggttttggattaagctttagagttgttgcgcttgatccaaacttcaagaagctctcaatggagcacataatttcagcttacaagcggacggcaactagggcaatccttcttgactacgatggtacactaatgcctcaatcatccaccattgataagagtccaagcagtaaatccattgaaattcttagtagtttgtgtagagataagaacaacatggttttccttgttagtgctagaagccgaaagatgctttctgaatggttttgtccttgtgagaatctgggagttgcagctgagcatggttactttctaaggcaagttacttatgcttcttgccttttcaacatcagtgctttcctgagaatgaagcgagatgaagagtgggaaacacatgttgcggcaacagacactagttggaaacaaattgcagaacctgtaatgaaactttatactgaaacaaccgatggatccaccattgcagacaaagagactgcacttgtttggtgctatgaggatgcagatccagactttggatcatgccaagctaaggacttctcgatcatcttgaaagtgtgcttgcaaatgaaccagcataatttgaaaacaaaatcaattactggggttggagtgatcaataaaggcacagtaggactgttcagcataaaatcaaggggtgttagcaagggactagtggccacacgcctactttctgccatggaagaaaaggggatgtgccctgattttgttttgtgtataggcgatgacaggtctgatgaagacatgtttgaggtaatcaccagttcgatggggagtccgatcgcggcaaaggccgaggtattcgcgtgcacggtttgtcgaaaacccagtaaggctaagtactacctggatgatacaactgaaatagtgagattgcttcagggcttagcctgtgtttcagaacaaatagacaaatag

SEQ ID NO: 51074 - DNA, 90 bp, Glycine max
  Peptide Sequence Number=SeqID_142759
atggaggaagattggagaacagcattgattgagttttaccacacgatcgtagagcttctgatatttttcgaagaggtttttacgaactaa

SEQ ID NO: 51075 - DNA, 717 bp, Glycine max
  Peptide Sequence Number=SeqID_142760
atgattaagtcttctgatcgcgtgttcaatagacatcggcgatcggggacttatatcctcgtttgtcgagaggtgacaccgggagacgagtacttttcatcttctagtgggggaggtatccatcgcgttggacgacgtcgcttatcttcttcatttgtcgatcgttggcgacttcctcgcctttcagcctctgcacatcgacgaggcggtgttgatgttgacgccctgcttgacctcactcagactagaaggtatgcatggggagcttctggtctcgtccatttgtacgatcagcttaatgatgccaatatcagcacccgccgacaggttgttggttacatcacgctgttacagctctgtagtgttggacatatgaacaattttcgtcagttgcggagtacaatgctgattcggagtacgacgaggtgtcaccacatgcgtgttagtggattgccacaaagaagactatcaaaaagatatctacagcgatgtacaggcagcgcttggatcgtctcaggattccagatgtctgttggatgccatatgcggaacaccgatcggtccaagactttcatccgatttcatgtttctcaggacagctccgctgggggcctgttgttgtcagatacagaccgaagagggttatgcaccaattcagatacgtccagtgcattccagcacaccctgtcaattcatgggtgtcatttgatgacgtag

SEQ ID NO: 51076 - DNA, 366 bp, Glycine max
  Peptide Sequence Number=SeqID_142761
atgattagtttcagtgttggtggtagcaacaaaggtggtagtgattgtagcaatgtcgatgatgttggtgataatagtagtgacaatgagtcaattacggtggtggtgatagttgtggtggctactacactaatggtgatggtggtgatagtaatgttggtgatgccaatgatgatggtcgtggtggtaatggtatttgtggtcgtcatggtgacaactaattatggttgtgataatgatggtgatggtgatgatggtgtcggtggtgacaatgacaaatatgatattaatggtagtaacaatggtgataacaatgatgacaataaaaaggtgatcgtcaaatgtggaaaatgtgtgattttttaa

SEQ ID NO: 51077 - DNA, 348 bp, Glycine max
  Peptide Sequence Number=SeqID_142762
atgtatggttttgttctagattgcttaatcctgaattattttggcacaatcctggaacactttggcttcattgacaaaggtggggttgctagccttgtcgaacaaagagttaggtgtaggaaaggagttgcgaatgggtgctataatggaagaagtgggacgatgcaagggaaacacaaaacgacagggagttggaaggacaaaggaggaagcaataaccttaacatgtccttgaagagtccaaaaaacaatattacaaaaaccattgggctttgctttgctactgggctgaaacagggtcttttcaatcgaaacactaataatgaggcactcagaaaggacaagtag

SEQ ID NO: 51078 - DNA, 168 bp, Glycine max
  Peptide Sequence Number=SeqID_142763
atgaagatgctcttgataccacatgatataagctccattggagcttcggaatggagaagaagaagatttgagaggagatgccacttcaaggagaagatgagtctagaagaagctcaccaccatagggaggccatggataagagcttggaggaagaaggagatgaatga

SEQ ID NO: 51079 - DNA, 372 bp, Glycine max
  Peptide Sequence Number=SeqID_142764
atgggaagaggctggggggtgtggggggcaggcacctggctgccctgcgctagctgtagcgcctgcagcagtggcgccagacccctgggcgttaccagacgcgcccgcgtcaggggcgctacctgctgtgccacgtgtcgcgtgcacagcggaggcgcctgtctgggggcgctttgtaataaaaaaaatagaccctccagcgagagaacttatgtttttgttgtctcatatgatgtgccaccattggaggtggtggatcaagggaaggagaaggtgaaacggttgtcaattcgtggaagccgaggtgtaacaaggtcaaagttgttgtcgcaacttcaatcgaaacaggaacaccccaacaccatggaataa

SEQ ID NO: 51080 - DNA, 552 bp, Glycine max
  Peptide Sequence Number=SeqID_142765
atgcagattgaaagtcgtaggagatttcatatcatccgttcctgggatcaagatgggtatcatgttgcagaggttgaatggatacaagatattatgccaccagaaggaacacatgaaagagaaattagttacaacaataaacatataatgcagctaaagatgctcattataaatttacatatcaacatcgtagtgtacacttcccttcaccgtccagtgtcaccaacatcacaaacctcgaggagtaacactagaggtagcatcgatggtgaatttttcgccgtgctaggagctaatggtggaggcggtgagggtgacggggtcaacggtgtcgggaaggacttcaaaacggtagccgatggcattagagttgttgggcttgcaccaagcttcaaggtggccccatggcttccaggtgtcatctccatcgagacagattatgagctaggctcccgggttggagtggccgagcgagtaacccactacaaactaggggaggggacgagcggcatgaccatggaggcggcggcgatgaagtggaagacgaagtga

SEQ ID NO: 51081 - DNA, 282 bp, Glycine max
  Peptide Sequence Number=SeqID_142766
atggagaggaagattatgattgaggtaatgtatacgcaaacagtgaagtggcgaaactgcccttcagcaattcttctttcggaagaagattttttccagaaaatttccggaaagcctctttccggaaattttccggaagaaccttcttccggaagaagtatttgtgatttccggaattactcagaaactacttctggaagaacgtcatccggaatgtttccggaagaagcttcttccggaagatttccattttcttctggaaatttgttcttcttgaagtaa

SEQ ID NO: 51082 - DNA, 171 bp, Glycine max
  Peptide Sequence Number=SeqID_142767
atgaagatgaagacatgcaaagcaaggatgaacccggaggaggttgcacagcagctcgcccaggcgagctgcttgcttcctccagaagtaacatgcttacctaggcgagctggttacttcatctcaaagtcttctagtgggccctggggctggaaaatgtccccaaagtga

SEQ ID NO: 51083 - DNA, 177 bp, Glycine max
  Peptide Sequence Number=SeqID_142768
atggtgatgcaatcctatcccgcaagggcattgggtagaagactccaagtagattgggctagagatccaagggaaggccctagggttctcatgagccttaggcttctcaaggaagttttctcaaagaagcttctcaaggaagttttctcaagaaagcttctcaaggaagctacctag

SEQ ID NO: 51084 - DNA, 438 bp, Glycine max
  Peptide Sequence Number=SeqID_142769
atggccaagttcgatccagacatagtcctcgaattttatgccaatgcttggcctacagaagagggcgtgcgagatatgaggtcctgggtgaggggtcagtggatcccgttagatgcagatgctatcgaccagttcctaggatgccctttagtgctggaagagggtcaggagtgcgagtatggccagaggaggaaccggtctgatgggttcgatgaggaggccatcacccatttgctatgtataccggggcaggattttgcccggactgctgccgggagacgggtgcggatcatgcgcacgaacatgaccaccctaactcagatctggatgactttgctgctcagcaacatccagcccagcgatcataatttcgacctccccctgccgaagtgtcagttggtgtatggcgcctaccaggcaccctctggacccggataa

SEQ ID NO: 51085 - DNA, 672 bp, Glycine max
  Peptide Sequence Number=SeqID_142770
gcctacaagctccaatggagcttacatcagatggcatctaagaagaggaaaacaccctctacacctactcaaaccaaatttgatagatccagattcacatcccaagaggcttgggagagatacactgacatagtgttgccacgaaagctactaccagagaggaatgtggtaatctattatacagagtttgacgagttcaaggaggaactcgagagacgccattgggatgagaagctgactgatttttctaacaacaatatagacatcgccattgtgaaggagttttatgccaacctctatgaccccgaagagttggctgctaagctttgtatccctgggaggggattcgagcttaatgctgatgggcagcctttgaagattctgaggaagaacatgaatactctagctcagacatggagcgttctttccttttctaacctcattcccacctcccacacctctgatatcacattagatagggcagccttaatcactgctctttacaaagccaggggagtcatttctgattctttgacattggagagcctcgatccagctattaatgtggcttatgtgaagaaaaactgctggaacctagatgacctctcagttactttcagagggccgcgcaaggccaatgggaagaggtttgaggctcccccatcttctgag

SEQ ID NO: 51086 - DNA, 666 bp, Glycine max
  Peptide Sequence Number=SeqID_142771
atgaccatgttacgccaagctcgaaattacaccctcgcatctaagagggctacacaaaagcctcgtaccggggccccccctcgaggtacgacgcgtatgagtaagcccttgaatagagggctacacgtcctcgtccatcagaggactacacgtcctcgaccttcggaggactacacgtcctctcctttagaggactacacgtcgtctcccttaactacacgtcctctcagaggactacacatgtcctcgacctttagaggactacacgtcttcctccttcagaggactacacgtcctccctcttcagaggactacatattctcccttcagaggactacacgtccttaccttcagaaggactgcatgtcctcgccttcagagggctacaggtcctcgcatcagaggagtacacatcctcgccttcagagggctacacgtcctccccttcagaggactgcacgccctcgccttcttaggactaaacgccctcgccttcagagggctacacgccctcgccttcagagggctacacgtccttaccttcagaggactacacatcctcgcattcaggggactacacgtcctccttttcagaaaactgcacgccctcgccttcttagggctacacgcccttaccttcagaggactacacgtcctcacctttag

SEQ ID NO: 51087 - DNA, 126 bp, Glycine max
  Peptide Sequence Number=SeqID_142772
atggacgaagaagtgcgggaggtccttggagctggttcaaacacgcacacgaccaaagtgttctggtcaccaaatggcagcagtcagtacatcctgacgttcatgtgcgacaaaggaaccctgtga

SEQ ID NO: 51088 - DNA, 850 bp, Glycine max
  Peptide Sequence Number=SeqID_142773
atgggcgccgagcggggagccgatgtcatcgtggtcggcgccggcatcatcggcgccgcctgcgcctggcggttggcgcgggaaggctatcgcgtctcggtggtggacgatcgccgcgccggcgccaccgccgccggcatggggcatctggtgtgcatggacgataatccggccgagctggcgttgagcgcttattcgctgcggttatggcgtgaagtgacggggcgcatgccgcaagcgtgtgcctggcgcggctgcggaacgctatggctggcggataaagcggatgaaatggccatcgccgagcaaaagcgggtgcggctggcggagcagggcgtggccgcggaattgctgacggcggaacagatcgccgccatggagccgatgctgcggcacggcctggccggcggactgcgggtgccgggcgacggcattctgtatgcgccgctcgcggctcgctggctgttggccgacggtggtgcggcaatcgacgtggtgcacggcgaagcggcagcgctggaagagggagccgtgcggctggcggacggcagacgcctggccgcgccggtggtgctcctggcgtgcggccttggggccaatggcctattgccgcagactttgctgtacgccaaaaagggccatctggcgatcaccgatcgctacccgctgcgggtgcggcatcaactggtggagttggggtatggggccagcgcgcatgccagcgacggcacgtcggtggcattcaatgtgcaggcacggcccaccgggcaatggctgatcggttcttctcgccagttcggcgccgtcgattcggcgttggacatgccgctgttggcggcgatgcttgcgc

SEQ ID NO: 51089 - DNA, 241 bp, Glycine max
  Peptide Sequence Number=SeqID_142774
gccacttgatccaacaagtggtatcagagcaggtatcttgagaaaagtttcacaacttcaagattcatggcctcctctgatgcaactccaagtagattgggctagagatccaagggaaggcccgagggttctcatgagtcttagggtaagcttagctattagagagcttctcaaggaagttttctcaaagaagcttctcaaggaagttttctcaagaaagcttctcaaggaagctacctag

SEQ ID NO: 51090 - DNA, 808 bp, Glycine max
  Peptide Sequence Number=SeqID_142775
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggaaaacagtgaatcggtcctcggtgcgccggccgctgtggccgcgctgccgcatcggacggccctgtggatcgcgcggcggttcagcgccggttcaagcgcggcggcgcaggacgggacctgtgatcttcctgcatcgcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 51091 - DNA, 366 bp, Glycine max
  Peptide Sequence Number=SeqID_142776
atgacgttgttgctcagcaatgtcctgcccagtgatcataactctgacttcctctgccgagtgtcagctggtgtatgccatcctgacacggatgagcgccatgtggctcagttgattgctgacgccatctatttatttgcaggtatgccacccaccaagcaccctctagacccgaataagtctaacagggccctggggtttccagcatttatcacgggcctatgccagtcattcggggttcccgtcacacctagtaaggtgatccggccgccgatcacccgagccttcattgagaagtattgcacgcctaggcaggcgcagggtgatgcgccacaggccgcagatgcaccgccaccacctcattag

SEQ ID NO: 51092 - DNA, 125 bp, Glycine max
  Peptide Sequence Number=SeqID_142777
gattgacattctcaccctgggtcaaggtttatggtgagttgggattttggctcaaggcttgtagaatggctagacatgatacatgtcagggtttggatttggttcaaggatgtgggatcctctag

SEQ ID NO: 51093 - DNA, 763 bp, Glycine max
  Peptide Sequence Number=SeqID_142778
atgaaggttatgcagaaatcctctttagcgggaagacaatcacaaaatctggagataggggacaacaacaaacattatcgccttaactggaggaacaatgccgacattacctccttttatttcacccatttccccgacgaagctaatgaagagttgctatggaggcacttcaaaaactggggtgacgtacgtgaagtatacatcgctaaaaggctcaacaagcatggcaggagatacaggttcatgcggttcaagggagtctcggatgcaaaaggattggaggtgagactggacaacatcttcatcaacgattgtaaactatttgtcaaccttcctaggttcgacagaccagttcggaatacagaggaccgccgacgattggaccgggctcgagtattggtgcggacaccgcttctgccgttgataaggtcggaggtcatcgtccgtgtgggggagcttgagtatcgggtatggattgtggaagagacagggttcgaaggtgggtcgaaccggaaaggaagctcgtcgtccgatgggtggtcggagatgataacatcggacgacggtggggaggttggcgatgttcttgacgacactaataccaatttctccttctcgtcggagctgcccaaccagaaattgtctccgtctcgtacccaacgggcagaaggagggaccgatgtgcgctgctgtgatcttagacccctaggtaatatccaggcagacgttacacccaaagaaaagtcaaaaggcactgtagaag

SEQ ID NO: 51094 - DNA, 255 bp, Glycine max
  Peptide Sequence Number=SeqID_142779
atggacaattgtcataccctaatttcgtccggggaccattgtttggtggcatgcaaccttctcttaaccgccatgaggtacttaacaccaatcgttaggcaatccatgaagttccgcaacatgccagaagttgaaaggaagcattgttgcacgattcgtaaagttccacaacattctagaagtcaaaaagggcattgttgcgtaatccgtaaagtttcgcaacattctgcaaagaaaataggtgtcgttacgtaa

SEQ ID NO: 51095 - DNA, 90 bp, Glycine max
  Peptide Sequence Number=SeqID_142780
atggctggaacggtaatagcagcacgggttcctccctctatctcattctctccatttgccccagttttctctttcatcaaagcaggataa

SEQ ID NO: 51096 - DNA, 294 bp, Glycine max
  Peptide Sequence Number=SeqID_142781
atggctactccacctgcctcgcctcctcctcctcctgcagacacatcagcgtatccatctacgttgaagcggacatgcaaggcgacacggctacgatcattggccactagaccacctggggcagaaagacttgtggtcaacgtcgatcctgctaccggcaaggccaacgatccccacaagaagaaattaagaacatatttgggaattttcgctcgtgataaggttgacgtgacatatgacacctggaaggaagtccctactgctcaaaaggatttgatatgggaggatattcag

SEQ ID NO: 51097 - DNA, 237 bp, Glycine max
  Peptide Sequence Number=SeqID_142782
atggcagttagaatatgttggatgttcttgagatggccccaaggaaacttgcctcaaagagatccaggaatgataaagcggccgaaggaaccagttccgctcccgagtatgacagtcatcgctttaggagcgctgaacaccagcagcgcttcgaggccatcaagggatggtcatttctccgggagcgacgcgtccagctcagggacgatgagtataccgatttccaggaggagatag

SEQ ID NO: 51098 - DNA, 180 bp, Glycine max
  Peptide Sequence Number=SeqID_142783
atgtggtaccatgttagtgaaaaacctcgtcgggctcctaagaggagaccagtcaaggtcatagtgttttgcgagaatgctccaaccacatgggatcaacataggcttaaaggagcactcaaaccgggtgacccccaaggcctacactccgaagagtccgtcagggcctctccctcctga

SEQ ID NO: 51099 - DNA, 447 bp, Glycine max
  Peptide Sequence Number=SeqID_142784
atgaccatgattacgccaagctcgaaattaaccctcactaaagggaacaaaagctggccagagtttgaggaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 51100 - DNA, 162 bp, Glycine max
  Peptide Sequence Number=SeqID_142785
atgtctctgaacttcacgaattgcctaacgatgggtgccaagtacctcgaagtggtcaaacgagggtcgcatcccaacaacggatggtccccggacgaaattaggcttgatgacgtgcgaccattctttggtcctcgtgaggtgcttggcacccatcattag

SEQ ID NO: 51101 - DNA, 539 bp, Glycine max
  Peptide Sequence Number=SeqID_142786
atggccccgaggaagcttgcctcaaagaggtccagaaggacaaggcggccgaagggactagttccgctcctgagtatgacagtcaccgctttaggagtgctgtacaccagcagcgcttcgaggccatcaagggatggtcgtttctccgagagcgacgcggcgccggcggtggacatcactggttactcccatggccaatggatcccgtttgatgccgacgctatcggccagctcctgggatatccgttggtgttggaagagggccaggaatgtgagtatggccagaggaggaactggtctgatgggttcgatgaggaggccatcgcccagctgctatgtataccggggcaggattttgcccggactgctgcagggaggcgagtgcgaatcatgtgcaccaacatgaccaccctgacccagatatggatgacgttgctcctcagcaacatcctgcccagcgatcataattccgacctccccctgccgaagtgtcagctggtgtacgccatcctgacgcggatgagcgtccatgtggctca

SEQ ID NO: 51102 - DNA, 336 bp, Glycine max
  Peptide Sequence Number=SeqID_142787
atgaagtcagatgacatgcggggttaccttattgttacgcacaccgttcgtcaaccatgggcaaacgagctcattgacgcacagagactaacatcgtcttctgcaccttttgtcgtcctaacccgtgaagtcaggggaaacgagttcccgttgacgcgcggagagctaacatcgtcctctgcaccttttgtcgtcctgacccgtgaagtcggtgacatgcggggttaccttatggttacccgcactttcggtcaactaggggcaaataagcccgttgacgcacagagactgacattatcttctgcacttttgtcatcctttcccgaagtcaagtga

SEQ ID NO: 51103 - DNA, 921 bp, Glycine max
  Peptide Sequence Number=SeqID_142788
atggtagaaccatcaaaaaagcgaaagggttcttcaagtcgaagccaacgacattttgagactcaagaaacgcagattccttcctccatttcctcttcctcattgttctcatccgaagaacaacggatacggtacacaaatcttttctcttctcgttccattattgatccaaaattcattgatatggatttcttttcaaatgagagttttgaatgcattcaggcatttgaaaacttcaatctcattcctttcatgtctttaaaattgtttgtttactctgatttagttaaagccttcaattcaaacctagaaatccatgaaggcactttaatttctgaagtttatgggattaaaatggtcattgaccaatccctattctatgacttgacccaattatccagtgaaggtgtaccatttgaaggtacactgcttgatgattggagatatgatttctctgtgcatgatgcccgccggttggtttgtaccaaccaagcggatatgaccgggaggcttcttgccggttcattggcttttgagagccgcatccttcattatctcattgtgcgtatcttgcttccaagatcttcaaaccctgcacagagatcctttctaataggcgccactgtgattgcatcctttggttaccgtaaagaacatgatggctcttgggtgaaaaagggtgctcaacccattgatgaagaaggaaatttacatggtggagaagattcctctcttcttcaaaagattttggacaggttcgatggtcttcaaacctttgttggtgaaaggtttgatactttggagttacaagtggacatgcgattcaatgagatggagtcaaggatcatcaaggtcgaagaagatgtttcttacattcgtacaagttttaatctaccaccaccaccgccaccatcatcttag

SEQ ID NO: 51104 - DNA, 79 bp, Glycine max
  Peptide Sequence Number=SeqID_142789
atgggtgacacggaccctccgttggtttgcccaagagaggggattacgacggaacccgcacatgatgcatatgcgaaag

SEQ ID NO: 51105 - DNA, 180 bp, Glycine max
  Peptide Sequence Number=SeqID_142790
atggtattagcgattatcggaaccggaagggaagttgaccgcctgacgcttttcattcgtagtgaagaagtttttcagcacgctttgcagcatctccttgtcggagctcagggtctgcagctcgcgcgtaaggttctgcagtttatcttccaactccttgatttttcgcccctcctctga

SEQ ID NO: 51106 - DNA, 565 bp, Glycine max
  Peptide Sequence Number=SeqID_142791
atggtggaggccatgatgagcatgaagaagataatggaagccaaagcggttacagttgctgctaccagcattgttgctaaggtgaacccgatgcccccatctggccttaaccaaatgaatcatccaacctcagatatggtaggcaaagatttgggaagtagggacgacccccatgatgtgcaaattcaaaacaagcacgccttcccgccatatggcctgcctcccaactgtacaccacccaatgtggcgtacactcccagtgagaatacacatgaaattccccaccacaatctagccgactccgagccttgcctcggatatgccactggagggcaagcagttggtggtatacccatgccaaacactttggaggcccctcagtttcgcccacaaccacaacccttgcattttgcggtgggaagagcccctcctactatgagtaaaaagggaaagttggatcatatagaggaaaggctcaaggacattgaaagaggcgaatattatgcctttgctaacctagaagagttgttcctagtacccgaacatggtcattcccaagttcaag

SEQ ID NO: 51107 - DNA, 279 bp, Glycine max
  Peptide Sequence Number=SeqID_142792
atgacttacgaacggggcggagatttcctggaagatgccgggaagatacttaacagggaagtgaaagggccgcggcaaagccatttttccataggctccgcccccctgacaatcatcacgaaatctgacactcaaattttggtggcgaaacccgacaggactataaagataccaggcgtttccccctggcggctacctcgtgcgctctcctgttcctgcctttctgtttaccggtgtcattccgctgttatggccgcgtttgtctcattccacgcctga

SEQ ID NO: 51108 - DNA, 216 bp, Glycine max
  Peptide Sequence Number=SeqID_142793
atgaggacgcgtagccctctaaaggcgagggcgtccaaccctctgcaggcgaggatgtgcagtcctctgatggcgaggacatatagtactctaaaggtgataggaaaacacagattgactgtccttttgaaagaggtgataattcatgcaacctcatcctatcttttgcaaatctctccgggaactccctcagagtatgtgttctgttcgatttag

SEQ ID NO: 51109 - DNA, 822 bp, Glycine max
  Peptide Sequence Number=SeqID_142794
atggcagaaccatcgaagaagagaaagggatcatcctccaccaccgctgctgctgcccatcgccgtcacggaccatccggagcacccacaacacctattcatccttctttgtcatctctaagatcatccacattgttttcatccgatgatcagcgtctacggtacctttctcagttttcttctagaatcatcttagaccctaagtacctagacgtagaattctttaatgatgaaacgtttgattgctatcaagtgtttcaaaattctggccttgttgatttcatgtcattaaaattgccatattatcctaaacttgtaaaagtcttctactgcaatttaaaaattcaggattgcattattatttctgaggtgcatggtattcctatggtcattgatcagtcattgttcttttctttaactaatttacccagtcaaggtgcaccttttgagggcaccattgttgatgactggaaatttgattattcgagtcatgatgctcgccgcatgcgttcctttgcaattggtgctggtgcagtgacttcctttgggtaccgtaaagatcggaatggtcaatggctgaagaaggatgcactccctcctcaagatgaacgtactccttcacctcctcctcagcgcgatgattcagcactcatgaatgaagtcctctccgaattacggggtcttcgttcttatgttggtgaccgcttcgactcattagatacacgctttgccggtatggacattcacctcacacaacttgaagaggatgtaggttgcattcgtcagagtttcgatcttccaccaccacctccgccttcttag

SEQ ID NO: 51110 - DNA, 402 bp, Glycine max
  Peptide Sequence Number=SeqID_142795
atgcccttgtcctttagtggactacacgtcctcgccttcagaggaccacacgtcctcaccttcataggactagacgtcctcgcctttagagggctacacgctctcacctttagagggctacatgccctcgccttcagagggctacacgttgtcgccctcagagaacttacacgtcctcgccttcagaggactacatgtcctcaccttcagaggactacacgactagacgtcctcgcctttagagggctacacgctctcacctttagagggctcacaccctcgccttcagagggctacacgttgtcaccttcagagaactacacgtcctcgccttcagaggactacatgccctctgccttcagaggactacacgtcctcgccatcagagggctacatgccctt

SEQ ID NO: 51111 - DNA, 288 bp, Glycine max
  Peptide Sequence Number=SeqID_142796
atggtgaaagttggaacctcttacgtgccgatcaacgtatcattttcgccaaaagttggcccagggcttcccggtatcaacagggacaccaggatttatttattctgcgaagtgatcttccgtcacagctgtccctcctgttcagctactgacggggtggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 51112 - DNA, 186 bp, Glycine max
  Peptide Sequence Number=SeqID_142797
atggtgaaagttggaacctcttacgtgccgatcaacgtctcattttcgccaaaagttggcccagggcttcccggtatcaacagggacaccaggatttatttattctgcgaagtgatcttccgtcacaggtgctcagtggcttctgtttctatcagctgtccctcctgttcagctactgacggggtg

SEQ ID NO: 51113 - DNA, 867 bp, Glycine max
  Peptide Sequence Number=SeqID_142798
atgatgctctggctgagcgccggagtactggtcggtctggcggacggtgccggttatctgctgacgctgtcaaactgcgttaaatggttcccggagcgtaaagggttaatctctgcgtttgccatcggctcttatggtctgggcagtcttggatttaaatttatcgactctcatctgctgtcttctgtggggctcgaaaaaacctttatgatctggggcgctattgttctggtgatgatcctgtttggcgcaaccctgatgaaagatgcgccgcagcaggaggtaaaaaccgttaacggcgtggtagagaatgacttcaccctggcacaatccatgcgtaaaccccagtactggatgctggcggtgatgttcctgacggcctgtatgagtggtctgtatgtgattggtgtggcaaaagatatcgcgcagggcatggttaagctggatgccatgacggcggcaaacgcggtgacggtgatctccatcgctaacctgtctggtcgtctggtgctggggatcctgtccgataaaattgcccgcatccgtgtgattacccttggacaggtggtgtcgctgctgaccttctttgcggcgattgcctgtgtggcctttaacttcggcggcaccattacggtgttcccgtcactggtgagcgagttctttggtctgaataatctggcgaaaaactacggcgttatctatctgggctttgggattggcagtatctgtggctcgctgattgcttccctgttcggtgggttctatgtgaccttctgcgtgattttcgctctgctgattatctccctggcgctctctaccacgattcgccaaccgcagcgtgaagttttcaaagaagttcatgcgtaa

SEQ ID NO: 51114 - DNA, 486 bp, Glycine max
  Peptide Sequence Number=SeqID_142799
atgtgggcctttcataccggtcaacaaattgattgggcacatctagcccagtatcgcatgcataaggcattgcgattaaatgctcctttgccttatcctcacttagttaccttgttccttcaacattttaacatccctcttgattttgaaccttatgttccaatcaagagatctttcttgatcagtgttgcagtggttgcctcctttggttatcgcaaagagcgtgatggctcttgggtaaaaaagggtgctcaaccaaatgatgatgaaggacacttaccggttgaaggagactcttctctccttcagagtattttggataggtttgatggacttcaaacctatgttggtgagaggtttgactccttggaacgtcaagtggagacactattcgaggagatgaactcaaggattgcaaaggttgaagaagatatcaccatcattcgcgactgctttgatttgcctccatcgccaccatcagtttag

SEQ ID NO: 51115 - DNA, 267 bp, Glycine max
  Peptide Sequence Number=SeqID_142800
atgtcaaatcataaaagcactgagtcagcactgaagaactttgaggtccaggtgggacaactggcgaagcagttagctgacaagtcatccaacagatttgtggcaaatacagaaaagaatcccatggaggaatgcaaagttgtgatgacaaggaataagaggtttttggaggctgaggatgaggagagtgttgtgcacaagaagagagctgctgaaaagaaaggtactgatggcaagaaaaatgatgtgagaggtgaaagccattag

SEQ ID NO: 51116 - DNA, 252 bp, Glycine max
  Peptide Sequence Number=SeqID_142801
atggatggattcatggaaccgatgaaacaacataatttggaaatgttgggtctgcgagcgaggcgaggctctcgggtgcgttttccaaaggaggaaaaatgcgcggagtcgccaccaacatttatttgtggaaaacgtcggaaaaaccgaaggaaaccggtcataaagaatattccagattcgggagttgtatttatgtttgaggaaggtattagcacctctcacgtttgtcccaaaggacaacaaccttaa

SEQ ID NO: 51117 - DNA, 216 bp, Glycine max
  Peptide Sequence Number=SeqID_142802
atggatgggttcattggggacatatgccatatgggcatgctatggccagcaagatccttagagcaggttattcactggctcactatggaaagcgattgttgcacccatgaaaatcttactgacaagctggcaccaatcgtgaataacaaaatgatgcaggaaaccgtgcgaggatttcaagactccagcatcataactccaccccctatcggttga

SEQ ID NO: 51118 - DNA, 543 bp, Glycine max
  Peptide Sequence Number=SeqID_142803
atggtctcccgtggcggaggcgaaagggacgaatgtttgtttcacctcggggagtcgcacgacatggaaacctgtcccgcggtagaagaattgcttcagcggctcatggattgcgggcagcttgaagtgtccataggagggagggaagaaccacaagtttgcatgcaggcggaagagaagaaggttcctctaacccccaaggccctagtgatatgttttactaggaaagggaccggctccacacccatatacccccggacagcacccaagccaacgccatatgcatatcaaagtaataaggccgttccgtggaagtatacccctcccgcgttcagcgaaaaagttgcaaccgaagttgactccctgtcagctaaggtgaccaacatcaccggcctcagtggcgtaacccgcagtggtcgggtgttcgcttcccctcacccggcggagttgccctccaaggggaaagtgcccatggtccaagagcccacagacgtagccaccccctcgaaagaagtagatcctccagtggtaagaggggactga

SEQ ID NO: 51119 - DNA, 387 bp, Glycine max
  Peptide Sequence Number=SeqID_142804
atgggaacaaatcaaactggaaaaaggttctatcaagtcaagattaaaggcctagatgttaccagccttaaggagttggggcggttgatgggacctctccaaatgcaagccttccgcaaggcgtacggaaagattttagatttgaccatagcagagatattcacggaagccattgtatcactcacccaatactatgaccagcctttgagatgcttcacatttggagacttccaattaggattcggaaagagagttggatcgtgtaaagcaaaatcgaaacggcatagtgggcctaccacgaaattacttaaaaggcaaggcaagggatatggcgaatcaagaggagtgggtcccgtttatggacgtattagcattgctaatctttag

SEQ ID NO: 51120 - DNA, 531 bp, Glycine max
  Peptide Sequence Number=SeqID_142805
gactcgttacaagaacaaacgacacaaggtagttttgttccccatggtcatgatgacatacttaatattgccattgcgcgaccagaacatccaggtcgtgttcgtgtagcggggtctggtatgacaatcagtcaatactatggaagggcatcatgtggctccagtagttcctctacatcaatcacccaacaacagttggctgagataattggaagccttaaagaagagtacatgaatgagattatcagaaacccgaaggaagaagtcaggaatgagattgaagaagaaaacaagggatcacagtactcacccctgattgaggcagagatacaagcattaggtgcacgtgttagcacaaaagggagcaatgttgaaactgttgtgaacccatcaggcgaagaacatgatggtcatgccatatcgactatggggttatatgtgcaacgtgaaaattgtacacacttggtggccttgggaaaaatatatgaaggggggtctagcattcccaacatggcttatgcgaatgatgtg

SEQ ID NO: 51121 - DNA, 429 bp, Glycine max
  Peptide Sequence Number=SeqID_142806
atgttaggatttacacgtgattctcctcaaatttcagccagcctgcatcaattagaccttgcaccttatgctccagagccctacaatgctcaatggaacgccccggggcttctccgtgacaagcacacgttgcgttcgagtcgtattctcggagaaatggaggttgatgaaccttggctagggttatggctaccattgaattatcaagtagatatgggatcaagtttagcatatgacaacggaatttggggtgaaccctataggctttttgctgcaaaattcctttttattacaggctttgtggttgatttagggatggcctttgtggataactgggtggtgggtaaggaggaggaatggcagttacagcatgggtttctccctcatcctcaccctcttcatttgccccagttttctcagtcgtcctag

SEQ ID NO: 51122 - DNA, 370 bp, Glycine max
  Peptide Sequence Number=SeqID_142807
atgttgctaagtagcaatgtcatctatatctgtgtaagagtggtcatgttggtgcgcatgatccgcactcgtctctttgcagcggcacgggtgaaatcttgccctggtatgcatagtagctgtgtgatagcctccctctctggttgtgctcgcacagttggccctcctccaatatcagggggtggcccaggaaccgtgagggcgtgcaaccctctcaaggcgaggaggtgtagtcctctggaggtgagggcgtgcagccctctgctggcgaggacgtgtagtcctttcaaggtgagggcatgcaaccctctgagggtgaggacgtgtagtcctctcaaggcgaggacgtatagtcctctcaacggtgagg

SEQ ID NO: 51123 - DNA, 306 bp, Glycine max
  Peptide Sequence Number=SeqID_142808
atgggaagatgtccattggaagaggagttttcagacattacctactctcaatgcacacctaacaccacaataaaccatgatgtttttatgaggagccaagtcatttttataggtagccaagtggaaggctatacgtcaccttcctctagtgaaagtatgaagaagcctcaggatttaaggggtcaaaatcctttcaaggtgagggatgatgcaatcctaccccccaagggtatggatagaagactcaaagaggcttggctagagctactaaagagaggcccaagggttctcataaccttagggtag

SEQ ID NO: 51124 - DNA, 534 bp, Glycine max
  Peptide Sequence Number=SeqID_142809
atgaccatgattacgccaagctcgaaattaaccctcactaaagggaacaaaagctgcaagcagaccgtggtggtcaagctgcgcatagacacacccatcgaggtggactattaccggcacggcggcatcctgccgtacgttctcaggcagctccttgaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 51125 - DNA, 381 bp, Glycine max
  Peptide Sequence Number=SeqID_142810
atggctactcaattgaaccaagctcagtcccaaaattctgacaaattgccttcacaaactatgcaaaatccaaaaaatgtgagtgccatcaccttgaggtctggcaagcaaattggagtgcctccactaataacagcacctgcacctgaacctgtcaagcttcattctacacctgaaaaagaggatgagatagttgcacaaaagagaaagctttttgatcatgagggagctaacaaaaaatttcatgcaggtggaccttcttctaatagttctgacttgcagcagcctcctatccctcttccatttccacctagagaaattccaaacaaaaagatggaagaagtggataaggagatcttggagaccttcaagaaagtggag

SEQ ID NO: 51126 - DNA, 790 bp, Glycine max
  Peptide Sequence Number=SeqID_142811
atggcctggcggcctcgccatgatgtggctggcggcggcgggagcgatgatctgcgtcacgacattggcgtggtgggcgacgcgccggctggcgccagccttgcggcgctaccgcgagcgctacacgcgggatgcgggcctgcggttcacggaactgttcctgttcgtcgaacccacccggctctgggcctgcgcggtgacgttggcgctgctggcggcaatgtcggccttcgcgctcacggcgagcggcatggccgccgttggaacgggcgtggcggcattgcgggcgccggccatgctggcgggcctgttgcgacgtcggcgggtgcggcgcttcgaacagcaattgcccatggccttgctgatgctggcgtcggccttgcgggcaggtgtcgccttgatgcccgctttgcggcaagtggtggcgcagggcggggcgccgctggcacaggagtttggcttgatgctgcgggaacagcggctcggcgtgccgtgggacgaggccctggcgcgcctgaacacgagaatgacggccgaatccacaaccctgatggtggcggccatgcgcaccgccgcgcagaccggtggcaacctggccgaagcgctcgacagcatcgcgcagacattgtttgccaggctgcagttgcaggccaggctgcggaccttgaccgcgcaggggcgcatgcaggcctggatcgtgggcgcgttgccggtgctgctgctgatcgcgctggatcgcctcgagccggacatcatgacgccgctctggcacacgcctgccgggtggacg

SEQ ID NO: 51127 - DNA, 833 bp, Glycine max
  Peptide Sequence Number=SeqID_142812
atggtgaaagttggaacctcttacgtgccgatcaacgtctcatgttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgaggattatgaacgtggtcttcgacttgagggccgatcttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 51128 - DNA, 300 bp, Glycine max
  Peptide Sequence Number=SeqID_142813
atgaaggaaaacagagagaaattggtgaactcaaactgggcatatcttggtatgaccaggcaaagatgtcttggtagttttttagcagggccatcaacttcttcacggatgggtgcgatcatacccatgtgcctatctttacttcctttttcccactgtcggttcctaagtccactagtttcgtctcttcttgatgaggccccatctcttggtcctcatgggcaaatatcttctccaactccgggggaagtcccacatcctcgtcctcttcactctccgtctagtctgcttcttgcttga

SEQ ID NO: 51129 - DNA, 432 bp, Glycine max
  Peptide Sequence Number=SeqID_142814
atgaacgcgctttacgacacccttatgataatggaggttgacatggaggccatgaaagaccaaatggccaccatgatggaggccatgttgagcatgaataaaataatggaggtcaacgtggctgtagttgccactacaagtgccgccactgagatagacccgtttcacccatccagtatgaatcaagtaagtcatccagccctgaacatggtaggacagggaggagaagcattgggaagtacgggcggtccccatgttgtgcaaagcaagaattttttcccaccatacagcttgcctcccaactatgcaacacccaatgttgtacatgtgcccaacgagaatgtcaaccaccccaatcttgttccccttgaaagccagcaaccccagttggggcatgcacattttgctcagtccctgggggggggcacgtga

SEQ ID NO: 51130 - DNA, 285 bp, Glycine max
  Peptide Sequence Number=SeqID_142815
atgtttgcttgcagtcttttcgctaagcgcacgcctcgcactaagtgcatctctgttcatgcgctaagctgcgagtctcacgcacttcgcgctcaatccttgcatctgaggctgatttggtccgctaagctggccaaggttgagccgtggctaagcgggacctattgtcgccaagtgcaattccttacggccataactaaggtcaatgaagctaagtgccagtcatggcagctaagcaagattcattgcggcaatataagcgttaagcgagtacctctcagctaa

SEQ ID NO: 51131 - DNA, 815 bp, Glycine max
  Peptide Sequence Number=SeqID_142816
aaaacaccgagactttttcaagtctcacaagttatccagaactacgtaggtctgagttcctcattggaggatacgtaggagcaagagcctcgcttttgtcgaccacaccgccttttgttgccatgactcaagagctggtagcccgcggagacaccttacggttatccgcacctcgtcattcagtgaccccaagtgtgattgatgagcagaggccaatgtggtcatctgcgcctttttcggagatgtcagcatttttcgatggagacttttcaagtctcacaagttatccagaactacgtaggtctgagttcctcattagaggatacacacagtcgtgttcgatggcacgcagagacaaattatggtcattctgcacccttttgtcatccagaggcgacgggcccgatgacatgcggagacaaattatggtcattccgcacccctttgccattcagacacagtcgtgtccgatggcacgcagagacaaattatggtcattctgcacccttttgtcatccagaggcggcgggcccgatgacatgcggagacaaattatggtcattccgcacccctttgccattcagacacagtcgtgtccgatggcacgcagagacaaattatggtcattctgcacccttttgtcatccagaggcggcgggcccgatgacatgcggagacaaattatggtcattctgcacccctttgccattcagacacagtcgtgtccgatggcacgcagagacaaattatggtcattctgcacccttttgtcatctagaggcggcgggcccgatgacatgcggagacaaattatg

SEQ ID NO: 51132 - DNA, 765 bp, Glycine max
  Peptide Sequence Number=SeqID_142817
ttggccaggcttcccggtatcaacagggacaccaggatttatttattcttgcgaagtgatcttccgtcacagtggcttcttgtttctatcagctgtccctcctgttcagctactgacgggggtggtgcgtaaacggcaaaaagcaccgccggacaatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgaattcgatcacaacactccacaacataaaaattaaaggcatacccattgcaaccacatgtatagaccccaaggatttggaaaaacttccccttaccttggttcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgaggaatatgtgatacaggatatattccggcttcctcgctcactgactcgctacgctcggtcgttcgactgcggcgagcggaaatggcttacgaacggggcggagatttcctggaagatgccaggaagatacttaacagggaa

SEQ ID NO: 51133 - DNA, 201 bp, Glycine max
  Peptide Sequence Number=SeqID_142818
atggcgggaaggattgtcagggaaggtgataataacgggctccagccggagcccgttgcgggaaatacacttactcgtcttcgagataggtgtagccgtaaagcccactctcaaactcttcaaggaactgcgcccgcagctcttcgtcaatatcctgctgctgttttacctgatcgcggaataacgtcatcagatcgttag

SEQ ID NO: 51134 - DNA, 666 bp, Glycine max
  Peptide Sequence Number=SeqID_142819
atggtgaaagttggaacctcttacgtgccgatcaacgtctcattttcgcaacaaaagttggcccatctgggttccggttatagcaacagggacaccggatttatttctcacagttctgcgaatgacttccgaagtcatcagccggaagcatcagcgctggcaagtgtaaagcctggggtgcctaagacgctgacgctaactcacattaattgcgttccgcgcttacactgcgccgctattccatcgggaaacgctgtcgtgccattcgctgcattacaggctgaatcgccaactgttgcgcgaagggcgatcggtgcgggctttgcgctattacgccagctggcgctaaaggcggatgtgctgcatactggcgattactatgttgggtacactgatgccagggtgttcccagtcagaagtgcgtctgtggcaggagaaaaaaggctgcaccggtccgcgaattcctcgctcactgagctcgctaccgctcggtcgttcgactgcggcgagcgctcagaactagtggcttatccccgaacgggctgcaggaattctggaatgctcagctcaggcaaacttaacaggaaatgccatgagacgggtcgcggcttaaagcacgaatttttccataggctccgcccccctgacaagcatcacgaaatctga

SEQ ID NO: 51135 - DNA, 307 bp, Glycine max
  Peptide Sequence Number=SeqID_142820
atggagaaatcagaaaagaaaaattttagtgaaaagaaaatgaagaaagcgtacatcacatgggaagacaatgatatggaatcttctgaagattcagaaaatgaagagataaacctctgtctaatggctaaaagttatgaaagcgatgaagaggtgtccttgaggaaggaatggtacatagatagcggatgttcaaaacatatgactagagatgcatcaaagtttacacatatctctcccaagaaaagcgggcatgtaacttatggtgacaacaacaaaggtagaatccttggagttggtaaaatag

SEQ ID NO: 51136 - DNA, 498 bp, Glycine max
  Peptide Sequence Number=SeqID_142821
atgatcaataggaaacatatcatgcagcagaaacgacatcctcatgctcagtcattgattgtgtctgattcatcagaaagtgtaaattccgaatccacacaaggttcaggctctaattttttaactacctatgaggattgtcaatctccaactaatcagcctgtaatcaacactgaagataccagagcacatgctcttagattaatattcacaattgttatcgtcatattgtactatggtattaaacaatttcaggatattctgatcttggtgatcaactcatgcaatgtagatattgtaatgcacaaatgtggtatgatgaaagaatatcaaaagataaaaattgtgggagtccaaggttcagcttatgctgtggagatggcaaagttaaactgccattattacaaaattcaccccaatatctccaacaacttttgtttgatgataatacaattgatagtaaaaattatcaacataacttatgagcatacaacatga

SEQ ID NO: 51137 - DNA, 221 bp, Glycine max
  Peptide Sequence Number=SeqID_142822
atggaaggaagtccctactgctcagaaggatttgatatgagaggatattcagccgacaacgacagtgtggatgacactgtttttgaaaaatacgacattagtaaggagaaatgggcccagctttatcagacccgtagagacccctcgtgggaggatgtgcggaaaaaggcacaggccatccagaagcaaaacaccacccccccacgtgttgtctcgtgggg

SEQ ID NO: 51138 - DNA, 440 bp, Glycine max
  Peptide Sequence Number=SeqID_142823
atggagagaagtatgatagatgctgccaatggtggagcccttggagacatgacccctgttgaagccagaaatttaattgagaagatggcttccaactcccagcaattcagtgtcagaaatgatgctattgccattagaggagtgcatgaagtagccacgaattcatcttcattaggtgagactaagaagcttgaaggtaaactagatgccttagttaacctggtaacccaactggccatgaatcaaaaatctgcacctgtcgccagactctgtggtttatgctcctctgccaaccaccacacagacctttgcccttctatgcaacaatctgaagcaattgaacagcctgaagcttatgctacaaacatctacaacagacctcctcaacctcagcagcaaaatcaaccacaacagaacaattatgacctctcaagcaacac

SEQ ID NO: 51139 - DNA, 390 bp, Glycine max
  Peptide Sequence Number=SeqID_142824
atggtgaaagttggaacctcttacgtgccgatcaacgtctcatttggggtcgccaaaagttggcccaataggagcattcccgtatcaacaaatctcgctggcataccaggatttacggttttctatgcgaagcttgatcgataccgtcacctcaggtgctccagtggcgtatcatggtttctatcagctgtcccttcctgttcagctactgacaattgtgtatccgcgtcacaattcggcacacaagcatacgagccggaagcatcagcgctggcaagtgtagcctggggtgcacaggctgcagctaactcaccacccgccgcgcttaattgcttgccgctacagggcgcgtccgcattctccagtcaggaacctgcggcaactgcttaa

SEQ ID NO: 51140 - DNA, 342 bp, Glycine max
  Peptide Sequence Number=SeqID_142825
atgtccaaatcttgtggatttgggatgaccggccctctcgatgagtcgatctcttgctttctcataagggtggacccttgggtacttgtacctatcacttttagaggactacacgtcctcgccaacagagggctgcacgccctcaccttcagaggactacatgtcctcgccttgacagggctacacgccctcatcttggttaccctcaccgttgagaggactacacgtcctcgccttgagaggactacacgtcctcaccatcagagggttgcacgccctcacctccagaggactacatgtcctcgccttgagagggctacacgtcctcaccttgggtactag

SEQ ID NO: 51141 - DNA, 522 bp, Glycine max
  Peptide Sequence Number=SeqID_142826
atggtgaaagttggaacctcttacgtgccgatcacggagcgcttcattttcagccaaaagttgcgcccagccagtattgcagcaggccgggggcgtccgggcgcaggcatcaagcttatttttcgaatgattccgtcgacctcagtgctccagtggcgtatctggtttctatcagctgtccctcctgttcagctactgaaacggggtggtgttatcgtcaacgcaaaagcactacagccggaacatcagcgcggcaagtgtagccggggtgcacagctgcagctaaccaccacacccgccggcttaatgcttgccgctacagggcgcgtgcccattcgccattcaggctgcgcaactgttcgggaaggcctgatcggtgcgggcctcttcgctattaatgaatcggccaacgcggcgaaaggggagatgtgctgcaagtttgcgataagttgggtaacgctagcaggagttatactggcttaccatgttggcactgacgttgtaaaacgacggcgtcagtga

SEQ ID NO: 51142 - DNA, 68 bp, Glycine max
  Peptide Sequence Number=SeqID_142827
atggaacatacggatttggggatcccacggtccggtggctctgcatgccactggactcttgggacatg

SEQ ID NO: 51143 - DNA, 641 bp, Glycine max
  Peptide Sequence Number=SeqID_142828
atgggatcaagtcaaatgccttcgcttaaaaagaagttctatcaagtcaaggttaagagcctaaggatcaccagtctaaaagagttagggcagttgatgggtcagctccagtggcaagcttttcgcaaagcttacggtaaaatctgggacctcgccatggtagaagtctctacagaggccattgcttccctcgcccagtattatgatcagccattgaggtgtttcacctttggggacttccagctatcacctatggtagaagaatttgaagagatcctaggatgtcctctagggggaaggagaccatacctcttctcagggttctatccctcattagctagaatttataagatagtccaaatctcggcgcaggaattagaccacagaaagcaagtcgaaaatggggtggttggaataccgagaaaatatttggaggaaaaagcaagaatcttggcaggtaaaggcgaatgggccccgttcatagacattctcgcactgttgatcttcggaggagtcctctttctgaatgtggatgggttggtggacctagcagcgatcgacgcttttctcgtctatcatgaccacaaggaaagcccggttgtcgctatgctagccaacctatatgacaccttcgaccgaag

SEQ ID NO: 51144 - DNA, 312 bp, Glycine max
  Peptide Sequence Number=SeqID_142829
atgcctcgacatgttgatgcagatgaaggttcttcatcttctcctcccatatcaattttcaattacccaagaagtgcgagtgctaaatccaaaacatattttttggaccaagttgatcttcatattcctcacttgtacgttattcaaaattgtccaaaggttgagccaaatttagaatatactaaagcatatgacccattcatatttgcacaacaagcagaacaagtttattacacaacatatcccgaggaacatcgaggatggttagccataataaagataaaagctcgtagaagaatcactaacaatata

SEQ ID NO: 51145 - DNA, 456 bp, Glycine max
  Peptide Sequence Number=SeqID_142830
atgaccatgattacgccaagctcgaaattaaccctcactaaagggaacaaaagctggtaccgggccccccctcgagcacaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 51146 - DNA, 507 bp, Glycine max
  Peptide Sequence Number=SeqID_142831
atgttagccatcatcaacaagtaccaagaagaattagatctagccacgacccacgagcacaaagtggcggacgagtatgcccgagtgtacgctgaaaaggaggctagaggaaggttaattgactcgttacatcaagaggcaacaatgtggatggaccgatttgctcttactatgaatgggagtcaggaacttccccgattgctagccaaggccaaagcaatggcagacacctactccgcccctgaggagatccacagacttctcagctattgccaacatatgatagatagaaacgcgaagaactggaactggagatgcggcacgcaaaccgaggcaggatttcagcatccaaaaaggtccagttttttttcttcttttatggctgagtatgtggtcaagtcaaaggagcctacctctacctcgtgggaccttcaatttcaggtaagggtggacttctcctcacttgaaatctgtgggcgttgggttcttgggagctataatgggtag

SEQ ID NO: 51147 - DNA, 273 bp, Glycine max
  Peptide Sequence Number=SeqID_142832
atgggctacgccataaatagtttccttacacctagatgtttagaaattttgttcatcgtgaacatgaaatggccccaaggaagcttgcctcaaagagatccaggaaagacaaggcggttgaaggaaccagttccgctcccgaatatgacagccatcgttttaggagcgctgagcactagcaacgcttcgaggccatcaaaggatggtcattccttcgggaaagatgtgtccagctcagggacgacgagtatactgacttccaggaagagatag

SEQ ID NO: 51148 - DNA, 264 bp, Glycine max
  Peptide Sequence Number=SeqID_142833
atgccactgaagggcaagcagttggtggtatacccatgccaaacactttggagggccctcagtatcacccacaaccacactctcacagcgggaactcatgagcctcttccaaggtcaccgcctttccttgaagaccttctttcttttcagttccttttaccaccgggggatccacttcttttgagggggtggccgtgtctgcgggctcttggatcatgggtgctttccccttggagggcaattccgccaagtgagggggagtga

SEQ ID NO: 51149 - DNA, 297 bp, Glycine max
  Peptide Sequence Number=SeqID_142834
atgcaaagaagatctactgcaagtgatttgatccccatcgatttggagattaacgctacttgcaaaaggcgcaatgcagagagaattagaaattttttgcaggacttagaagcagtaacaactccagaagaagaacctcgatcttccgaggcatcttctagctttcctattccagggcaatctcatatagatttgattgaagaagttatcatggctgaagagccaaggagagtgaccttagaagattactcaagttcaagtgtgctgcaatttttcaccagcattgcacaaccagag

SEQ ID NO: 51150 - DNA, 381 bp, Glycine max
  Peptide Sequence Number=SeqID_142835
atgattcctttcacctcttcggagcttgagcttactattgctgcccctataaagcccctcaaaactttgcttgcacgtgttcttcctttcgggctttcttggtttctcgttccaaggcttcagctgtggcccatattgacgtcccttagttcatcatactcttttcagactttgatggctatggacttgaacttctcttcgactacccgggctctttcaagatctgcctttagggcttccgccgatgatcccattactgcttcccctaagctctctgtcctttcttcacgccgcatcccatgccttgcgaactccttggagtaccctcgcgttgtggtcactgaaaccccgtgcgatgaaaggcgtgatgctttcatctga

SEQ ID NO: 51151 - DNA, 400 bp, Glycine max
  Peptide Sequence Number=SeqID_142836
atttccctcgctgatcacaggactctgccagtcattcggagtccccgttgcacctaccaaggtaattcggccgcccatcacccgagcttttattgagaattactgtacccagagacaggctcagggtgatgctccacaggccgcaggcacgccaccaccacctcatcaggctggccaggctggggcatttgacatggagcagtatttacgacatttggttcgccaacaggcggccaaccaccgagcacatttcagggcagaggttgcatggcccggagattggcccaaggcccaagcgggagaggcgcccccagaagctcccggcgatggagaagaggcccacgaggacgaggagatggccgatttgcttgacttcttgggagggagtggagatacatga

SEQ ID NO: 51152 - DNA, 390 bp, Glycine max
  Peptide Sequence Number=SeqID_142837
atgggcaacgtcgtgccgacgtcacccagagcgagctgcgtgctgcagccacgtgcgtcgagcgtatacgcccaatcgttgccgccatggttgcagcacacgcgcattgcgacccgaggcgatctacacgcaaccccagcggcgcctcctgcgcgaactgctggtgggcctgctgcgcagcgcactccagtgaatgccgatccagctggtcatcgactctgggacaacctggacgtgccgaatccgaacgcagggatcggcgcgcgcgctcgccggacccgccggatcaggaaccccccgtcgcccaacggggtgatctcgttgccgtaccgcggcgacgcagggtcgaggattgcggcgtgcccagcaccagggcatggtcagtactga

SEQ ID NO: 51153 - DNA, 567 bp, Glycine max
  Peptide Sequence Number=SeqID_142838
atggttattatattgacacatgccagaataaaagatgcgcagggaagttatccagcttcagtgagcaattctttcaaggcatcaaaactattgattaatgatcctatattggaaattcaggaatttaaagagaggcttttagatttaggtgttgaggtgagtccagttttaatacctggcgatcaagcaagttcacaagtttcagggggaagccagctatcatcaaaggattcgtttctttcaaaagctgaagtcaaaactatttttgagatcaatggcatttttgaggacgttgtttgtgttacggtggggactattagcaaaatagtcatggataaccattcatggtgttatccagcttgtgttcaatgtcataggaaaactaacatccaaacaggaccattcacatgcagatgtggcaaggataatgatcaacctgttctgaggtatagagttgaagtcatggttacccaaaacaatgagagtaataagtttttgctctgggaccgtgaatgtgctgaattgattggtgaaacagctgatgatgtgaatagggtcaagattgaa

SEQ ID NO: 51154 - DNA, 408 bp, Glycine max
  Peptide Sequence Number=SeqID_142839
caaaagaatgtttatacggataaccactcgggtatttccgcccgtcagcgtgactcaaatgtcagtatgacagatcttgtgagagcggaagatgacgtaaatctccgtgtgtcaacgggcttgttggtcgcgattgacgaaggacgcagaatgaccataatttgtctctgcgtgccatcggacacaactgtgtctgaatggcaaaaagacacaactgtgtctgaatggcaaaagctcttgctcctacgtatcctcggacctacgacttgtgatctgaaaatctccggaaaggggtgcggaatgaccataatttggcctctgcatgtcacacgggcccgccgcctctggaatgacgaggtgcggataaccgtaaggcgtctctgcgggctactagctcttggggtcatg

SEQ ID NO: 51155 - DNA, 204 bp, Glycine max
  Peptide Sequence Number=SeqID_142840
atggatgagaggagaaggaaactgttgcaagacagaacaattgcgtccattcttgaggaggagacttatttttctgattcattatcacctgattcaccatcatcaagggaatctgctaatcaacattctaaaactactaccatggcagatgagcatgatcagaggactacccttgaggactattcaagtggctctgtaccataa

SEQ ID NO: 51156 - DNA, 774 bp, Glycine max
  Peptide Sequence Number=SeqID_142841
atggtgaaagttggaacctcttacgtgccgatcaacgtctcattttcgccaaaagttggcccagggcttcccggtatcaacgactacagcagatttagtttatactctgctggaaggatacacattccgatcacaggtatcttattggcgcaataccgtgcgcctcgaggggtgatgctgccggtaccacttattgatttagtgtatgatggtgttaatttcgaggtgctccagtggcgtatcatgttgtcatcagctgtcccttcctgttcagctactgacaattgtggtatccgcgtcacaatcgcacacaagcatacgacgccggaagcatcagcgctggcaagtgtaaagcctggggtgccaagacgtgcagctaaccactcacacccgccgcgcttaattgcgttgccgctacagggctgcccgcattcgtccatgtcaggaacctgtcggccaactgcattaatgaatcggccaacgcgcgggcgatcgagtgcgggcctcttgcgtattacgccagctggcgaaagggcggatgtgctgcatactggcgattactatgttgggtacactgatgccagggtgttcccagtcagaatgcgttctgtggcaggagaaaaaagctgcaccggtgcgtcagtcagaatatgtgaatacaggactcactatagggcgaattggagctcaccgcggtggtcggctcgctcagaactgactcgctacgctcggtcggattcgactgcggcgagcggaatggttacaacggtatag

SEQ ID NO: 51157 - DNA, 438 bp, Glycine max
  Peptide Sequence Number=SeqID_142842
cctaaggttggtccctcagctgctcgtgtcagcacaaaggggagttgtgttgatccctcaccaactgatcatgacacgggtgactcagacaaatgcgggttgtacatcgaagaaaatccttcccgtctagttgccttaggaagaatttatgagggatcaatagcggttcacaacatccctttgttgcatggccaagtgaaggttggtgttgaggaggttaaagatgcagaggctctcgttcctgtacccactgacgagatagttgtgtctctagcaaaacctatagatgggccgaatcctcaggttatgtgggatgctaccgtgttcgaggtgtttaatgaacacttcccgttgtacataaggcacaaagatttgtctgaaattgcacacggtagtcaatgtctcagcatatttgttaaacagttgtggattctataa

SEQ ID NO: 51158 - DNA, 192 bp, Glycine max
  Peptide Sequence Number=SeqID_142843
atggagcaggacaagtttcgaagggctctgtggggtagcagttacgagctcaagcttagaaaggctgagagggacaaatcaaggatcgaaagcatggtgttagaggacaagttaaaggcttgtcaaagagccaaggcagtggctgacacgtactcagctcctgacgaagttcacgatctttttgattactga

SEQ ID NO: 51159 - DNA, 582 bp, Glycine max
  Peptide Sequence Number=SeqID_142844
atggaaactcaaaatacccacaaaaacagcagtgtccacttggaggctacttcgggatatttacaaaaagcaaaacttagaaggagacaaataccgatagatgatatgctatgtcctttatgcagaaataaggaggagggggctgaacacttgttcttcaattgtagcaaaaccctccctttatggtgggaatcaatgtcctgggttaatcttatcactgtaatgccacaaaatcatagggaccattttctgcaacatggaatggaggtagcagatggagtcaggtccaaaacctggaaatgctggtggattgctttaacttggacaatatggcaccatagaaataaggtggtgttccaagatacaacttttcatggaatcaaactgttagaagatgccttattcctactatggtcatggatcaaagcaatggacaaggattttactcttcattttaaccaatggtcctctaatcttaaggaagaagaacacaataagggtaagggaaacttcattaaggagaagaagcacaaagttgtcacgatgctcgagttaaatatgagataccctatccatgtttag

SEQ ID NO: 51160 - DNA, 174 bp, Glycine max
  Peptide Sequence Number=SeqID_142845
atggctcctaataagatttgtgaaggctgcatttatggcaagatgcacaggttaccatttccaaaaacatcttggagagctaaagctccacttcaattggtgcatgctgatatctggggaccatcaagtatccccagattttggtggaagacgatattttctcctcttcgttga

SEQ ID NO: 51161 - DNA, 561 bp, Glycine max
  Peptide Sequence Number=SeqID_142846
atgacacacgacctcaccatcagagggatgcacgccctaaccttcagaggactgcacgtcctcgccttcagaggactacacgtcctcgccttcagagggctgcacgtcctcaccttcagaggactgcacgtcctcaccttcagaggactagacgtcctcgcctttagaggactacacgtcctcgccattagagggctgcacgccctcaccttcaaaggactacacagggctgcacgtcctcaccatctgagggctacacgccctcaccttcagaggactgcacgtccttgccttcagaggactacacgtcctcgccttcagagggctgcacgccctcaccatcagaggactacacgtcctcaccatcagagggctgcatgccctcaccttcaaaggactacacgccctcgccttcagaggactactcgtccacgccatcagagggctgcacatcctcaccatcagagggctgcacgtcctcaccttcagagggctgcacgtcttcgccttcagaggactacacgtactcaccttcagagggctgcacgccctcgcctttag

SEQ ID NO: 51162 - DNA, 489 bp, Glycine max
  Peptide Sequence Number=SeqID_142847
atgcgggggaactcgcctgcctcctctagcgatacttctttcttgccacagtcatcccttttctccgaaagacctttcactggaatatcctcgttcggagtgagggtcatcttgtcattttgttcttccaccatctttgccttccctttaacatttgcgggttgtgtcggcaggtcgtggggtgcaaacacgcgaccgttgtgggtcacgccgctccgccccgtgatattggttaccttggctgacaatgagctgatgtcggtggcctcttccttcctttcgcttagaggtgcatacctccacggaactgcgtggctgtttcggtatggaaatggaacaggtttcactaccaaggggtatcggggcttttgtggagctgcgtcttatggtgaaatatatcaccaaaggtttaggcctcccaaaacttctttcatctgcgaagtgcatacatatatgttgctcttccctccccttatcgccgacttctag

SEQ ID NO: 51163 - DNA, 108 bp, Glycine max
  Peptide Sequence Number=SeqID_142848
atggaaaagggatatgctgctgctagtgaagttgggcaggttcatttgcgaatgaggaagatgctactggttgaggtccttgatattgctttcccgacctcaatgtaa

SEQ ID NO: 51164 - DNA, 366 bp, Glycine max
  Peptide Sequence Number=SeqID_142849
atgacaccttcgaccgaagatgtgaaaagagcaatacaaggattgtttgttgtactccagctctttatgtatgagaaaggagggccaaattgggaccaactcttagcaagcaaagaaggagcatctgtcaacttgttccctcgatggaaggaaggaagaaccggggttcttatttcatgcggaggatttccaaatgttcccttgatggggacgaggggttgcatcagctacaatctcgttcttgctataagacaacttggctaccctatgagaggggcgccactagaggatgagctcgcgcctgtcatttcacgaggcttcaataagaccaacatggagacacttcagaaggtccgcaaggcatga

SEQ ID NO: 51165 - DNA, 132 bp, Glycine max
  Peptide Sequence Number=SeqID_142850
atgcgtttcagatcgaagaagaaaccgaccgacaccattgagcaggtcaaagacagttcaaccgcgcatgtcgatcgggaagcgaaagcccgccgcgcgaagaaagagatggttgaggccaacctgcgtctg

SEQ ID NO: 51166 - DNA, 567 bp, Glycine max
  Peptide Sequence Number=SeqID_142851
atggaggtatttacggaagccattgtatccctcgcccaatactatgaccagccgttgagatgcttcacgtttggggacttccaaatagcaccgactgttgaagaatttgaggagattttaggatgccctcttgggggaagaaaaccgtatcttttctctgggtttcttccctccttgagcaagattgtagctgtgatcagagattcggcgagagagttaaatcgtataaagcaaactcgaagcggcgtagtgtgcctgccgcggaaatacttggaaggcaaggcaagagatatggcgagtcaagaagagtgggtcccatttgcggatatactagctttgctgatctttggggttgtcatctttccaaacgtggacggtttggtggacctatccgtaattgatgctttccttgcttatgaccatagcaaggagagcccggtggtagctatcttggcgacttatttgatacatttgaccgaaggtgcgagaagaacagcgcacggattgtctgctacttaccctctctttgtgtgtggttggtttcgcacctattccaacaagacataa

SEQ ID NO: 51167 - DNA, 258 bp, Glycine max
  Peptide Sequence Number=SeqID_142852
atggcagcactgcataattctcttactgtcatgccatccgtaagatgcttttctgtgactggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactga

SEQ ID NO: 51168 - DNA, 525 bp, Glycine max
  Peptide Sequence Number=SeqID_142853
atggtcttaaaggaggagttagctgcttgctcaagatccaagaggagtttggcccaacacttagaagccacggagcaaagcatgctagctataatagggcagtacaaagaggagttaaaccagtctttggctcatgagcaaaagctagtagaagacttcgcacgagcatacaccgagaaggaggcaagaggaagggtgattgatgcattacctcaagaagcgaccatgtggatggataggaaactcaccataactaaaaaagcgcaaaggcacccctataacacccgatccaaaagtaagatgggtaacgaagagggagtgcaagaacagatgaaggccgacatgtcggctttaaaagatcagatggcttctatgacggaagccatgctaaaaattcaaaaatcaatagaagacaatcctacggcggccgcttccaacacaactagggaagcggaacccggtgctacagcccgcaatgaactcgtgccgggacagaagcgcggtgggtttcaatcggaggtatag

SEQ ID NO: 51169 - DNA, 402 bp, Glycine max
  Peptide Sequence Number=SeqID_142854
atgggtaaagtagaggaggcgcaagagcagatgaaggtcgacatggaggccacgaaagagcaaatggacacaatgatggaggccatgatgagcatgaagaagataatggaagccaatgcagttgcagttgccgctaccagcgctgttgctaaggtgaacccgatgcccccatttggcctcaaccaaatgaatcatccaacctcagctagggtaggcaaagatttggaaagtacgggcgacccccattatgcgcaaattcaaaacaagcatgccttcccaccatatggcttgcctcccaactatacacaacccaatgtggcatacattcccaatgaggatgtcaataactccgctcccatactcattgagagccgacaacctcatcatgcacatgtattttaa

SEQ ID NO: 51170 - DNA, 96 bp, Glycine max
  Peptide Sequence Number=SeqID_142855
atggaggttgaggaaccttggcaggggttatggctaccattgcattatcaagtggtgttcgtcatcgaaagtgcggtagacaggctttgtggttga

SEQ ID NO: 51171 - DNA, 293 bp, Glycine max
  Peptide Sequence Number=SeqID_142856
ccaattcatattgttgttgaggttatacgaaccggctctccacgcaatcaagagaatgttgctgctgtcttgtggtcactatgcaccggagatccactgcaattaaaactagcgaaagaacatggtgcagaagcagcactgcaggagttgtcagaaaatggaactgatagagctaagataaaagatggaagcatattggaactcttgcagcgaatggaagggggacctgctatcaagtcagcagcaacaacagaaccaagtagtcaaaacggaaagaaattggaaggtgggag

SEQ ID NO: 51172 - DNA, 120 bp, Glycine max
  Peptide Sequence Number=SeqID_142857
atgtgggtgtcgagggagcggcttctggcagatttcaggcgggaggagaaagagaacaacgatttcaggcaggaggatgacaaagagaagagggaggacaagttaacatcggttttgtaa

SEQ ID NO: 51173 - DNA, 324 bp, Glycine max
  Peptide Sequence Number=SeqID_142858
atgggggagacacatgaaattccccaccacaatctagctgacttcgagccttggctcggatatgccattgaagggcaagcagttgatggtataccctttgaaaacactttggagagccctcagtttcgcccacaacaacaaccattgcattttgcggtgggaagagcccctcctgctatggcaaaaatgggaaagaggaaaggctcagggccattgaaggaggtgctggactttgacaagtacaagggggctacttgccccaagaaccatccaaagatgtattgtcggaagataagggcatacgcaaagatgagaaactgctga

SEQ ID NO: 51174 - DNA, 243 bp, Glycine max
  Peptide Sequence Number=SeqID_142859
atggaattgcaagtggacatgcggttcgatgccatggaatcaaggatcaccaaggttgaagaagatgtctccttcatcccttgtcctgatttcagggattgtcatcatcaaaaaaggggagattgcagacaaaggatcaagctgaatgttttgatgatgccaaaggatcacatgcttctcaaagctttattcaagacaaagaaattaaagatattcaagatgaatgatcaagacagtctctag

SEQ ID NO: 51175 - DNA, 126 bp, Glycine max
  Peptide Sequence Number=SeqID_142860
atggaggttgatgaaccttggttggggttatggctcccattgaattatcaagtagatatgggagcaaactttgtggttgatttagggatggcctttgtcgataactgggcggtgggtaaggagaag

SEQ ID NO: 51176 - DNA, 346 bp, Glycine max
  Peptide Sequence Number=SeqID_142861
atgaagaacagaatcaaaatcaaacatataatcatcaacaatctgatcaattatctcagcacaaaaaatagaatgatcctcagatggatgtttcatggcatcaagaatgttaaaatgaacaacaatatcaccaaattccatagacaatgtgccagcataaacatctatcttgaaagtacctgggtccttacatttctcaggaatgtgaggaacaaatttacctacaatgctgacacatttctacccatgctaatcctttcatcgcctttgagcttccttttgtgggtgcagaactcctttagaaacttggcatatcttggaatctgcttgatggcatctagcagag

SEQ ID NO: 51177 - DNA, 567 bp, Glycine max
  Peptide Sequence Number=SeqID_142862
atggaaaacatttccaagtggtttcaagaacttgatgtttatggcaaagttactctaaagattaaactccgggaaattgcctaccctgatctaaactctatgtgtcgtcctccagaaaaggtcaacaccgaagttaaacatattgcatcatcatctaaccaagcaattccaaaaaggactatgccgatgttggatcaatttcatttatgcattcatgattccattaaaaacattgtcgatgtcaaagctgacggtaactatggatatcgtgcaattgctaccatattaggtatgggtgaagattcatggtctttggtgcgcaaccatttgcttaaagaactttccaaatggtctgatgagtatatcaacctcccatgtggcatagacttatttgaggaattaaagcgatccctacttgttgatggattatccatggttaccatggataagtggatgaatataaccgacatgagatatgtcattgcatcaagaagtcaaccaccaatagattcttctatgcactgcgtaatatgtatcggtcatgtgtatgacaatcattttgttcag

SEQ ID NO: 51178 - DNA, 502 bp, Glycine max
  Peptide Sequence Number=SeqID_142863
cgctgttcatgtgtcctccactttcgagtttggagctgtgtttcatgattgcctaagtgcggaccctcaaggcaatcctccattctcccctttttcgaagccccatgaatgttattgcctagcgctgttcatgtgtcctccattatcaagcgtgaagcctctggtgactgggaaatacgttcttctaagaaaaagagaaggagtagagacgagagtcgtcatcacggaaagggcaggacggacgaaatcagtgtcctatctttgttttcctcttatctccgatgagagatccttcctccaaaaggctgttgcttctggaggaagcaaccttgctcgcctgggcgagctgggtgacaagcttctcccctattttgctataaatagggggagaagtgaagaagaaaggggttcagccttcttggcacttctctctctctcgaaattgctgaggaaaattatttccgtgaagaaaatccaagccgaggcgcttcctcttcaacgg

SEQ ID NO: 51179 - DNA, 165 bp, Glycine max
  Peptide Sequence Number=SeqID_142864
atgactcataacccaactatagaggagttgataaacaaaatacaactctctcccaaaataatgtcaacgtcatcacgtcggctcgacagctcctcaccagaattttactccctgcaccctgctgttgtcattctgctcccacaacaatgttcgcgatcatcacag

SEQ ID NO: 51180 - DNA, 375 bp, Glycine max
  Peptide Sequence Number=SeqID_142865
atggctgcaagtgacattgctattctcagagatagagcccacataccaacaaagaaaagtcttatggaacttacatcgcaagatgcgttgttggcacagaacaagttgttgtccaagcaattgaaggcattgaccgaaacactaaggtgtgccatctgtggtggagctcacaattctggctgttgtatccccaatgaagaaccagctcatgaagtcaattatatggggaaccagccaagacaaaatttcaatgtaggtggatattccagatttcagcatggccagccatataattcacagcagagacaatggcaaaatcaccctagtaaccaattcaacaaagaccaggatggtccatctacaaggccacaatag

SEQ ID NO: 51181 - DNA, 609 bp, Glycine max
  Peptide Sequence Number=SeqID_142866
atggaagagatctcgcagcccaagttgaccgcccatgatggaaagggagatgatcacaattatggtagatacgttacccactccgcaagcttatccttatggcctgcctccggacttcacccccgtgccactccggaagatttaagccaagcccctacttttgaagggcaactcccaccttatgaagactatcctgggcaagacgatggggaaggagatacccatcctggccccctgctccacctcaaagatccatccccgcatgaactaccccagctgaacatagcctgccatatcccggcctcacccacacccgtaaagaatctgttccctttgcggaagataagattatgtcttgtgcccaacatcgtcatccctcccaagttcaaagtaccagactttataagtacaaagggacgacatgtccaaaagggcatctccggatgtattgccggaagttatgggggcgtattctgcggagaaaagttgttggtggccatttctttccagcaccccaagcttggtatgatccggggcagctgtacatggataccatctggaagttcccggacacaatggattgacttggcatgcccgttcagagtataa

SEQ ID NO: 51182 - DNA, 110 bp, Glycine max
  Peptide Sequence Number=SeqID_142867
atggctgcggagtgtagagggaagaaagatgattggagacaccacttcaaggagaagaggagtcaagaacaagctcacccccataagaagccatggataagagctttaag

SEQ ID NO: 51183 - DNA, 258 bp, Glycine max
  Peptide Sequence Number=SeqID_142868
atgtcattgcctagcactgttcatctgttctccactgtcgagtccggagcctcgcgaatgtcattgcctagcgctgttcgccaattctccactttccactttcattcggagccccatgaatgtcattgcctagcgctgttcattcatcctccacccaaagagtttggagctatgcttcatgattgcctaagtgtggaccctctagtgcaatcctccattctccacttttttcggagccccatgaatgtcattgcctag

SEQ ID NO: 51184 - DNA, 258 bp, Glycine max
  Peptide Sequence Number=SeqID_142869
gcctacatcagaaagttgatagaattcttcgatgacatatcctttcatcacattcctagagaggagaatcaggtggttgatgcccttgccactctagcgttcatatcacaactcacccgttccacatcgaattcagatgttgcggcaagcctctcttgcacattgctacttgatagaagaaccaagatggtaaaccttggttcttggacgatatgccaagtggtctctagacaaggaatacccacgggaggcctttaa

SEQ ID NO: 51185 - DNA, 63 bp, Glycine max
  Peptide Sequence Number=SeqID_142870
acaaaaggtgcagaagatgatgtaagtctctacgtgtcaacgagtttgtttgcccctggttga

SEQ ID NO: 51186 - DNA, 401 bp, Glycine max
  Peptide Sequence Number=SeqID_142871
atggctaagtttgaccctgagatagtcctggagttttatgctaatgcttggcccacaaaagagggagtgcgagacatgcggtcatgggtgaggggtcagtggattccctttgacgcagatgccctcagccagttcctgggtgacccgctagtgttggaggaaggccaagagtgcgagtttagtcagaggaggaacagggccgatgggttcaacgaggaggtcattgcccagctattatgcccactggggcaggattttgcccggactgctgcagggaggcgggtgcggatcatgcacactagtatgaccaccttgacccagatgtggatgacattgcagctcatgaatgtcttgcctagtgatcataactccgaccttcctctgtcgaagtgtcagctggt

SEQ ID NO: 51187 - DNA, 417 bp, Glycine max
  Peptide Sequence Number=SeqID_142872
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtgattatccgcccgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 51188 - DNA, 279 bp, Glycine max
  Peptide Sequence Number=SeqID_142873
atgtcagtgaaaaacctcgtcgggcgcctaggaggagaccagtcaaggtcacagtgttttgcgagaattctccaaccatatgggatcaacataggcttaaaggagcactcaaactgtgtgacccccaaggcctacactccgaagagtccgtcagggcctctccctcctgattcaggtccaacacagaaaatatttcagcacacagactctatctatgaactgtacaaaacacacgactcctcaattgttctcaaaatagcattaactcgtcgcccttaa

SEQ ID NO: 51189 - DNA, 430 bp, Glycine max
  Peptide Sequence Number=SeqID_142874
gtcgactctagaggatcccgcggtaatacggttatccacagaatcaggggataacgcaggaaagaacatgactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 51190 - DNA, 792 bp, Glycine max
  Peptide Sequence Number=SeqID_142875
ccgagaggagaagaaaacttctgcaagacagaacaattgcatccattcttgaggaggagactcatttctctgacttattatcacttgattcaccatcatcaagggaatctgccactcaattacctgaagtcattaccatggcaaaagaacatgaccagaggattaccctggaggattactcaagattacctaatgaagacccctatgcacacttggcaacgttcattgaaatatgcaacactgttaagattgccggtgtaccagacgaagccaagagatggctccactcattcaaaggtaacagtctgaaaacctgggaagaagttgttgaaaagttcctaaagaaatacttcccagagtccaagactgcgaaagggaaagctgcaatctcttcatttcaccagtcttcccagagtccagaactcccactcatggggggaaagataaaactgaagacctcggaagaagcaactgagctaattgagaacatgtcagctagtgatcatgccattctacgagacagaacccatcaacccacgaagaaaagcttgatagagctatcatcacatgacgctttattgggacaaaacaagttgctttctaagcaacttgagattttaaaagaaacactcagtaagctgccaactaagttgtctatgggtcaacctacgcattcttctgttgtgcaggccaatgtattcccactgaagaaaacactcaagaaattcattatatgggaaatcaacagcgacaagggtatactcaaggaggattttcaggcttccaaaccgc

SEQ ID NO: 51191 - DNA, 123 bp, Glycine max
  Peptide Sequence Number=SeqID_142876
atggcctcatatggtggtgtcgagggaaggagcccagagtttgaagaacctctggatttgaggtcaaatccttttcaagatggaggggatgatgcaatcctatcccccaagggtattggatag

SEQ ID NO: 51192 - DNA, 294 bp, Glycine max
  Peptide Sequence Number=SeqID_142877
tagctctagtatatggtcaaatgaatgaaccgcccggagctcgtatgagagttggtttaactgccctgactatggcggaatattttcgagatgtcaatgaacaagatgtacttctatttatcgacaatatctttcgcttcgtccaagcaggatctgaagtatctgccttattgggtcgaatgccttctgctgtggtttatgtacccgcagacgatttaaccgatcctgcgcctgctacgacatttgcacatttagatgctactactgtactatcaagaggattagcggccaaag

SEQ ID NO: 51193 - DNA, 730 bp, Glycine max
  Peptide Sequence Number=SeqID_142878
atgggttctccacctgcctccactcctcctcctcattctcctcctcctcctcctcctccttcggaagcatcggcttcaccgtctgccgtgaagcagacatgcaaagcctcacgtctacaatcgctgtccactagaccacctggtgctgagagaccagtggtgcatgttgatcctgctaccgagaaggccgacggtggacgtcacctacgagaactagaaggaggtccctactgcttagaaggacctgatttaggaggatattcagccgatcaggacggtgtcgaggacactgtctgtgagaaatacggcatcaacaaggaaaagtgggcccagttttgccagactcgcaaagacccttcttgggaggatgtgtgcaagaaggcacaggccatccagaagcagaatactgccccccatgttttgtctcgtgggggttatgactatttggagcagaagctcctggctgagaagataaagaagaagctggaggaagctgcacagtcaggaagcgttgatggcatcatcgaccctccatccctggtcagacgccacatgaagtggaagatggcccgcacaaagaaaacaggggagatgacgattgaggccgcaaaggaaatctctgagaagatcgccacacagggatcctatgtcccccatggacgtcagtatgttctcaccactgttattggacgtctagagcaccctggacgtgtccgtgctgctggagccg

SEQ ID NO: 51194 - DNA, 145 bp, Glycine max
  Peptide Sequence Number=SeqID_142879
gcttaaaaagggcttcctgttcgcgaaggcgcacttagcgccattttcgcgcttagtgcaagtaagtgaattttggcttagcgtcattttcgagctaagcacagaaaagacaatcttcttgctgggtgagctgatgacgcgctaa

SEQ ID NO: 51195 - DNA, 636 bp, Glycine max
  Peptide Sequence Number=SeqID_142880
atggcaacccctaggaggtttatctttgaggccctacaaaagggaggtgtgattccccatggtggtcataaagaggattcttgtttgttgcatcccggcaagctacataacatggaaacatgtttggcagtagaggaattgttgcaacgaatgatagatcaaggccgactggaagtcggtgatgaggggagggaagagcagcatatatatatgcagtccgcggatgagagaagttttggaaggcctaaacctttggtgatatatttcaccaaggatgcagctccacaaaagccccaataccccccggcaactaaacctgttcctttcccataccaaaacagccacgcagtcccgtggaagtatacacctccgagtgaaagggaagaagaaaccaccgatgtcagctctttgtcagccaaggtaaccaatatcacggggctgagcggtgtgacccgcagcggtcgcgtgtttgcaccttccgacctgccaacacgatctgcaaacattaagggaaaggcaaagatgttagaggaacaaaatgacaagacgacccccactccgaacgaggatattccggtaaagggtctttcggagaaaagggatggttgcggcaagaaggaagtgtcgctagagtaa

SEQ ID NO: 51196 - DNA, 576 bp, Glycine max
  Peptide Sequence Number=SeqID_142881
atggaggccataaaagagcaaatggccacaatgatgaaggccatgatgagcatgaagaagataatggaagccaatgcggttatagttgccgctattagcgctgtcgctaaggtgaacccgacgtccccttccggcatcaaccaaatgaatcatccaacctcaaatatggtaggcaaagatttgggaagtatggatgaccccatgatgtgcaaattcaaaacaagcacgccttcccgccatatggtttgcctcccaaactatacaccacccaatgtggtgtacattcccaatgaggatgtcaataactccactcccatactcattaagagccaacaacctcaatctgatcatgcacatgtctctcgacccatggaggagacacgtgaaattccccaccacgatctagcgacttcgagccttgcctcggatatgccgttgaaaggcaagcagttggtggtataccctttgaaaacactttggagggccctcagtttcgcccacaaccacaaccattgcattttgcggtgggaagagcccctcctgctatggtcgaaaagggaaaggcggatcatctaa

SEQ ID NO: 51197 - DNA, 362 bp, Glycine max
  Peptide Sequence Number=SeqID_142882
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagtcactactgttgttctttatgatgctaatggtgcacttgagaatcctatcactcaaaatgatgagattaaagaatatgtagatagcag

SEQ ID NO: 51198 - DNA, 903 bp, Glycine max
  Peptide Sequence Number=SeqID_142883
atggcgagccgagagaagtggggcccgtttgcggatatactagctttgttgatttttggggttgtcctctttccgaacgtggacggtttggtggacttagccgccattgacgctttcctcgcgtatcaccatagcaaggagagtccagtggtggctatcttggcatatttgtttgatacctttgacaggagatgtgagaaaaatagtgcacggattgtctgttgtttacccgctctctgtgtgtggttggtttcacacctattccaacaagacacaagatacccgtgtccacttcaaagctatcgctcatgcgccgaaaaaggaagagtcgattgggaccaacatttggctggaataggaggcaacacaatcaattggtttcctcgttggaaggaaggcaaggaaggagttctcttctcgtgtggggactaccctaatgttccattgatagggactaggggttgtattaattataatcccgcactcgccataagacagctagggtatcccatgaggggagcgccaaccgaagaaagtctctcgcctttccttgtgagggatctaggcgtgcaaagtctcaaggagcttagaggcatccgaaatggcgtcatcgatggttatcatggatggctaagagttcacacgcgagggttagattggctctccaaattgaaagttatcaatgaggagaacttcgaagctccggaggaagatgaagaagtccaagctctcaaattagagctagggaaggcgagactcgccaaggagaagttcaaatcagtagctacacacatccggaaagagtgcaccgagttacaagaggaaaacgcggccactgcaagagcccttgaacaagaaatcaaaagggcccgcaaggaggagtatggtcgagagaaattctga

SEQ ID NO: 51199 - DNA, 192 bp, Glycine max
  Peptide Sequence Number=SeqID_142884
atgtttttgtgttgtcgcgctaagcgtgcctcgcacaataaatggcctcaaggaagaggaaagccacaacatcctggccccaggaaccctatgataccacaagattcacttctgagggggcctgagagtgatattcatagaacgttcactcccggaacatccttccagagaggaatgttaacctctttgtga

SEQ ID NO: 51200 - DNA, 720 bp, Glycine max
  Peptide Sequence Number=SeqID_142885
atggcgggtgaattagtggaatttgaagagggtactataggcattgctttgaatttggaatccaaaaatgttggtgttgtattaatgggtgatggtttgatgatacaagagggaagttcagtaaaagcaacaggaagaattgctcagatacctgtaagtgaggcttatttgggtcgtgttataaatgccctggctaaaccaattgatggtcgaggagaaatttcagcttcggaatctcgattaatcgaatctcctgctcccggtattatttcgagacgttccgtatatgagcctctccaaacaggacttattgctattgattcgatgatccccataggacgtggccaacgagaattaattattggagacagacaaacggctattggtcaaaaagcatcttctgtggctcaagtggtgaataccttacaagaaagaggagcaatggaatacactattgtagtagctgaaacagcggattctccagctacattacaatacctcgccccttatacaggagcagctctggctgaatattttatgtaccgtgaacgtcacactttaatcatttatgacgatctctccaaacaagcacaggcttatcgccaaatgtctcttctattacgaagaccacctggtcgcgaagcttatccaggggatatggccaaatattcttatctgccgatctattcaatgctggaatcagacccgctattaatgtag

SEQ ID NO: 51201 - DNA, 657 bp, Glycine max
  Peptide Sequence Number=SeqID_142886
atggatatgaacttggggtacctcatctcccaccagatctctctgattgcacaacatgacacatctagacttggattccctgccttgatcatagctctatgtaaggccagaggagtccaatcagattctagattcctgaagaacttgagccctgccattaacttggcatatattaagaagaactgttggaatcttgatgatccaacagtgacatttagagggccaaggaaggccaggggtaagagctcagaggtctccactacttcagcagcactagagacaccagcttctacttcttccatagctccaatacctcccactcagactccagtggcttgtccaagagcccagccttctccttctggagggggtggtgcctcaacagcccaggagcctgctcctaaggagccagcagcagcagtaacagagggggaggatgagctcacccctcctgagcctttttattttgatgcaggtatacacatggctcaagaggaggagacttctacaaaccagatcccagagccatccccagcacccatacctgatgatgtcataccatctgcaccagcatctgagttagagaaacctatctttcaagattcaccagctgctcaggtgttggaccttaatgagcatgcacatgagcaaccatag

SEQ ID NO: 51202 - DNA, 239 bp, Glycine max
  Peptide Sequence Number=SeqID_142887
gccacacttcgaccaactgttcaaaagaactggtagtcttgacaaaagcttcgaaggtaacaaaggatcaaaatcctattattcaaagcctcactaactctatttttcaaatgggtcacttatctttacttccttttggcttattagggacaccaaaaattgctaaaccagaaaaaaccggggaagaggtaaccaatcttaaatctaaatacctactgatgcgcaacaaaacaccttag

SEQ ID NO: 51203 - DNA, 516 bp, Glycine max
  Peptide Sequence Number=SeqID_142888
atgaaaaagaagaagcaagttaaagattcctcaaagcccgaccttgtgaagaatacaactaagttgacggaggagtcggttaaaggaaataatgttgaggtgaaggttgttcactttgatgggccccaggtgttggacaagggactagaagagaacaaactggttgaaggacctattgaggttttggagaaaaaaaagggagagaaagaggtggagaaggagaaagaagtggagggtgctcgaaagtcattcccaactgagaagaaaaaaggagcagaggccctcgagaaatcagcttctatggcattcggagacaacccgagtagtggtgcagtgcaggcaaacaaggctattctatgttatcatgaagggaaactttgcagtttggatcatgagatggtatcaaaagctaacgagaagaccaaggcgatggttgcacggttgaaggcgatgaaagtcacggttggtaaaaccaaagaacttggtttagaattggctaagagtggggggcggtga

SEQ ID NO: 51204 - DNA, 447 bp, Glycine max
  Peptide Sequence Number=SeqID_142889
atgggggttgttgagaggtgcgtaagagagagcgggagctgccagtcgaaaagcaggcttgtaagtagtacgtcgagacgaggggcagttgagagaacgggagcagcaaacagctttgtttcaaccagatggacaacaacagtctataataggcaggtagtcgaggtgcgatacgacgaaaaagaagcaagaggttgggagcacttgccattccagtgggtggagccagtaccaaatgctacttctggaacacttgtagcccgtcaagcggctgctactcgagggttactcgagctaccatgcgcctatgagtataatgtagtagaggatagtgggcagactggacagatagtctacgagtggagctacagcagcaaccatgaagatatagtactggaccgaaggcatagactaagaaagatgggtggtccggaccgtcgtaagtaa

SEQ ID NO: 51205 - DNA, 405 bp, Glycine max
  Peptide Sequence Number=SeqID_142890
atggattttacaaagatagtggaaatctcaagtgggttgcttgagtactgcacccaggagatactggcagagcaagaagctgatagagtgcatggattacctaggcagcctatggtgaagttcgacaatatggtggttatatcactgtcaatgaaactcaaggaagagcattgttctattggttttttgaggccactcacaaaccagaacaaaaaatcgttctcttatggcttaatggaggcagtggttggattaactcaacatagcaatgcaaagcctgttgctgattccagtttttccaaggctaaaccagaacattctttggactcacaattcaaaccgctagaagcttcacaactagtttctgtcttcactattttattcttgtttggttgctcaaattaa

SEQ ID NO: 51206 - DNA, 168 bp, Glycine max
  Peptide Sequence Number=SeqID_142891
atggttgttgttggaggaggtgggttggatgatgaagggatgtcttcagctcttgctctctttcttgaggccatctcaaaatgggtcgctcagctcagtcactaccataaagaacttcgcttggcgcaaggatacttggcgcaaggatactggctcagcctcacttag

SEQ ID NO: 51207 - DNA, 302 bp, Glycine max
  Peptide Sequence Number=SeqID_142892
gcgtccttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggtgtgggcgttagagcattga

SEQ ID NO: 51208 - DNA, 120 bp, Glycine max
  Peptide Sequence Number=SeqID_142893
atggatgggattctcatttctagtgtgttggctgattcacgattcactcgaccggatatgggttatcacccaacaaaactcaatttcgtgcctagcgatgcggatgaggcgccactcgat

SEQ ID NO: 51209 - DNA, 185 bp, Glycine max
  Peptide Sequence Number=SeqID_142894
atggggggaatgtgcgaggagtttaagatccaacaccccaattccacaccctacaggcccaagattgaacggagcagtggaggcagccatgaggaatatctagaagattatccagaagatgactgtgctcatacaaggactggcacgagatgctcccattcgccctacatgggtaccgaacctca

SEQ ID NO: 51210 - DNA, 400 bp, Glycine max
  Peptide Sequence Number=SeqID_142895
cgcacccgtgagcctcgccctcgctcgcccgcgaagggcacgttgcgacaagaagcctacttcaaaatcatatggctctcactcttatccaaagaaagaccaaggtcaaggcatcttaggggttgcaccttctaagcccaaagatgataaggggaagaatagaaaaagaaaagaagaacaatctttaatggttaaggagcagtctaaggaggtaagtgtctcctccaagatgttagctaaaaaggaaagtcattttgaaataaagacaaacattaaagaaactttccttcttagacaacctctgcatcttctcctttgtaaaagaacacttgttaccactgtcatacctcttgagcttgaggttattcctcaagtaaaggagttgttggatgagggtttg

SEQ ID NO: 51211 - DNA, 270 bp, Glycine max
  Peptide Sequence Number=SeqID_142896
atggttgctaaaacccaaaggaatagaggagcattggggaataagtgggaagggaacataggctcaaaggggctatcaaaggaattaattcaaggtaggctcatttggctagaggcttataagaacaaaatgcctaaatcatctcccaacatgcatgggaagcaagaagtatcaacaagagtaaagccaaggctattgtgcaagcaatcaacggggcaaaacacacagaataaaatagatgatgatggctcaaattctcaccaagggtaa

SEQ ID NO: 51212 - DNA, 402 bp, Glycine max
  Peptide Sequence Number=SeqID_142897
atgccgatctccccctgcggaagtatcagttggtctgtgccgtcccgacatagggatcgcacccacaagacacccagtggacccggaaaagtccaacagggccctggggtttccagctctggttacgggcctctatcagtcctacaaggtgcccgtacccccccggcaaggtcacgtcatcatagggatcgcgcctgcaagacacccagtggacccgaagaagtccaacagggtcttggaggttctacggagtacctgtcacctccagcaagggcatcaggccccctactaatcgagctttcatcaagaagtactgcgtctccaggcaggcgcagggcgaaacaccacagcagcctggggatggccggcagcgggcaacagacgcaccgccatcacctctag

SEQ ID NO: 51213 - DNA, 487 bp, Glycine max
  Peptide Sequence Number=SeqID_142898
atgttggtgcgcatgatccacactcgtctctttgcagcggcccgggtgaaatcttgccccggtatgcatagtagctgcgtgatagcctccctctctggttgtgcttgcacagttgctcgccctccaatattagggggtggcccaggaaccgtgcggatgtggagcacactgaaaatgaggacacgtagccctctagaggtgagggcgtgcagccctctcaaggcgaggatgtgtagtcctccggaggagagggcatgtagtcctctcaaggtgagggcgtgcagccctctgttggcgaggacgtgtagtcctctcaaggtgagggcatgcagccctttgttggcgaggacgtgtagtcctctaaaggtgagggcgtgtagccctacgaaggtgaggacatgcagtcctctgatggcgagggcgtgtagccctctgaaggtgaggacatgcagtcctctgatggcgaggacgtgtagtcctcttcaag

SEQ ID NO: 51214 - DNA, 275 bp, Glycine max
  Peptide Sequence Number=SeqID_142899
atggattttgctgcctcaaagcgcatttgcagagatcgagagatgtttgatacttttaaaactgatggagaattcggtcatttcaagttagggaatgatggaaaaataaaggttaaaggcataaggagcataaggatgacgctccatgatggtgctattcgaactttatcaaatgtgagagatgacatcacaagggtaaaagtatgttggttcaaagtggggatgcaaggtgtacaacaagagacacttggtgttgcgaggatagaaaaacaaag

SEQ ID NO: 51215 - DNA, 85 bp, Glycine max
  Peptide Sequence Number=SeqID_142900
atgggagaaagaaaaaggaaaagaaaagaaggaaagaaagctcctgatcaaggatcgaaagaaaacagaagaaatgtgcagagag

SEQ ID NO: 51216 - DNA, 189 bp, Glycine max
  Peptide Sequence Number=SeqID_142901
atggagaagtctgaaaagaaaaatattaatgaaaagaaattgaagaaagcatacattacatgggatgaaaatgatttggaatcttctgaagattcagaaaatgaagaaataaacctctgccttatggcaaaaagttatgaaagtgatgaagaggaaaacaaagacatgcctccaataaggctggactag

SEQ ID NO: 51217 - DNA, 477 bp, Glycine max
  Peptide Sequence Number=SeqID_142902
atggagtggatactacccacacctacaccataccgtctagtggagccagtccaagtgatcgaggtgacgtcatccgaggaagaccctgaagaggaccctgaggagctacctcccgagcctgctgtggatgctcttgactttctagagggtgatgaggacccactccctgaggtggattctcccgaggacgtcatgtcggcatctgaggcagactctacggaggatagtggccctggagagatggcgatcagacgtggtagggatcagaaccgtgatgtcctcgaccgcatcacagttgtactggaaactctggtgcaggaacgtgatgtggagccggcggagtatcggggactcatggctttccgtaagaaccacccgccaaagtttagtggagactatgatccggaaggtgccaggttgtggttagctgagacggagaatattttcgaggcgatgggttgcctcgaggagcataag

SEQ ID NO: 51218 - DNA, 507 bp, Glycine max
  Peptide Sequence Number=SeqID_142903
atggcccgagttatgttggggaacggttacgaacccggaatgggtttaggcaaagacaacggcggcataactagcctgataaatgccaaaggaaatcgtgggaagtgtggtttaggctataaacccactcaggcagatataaagagaagcatcgcgggaaggaagaacggtggtcaaagctcgcgattgagacaagaaagtgaaggaagcccgccctgccacataagtagaagctttataaacgcgggtctgggagacgaaggtcaagtggtcgcgatatacaaagatgatgttccgagtacattggatttggtacgaccatgccctcctgatttccagctgggaaattggcgagtggaggaacgccccggcatttacgcaacgagcataatatccgatgacgagtcccccgaaggtactaatacctgggacccgcttatcaacttcgagcaagaaacgaatcaaacggaagatgaaggaaacgaggatgtgggacttcccccataa

SEQ ID NO: 51219 - DNA, 384 bp, Glycine max
  Peptide Sequence Number=SeqID_142904
atgggtaaagtggaggaggtacaagagaagatgaaggccgacatggaggccatgaaagagcaaatggccacgatgatggaggccatgatgagcatgaggaagataatggaagccaatgcagttgtagttgccgctaccagtgctgtcgctaaggcaaagctttgggaagtacgggcggcccccattatgcgcaaattcaaaacaagcatgccttcccaccatatggcttgcctccccaactatacaccacccaatgtggcatacactcccaatgagaatgtaaataactccactcctatactcattgagagccaacaacctctgatcatgcacatgactcttgacccatgggggaggcacataaaatgccccaccacaatctag

SEQ ID NO: 51220 - DNA, 366 bp, Glycine max
  Peptide Sequence Number=SeqID_142905
atggaggccatgaaagaccaaatgaccaccatgatggaggccatgatgagcatgaggaaaatgatggaggtcaacgtggttgtgtcatcgctacaagttccgccattgagagcaagcatcctttcccacaatatggcctgcctcccaactatgcaccatccaatgttgtacatgggcatgatgagaatgttgaccactccactcctatacccctcgagagccaacaacctcagtctgggcatgcgcatgtcgcttaacccatgggggagacgcatgaagtaccccgagaccacactctggctgacttcaagccttacctcggatatgccaccgaggggcaagcatttggtggcataccccaactga

SEQ ID NO: 51221 - DNA, 567 bp, Glycine max
  Peptide Sequence Number=SeqID_142906
gcagctgtgtctccggaaaaaccacctcaaaagccgaatccggaggtcaatgatccgttttatctgatgacattgatcatcccagagcttttcttgaggccttaccaggttacatgggatgtcatcgtgttcagggtctttaatccagacttcctgctctatataaagcacgaagacctctccgaaatcgcacacggtggtaaatgtctcagcatatcagtgttacagttgtggattctcggacactggcagatggtggtcattgtgcccaaggaacacctagttgtctggttttgttcattgcataacagaccagacaactaccttaaggggacaattaacattgctttaaaaggtcttgatgatgctccacaacctaaatcaaaggctcatgctaggtggattatcgtcaagtgtaatagacaaaaaggaagtactgagtgcggctattatgtcatgcactggatgtccaccatcattttaggaagcttcaagaataactgggaagcatattttaacgatcctagaccattggagccacagagattaaaggcgctgcagatctag

SEQ ID NO: 51222 - DNA, 306 bp, Glycine max
  Peptide Sequence Number=SeqID_142907
agattaacgtcgtcttctacaccttttgtcatccaggggcagcgagtcgggtggtgggcggagataccttatggtcatccgagcctttcgtcaaccgagaggaacaaattcggcagtgtcaggatgattttggtcattcggtgcttatcgttttcaaaattttttgaaggttttttcactctcgtcgtccggaaacattcaagtccagcgatgtgcggagttcttctctgctgggcagagacgattaggtgcaatggcaaagggaagtgtcgtggctgtccaactttgtcgttttcaaaacactga

SEQ ID NO: 51223 - DNA, 453 bp, Glycine max
  Peptide Sequence Number=SeqID_142908
atggctccaaagaagctcccagccaagaggtccaggaaggaagccacttgcaagggttctagtgcggccccacaggcaaatatggactttgatagacacagggacgaggagtatgtggagttccaagaggaaatagcccggaggcaatgggctcagctcgtatcacccatggctaagttcgatccggagatagtcgtggagttttatgctaacgcctggcttatagaaaaaggagtcagagataagcgctcctgggtaaggggccagtggatttcctttgatgaggatgccatcaatcaaattttggggcatccactggtcttggaagaaggccggcattgtgagttcagccagagggcaggactttgcccggagggtagtagggggatgggtgcagatcatgtgcaccagcatgaccaccctcacgcagatctggatgatgttgctgcttag

SEQ ID NO: 51224 - DNA, 174 bp, Glycine max
  Peptide Sequence Number=SeqID_142909
gaaatggctccaaagaagctcccagccaagaggtccaggaaggaagccacttgcaagggttctagtgcggccccacaggcaaatatggactttgatagacacaggttccggagtgtggaacaccaacaacgatttgaggccattaaaggatggtcgttcctaaaaaagaggtga

SEQ ID NO: 51225 - DNA, 435 bp, Glycine max
  Peptide Sequence Number=SeqID_142910
atgtcctcaccttcaaagggctacatgccctcgccatcagaggactgcgtgtcctcaccttcagaaaggctacacgccctcgccatcagaggactgcatgtcctcaccttcagagggttacacgccctcgccatcagaggactgcatgtcctcaccttcgtagggctacacgccctcacctttagagggactacacggctacacgccctcacctttagagaactacacgtcctcgccaacagagggctgcacgccctcacctttagaggactacacatcctcgccttcagaggactccacgtcctcaccttgagaggactacacgtcctcgccttgagaggactacatgtcctcaccatcagagggctgcacgccctcacctttagaggactacacgtcctcgccaacagagaggctgcacgccctcacctttag

SEQ ID NO: 51226 - DNA, 273 bp, Glycine max
  Peptide Sequence Number=SeqID_142911
atggcagcctcctcttcctactcctccaatcttgttgggtcaatgactttgctacaaatagcattaaaaacaaaacacaggcattttatggcaacccgaactttgacagacaagattccccgaattgctacaggtatggaggaaacgtggaggaggctttggctgcgcagcaactctgatttcggattggtaatcgattacaggaccaataagcctactggtaatcgattacaggatgttgtaatcgattacaggctgcctgttcatgtgtaa

SEQ ID NO: 51227 - DNA, 390 bp, Glycine max
  Peptide Sequence Number=SeqID_142912
atgacggtgaaaacctcggacacatgcagctcccggagacgacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaacgacggccagtgccaagcttgcatgcctgcaggtcgactctagaggatcccccctaa

SEQ ID NO: 51228 - DNA, 486 bp, Glycine max
  Peptide Sequence Number=SeqID_142913
atggcgaggattcctaacaagattaagtctattgatgggtcaaaagagacacttaagcttgttgtcagaatcacggatctttggttcgttgggactcccaacaagtctgagcaagcggaaattgtttttcttgattctgagggtgatcaaattcatgctgtatgtaaattggaccacctcaagtcttggaaagctgatttgaaagagaattccacttatgttatgcataatttcaaagttgtcaagaatgatgtgacgattgttagagaagctgatttgcatgaactgccttttaaggaatttagatttgttgaatttgcaaatgtcgttgctggcaatttcatggctggcctgttggttgatattattgggctcgttgatcaggtggtctttcggcatgtttcatcaaaaaatagcaggcttgtttttagaatgaaggatttgagggtgtatattgtcgaggatttcatttatcacgttgcatga

SEQ ID NO: 51229 - DNA, 150 bp, Glycine max
  Peptide Sequence Number=SeqID_142914
atgataaccctcaccattgaacataagagcctattgatagaatttccctcaggaaatggaaagttggatgaggccatatctattcttgagggacaacccatcccttgtgttcaggaatccttacaactcaagagaccctcggtcccttaa

SEQ ID NO: 51230 - DNA, 369 bp, Glycine max
  Peptide Sequence Number=SeqID_142915
atgactcctccacggcttccactatggcatagaggatgggcaacttaccaagatgtcttcctcgcccgacacaataaccaaatgcccctttactacgaatttcaatttttggtggaatgtagagggaacgacccctaccgagtgaatccacgggcgtcccaaaagacagctgtaagccaggttaatatccattacttggaagggaggtcgatctcccccctaacttctcggcgggtgccgtcgaaggcacagaccaccatggaacttggctttagatgggaagcattaaacaacaatttctccaacgtgcttttgggcattacatttaaactagaaccattatcgatgagtacattggccacgacatga

SEQ ID NO: 51231 - DNA, 315 bp, Glycine max
  Peptide Sequence Number=SeqID_142916
atggaattttcatggcgaagactgctttatgacaatgaaattgatattgccatcaatttccttagggaggtacaaggacaaagcatacagcaacaacaaattggcatttgggagtggataggagattcatcaaggatttacacaactcgcagtgcctacaatctgatttgggaggaaattactggtggccagaaggaggattggagtatggaactatggaagacaaagatacctagcaaaattgcggtattctcttggagattatgcaggggcagactgcccacaaaggagaatctgcgaaaaaggaacatatag

SEQ ID NO: 51232 - DNA, 111 bp, Glycine max
  Peptide Sequence Number=SeqID_142917
gattgcatcaagaatgctcaaaattataatgctcaagatcaggatgttcaaaatcaccaataacagaatgcacagattcaccagttatggaatgctcagaatgatcaaaag

SEQ ID NO: 51233 - DNA, 433 bp, Glycine max
  Peptide Sequence Number=SeqID_142918
atggcgatgaaaaagttgctcatagcgtcgctgctgtttagcagcgcgactgtatacggtgctgaagggttcgtggtgaaggacattcatttcgaaggcttgcagcgtgtcgctgttggtgcggccctcctcagcatgccagtgcgtcctggcgatacggtgaccgatgatgatatcagtaacaccattcgcgctctgtttgccactggcaactttgaggacgtccgcgtcctgcgcgatggtgataccctgctggtgcaggtgaaagagcgcccaacaattgcgagcattaccttctccggcaacaagtcggtgaaggatgacatgctcaagcaaaaccttgaggcatccggcgttcgcgttggggaatctctcgatcgcaccaagcttgccgatatcgaaaaagggctggaagatttctactacagcgtcg

SEQ ID NO: 51234 - DNA, 360 bp, Glycine max
  Peptide Sequence Number=SeqID_142919
atgacggtgaaaacctcggacacatgcagctccccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctacaggactgctattcttcacaggacagtatctcctatctgataagcacccaaacacttggggaaccctcccttaa

SEQ ID NO: 51235 - DNA, 216 bp, Glycine max
  Peptide Sequence Number=SeqID_142920
atggaccctaagagaataaaggtcattcttgagtggcctactccaccaagtgttgaggaaagaatccatgagtttcaagaacctctggattttaggtcaaaaacttttcaagggggagggaaccatgatatgaatggcagcagaatggagaaggaagagagagaggagacgccacttcaaggagaagatgagtctagaagaaactcaccaccatag

SEQ ID NO: 51236 - DNA, 621 bp, Glycine max
  Peptide Sequence Number=SeqID_142921
gagcttccaggggaacggcctggtatcgtaatagtccggtcgggtttcgccacctctgacttgagcgtcgatttttgtgatgctcgtcagggggacggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgactggcacgacaggtttcccgactggaaagcgggcagtgagcgcaacgcaattaatctatgaccatgattacgaattcgagctcggtaccccacgagctagtcacaagggaaggagacaccatttccgttcttcttccaagcttttccaagtgttcttgaacctttcttccatcaagcttagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 51237 - DNA, 432 bp, Glycine max
  Peptide Sequence Number=SeqID_142922
atggttgcattctttcaagggaataacttgaaaacatgggaagaagtagtagaaatatttttgaagaaatacttccctgaatcaaagatagctgaaggcaagtccaagcaattattagatgcttctgctaggggaaagatcaagttgaaaactccagaagaagcaatggaactcattgagaatatggatgctagtgatcgtgctattttgcgtgatagaagtcatgtacccaccaagagaagcctgttagagctttcttcgcaagatgcaatgttggccaagaacaagctgctagttaagcagctggaatcactcactgagacactcagcaagttgccaacacaattacaagcggctcagccttctcagttagcaattattcaggttggaggttgtagtatatgtggaggagctcatgaatccagctgttga

SEQ ID NO: 51238 - DNA, 276 bp, Glycine max
  Peptide Sequence Number=SeqID_142923
atgtcatcgggcccaccgcctttggatgacaaaagaggcagaatgaccataatttgtctctgcgtgccatcggacatgactgtgcctgaatggcaaaaggtgagtggaatgaccataatttgtcttcacgtgtcatcgggcccgccgcctctggatgacaaaacacgcagaatgaccataatttgtctctgcatgccatcagacacgactgtgtctgaatggcaaaagaatgaccataatttgtctctgcgtgccatcggacacgactgtgtctga

SEQ ID NO: 51239 - DNA, 375 bp, Glycine max
  Peptide Sequence Number=SeqID_142924
atggaagttgtaatgcctgacaatggaggattctttttttttatatacgaatatggagggactaggaagacttttatttggaatgccttatctgcaactatcgaagttgaagctttggacagaacattgagacatatcatgaggaccaaaaattcaaatagctcagagcaaccatttgaaggaaaggttgttgttcttggaggtgatgttagacatatcttaccagttattcctaaaggttccatacaatacattatttctattgctgtaaattcttcttatttgtggaaattttgtgaactcttaaaactgacacaaaatgaggttaagattacagtatctaacgaaaatgcaactgacatacaagtttgctga

SEQ ID NO: 51240 - DNA, 482 bp, Glycine max
  Peptide Sequence Number=SeqID_142925
atgaatgcaaagagaagagaagatattgttggtgtgcttccaaagagaaaaatattgatgcggccctccgcgccggtgataggcagtgatggctgctcccctgactggcagacggtgtttcttaaagaagaggatcatcggcatgagggaagagtcgtgaattcgagaatgggatttcaaaaactttcaggtggaagagaggatgaagaacctcctatcgaagaaaagttgaagaaaaccctacattgttgttggaactgtgtgggtcgaagaaaaccctacactgctcttggaacagtcgtgggtgctcaaagctcgaagctttctacgctgccagttaacaagcttgacgagagttacacgccgagcaaagtttccatccgtgccggtgatggttttcacaacttgaaggagattaagaccgtggaacttttgaagccaactgggtgggtttatctatccttgtctggagttgatcctag

SEQ ID NO: 51241 - DNA, 471 bp, Glycine max
  Peptide Sequence Number=SeqID_142926
atggaaaaaccatcgaagaagagaaagggatcatcctccaccgccgctgctgctgcccatcgccgccacggaccatccgaagcacccacaacacctattcatccctctttgtcatctccaagatcatccactttgttttcatctgatgatcagcgtctacggtacctttctcaattttcttctaggatcatcttagaccctaagtacctagacatagatttctttaatgataaaatgtttgattgctatcaagtgtttcaaaattcaggcttggttgatttcatgtccttaaaattgccacattatcctgaacttgtaaaggtcttctactgcaatttaaaaattcaggatggcattatttcttctgaggtgcatggtattcccatgatcattgatcagtcattgttcttttctttaactcatttacctagtcaaggtgcaccttttgagggcaccattgctaatgactag

SEQ ID NO: 51242 - DNA, 546 bp, Glycine max
  Peptide Sequence Number=SeqID_142927
atggaatttggtgatattgttgttcattttaacattcttgatgccacgaaacatccatctaaggatcattctatttttcgtgctgagatacttgatcagattgttgatgattatatgtttgattttaattctcttcatggttggaaacatccatttttatctgatctgcatatttgtcatcccccatgcaatgaatctgagtttgaatttgatcctgtatttgatttttatgctgagagtaaatttgaatttgagtctggttctgattttctaggtgttgtacctcttgatgttgattttttagagtcagaatgcactaaccatgttgcaggaagtacatatacttctgacttgctttatgaggtacaggctgaggaatcttcctcttctcctaccctggttcctcccactgttcagccaccacccacaccagagttgaggcccttaccagcaaacctcaagtatgcttacttggaggacaaggaaaaatttccagtgatcatctttgcctcccttgctgcagagcaagaggagaagttgttgcta

SEQ ID NO: 51243 - DNA, 192 bp, Glycine max
  Peptide Sequence Number=SeqID_142928
atggagaagaaaaatagattccttgaagaaggtgccgcgcaatacgaaaggtttttcaactttttaatcaaggatgcaaaaatacccaaaggggagggcaaaagggtcattttaaggctttttctgaaccctggctcgcccaggctagcctatgtctcgcctgggccaccaaataacttcatggtgaagtaa

SEQ ID NO: 51244 - DNA, 390 bp, Glycine max
  Peptide Sequence Number=SeqID_142929
atggccaacgacggtttaataagcgacttggcctctttgaccttccttgggcctccctggcgggagtgccggaatgctcatgcccagagaggcgtcaacccacaataccatactcatttcgttaaaggcgagaagaagaagaagaagaagaagaagaagaagaagaagaagaagaagaagaagaagaagaagaagaagaagaaagcaacgaaactttaccggaatccgttattgccacgagcttgttttcgagtgatgatcctcaagcaccctgccaaggcggggtgcgggtgtggtgcgtggtgcagcacgagagcgtcgcggcctgaacccccagaaccaaacctcacactcaacccaccgcaccccgagcccgaggcgaacgagtaa

SEQ ID NO: 51245 - DNA, 300 bp, Glycine max
  Peptide Sequence Number=SeqID_142930
atgggtgccaagtacctcggagtgaggactacatgtcctcaccttcagagggctacacatccttgccttcagagggctacacaccctcgccttcagagggctacatatcctcgccttcagagggctacacgtcctccccttcaaaggactacacgtcctcgccttcaaaggactacacgtcctcaccttcatagggctacacgtccttgccttcagaggactacagtccttgtcttcagagggctacacgtcctcgccttcagagggctacacgtgttggatcaagtggcatcggaataa

SEQ ID NO: 51246 - DNA, 414 bp, Glycine max
  Peptide Sequence Number=SeqID_142931
atggtgtttccttccaagcttccactccagttcccattcgagtacctaacgggtaatcagtttcggtttcaatgtatgcaactgaaagatgatgctgatgttaacacaatgttaatgtgtaatcatgaattttcgtttgttggtccgattgagttattatgtagcattgctagaatcccagatggtattttaaacttacttgaaactactatgacccatacttatgatgccctgctatattacaatgggaggtggaatatgtcacgccaaaatgagtttgtaggttactcgttcacaggaaaaaatcccaaaaactttgacattcccaccggatgtaccatggatgaactgaaggatttgatcaaacaagttgcacctcgtgggattcccccttatggtgttgatgaaacataa

SEQ ID NO: 51247 - DNA, 741 bp, Glycine max
  Peptide Sequence Number=SeqID_142932
agttggggcaattaaatgggtcaacttcaacggcaagccttccgcaaagcctatggacttccagctagtgccgactgtggaagagtttgaagaaatcctgggatgcccactgggaggaaggaagccatatcttttctttgggttctatccctccacgacaagagttgccaagggcaaagtgccttggaaaatcaaggcaaatgggctttcttttattgacatcttggtgcttttgatctttggagttgtcctctttccaaatatggaagggttagtggacctagcagtgattgacgctttcctcgcctttcatcatggcaaggaaagcccggtcgtcgccattttggccatgtatgacacgttcgaccggggatgtgaaaagagtggcgcaagaattgtttgttgtgcactggctctctatgtgtggctggtttcacacctttttctccaagaaggtaggcccgtctatccgctacaaggaaggaagaatcaggattctatcttcatgcgaaggatgtccaaatgttcccttgatggaacaaggggttgtattaattataatcccgtcctcgccataagacagcttggctaccccatgaaaggagtgccatcagatgaaagcatcacgcctttcatcgcacggggtttcagtgaccccaatgcgagggacagagagcttaggggaagcagtaatgggagcatcggcgactatcataagtggctgagagtccggacacaagg

SEQ ID NO: 51248 - DNA, 267 bp, Glycine max
  Peptide Sequence Number=SeqID_142933
atgagtgaccctgaaagattactcaagtacttttgtgctgcaattcttcacaagcattgcacggccagaggtaacagtcttaagacttgggatgaagtggttgaaaaattgttgaagaaatacttcctagagtctaatactgctgaaggaaaagctgtcatctcatcctttcatcaatttccagatgagtccttgagtgaggctttggaaagatttcatgggttactaagaaagacgcctactcatggattttccaaatcaatctag

SEQ ID NO: 51249 - DNA, 543 bp, Glycine max
  Peptide Sequence Number=SeqID_142934
atggagagaagtatgatagatgctgccagtggtggagcccttggagacatgacccctgctgaagccagaaatttaattgagaagatggcttcaaactcccagcaatttagtgccagaagtgatgctattgtcattagaggagtgcaagaaatagccacgaattcatcttcatcagctgagactaagaagcttgaaggtaaactagatgccttggttaacctggtaacccaactgaccatgaatcaaaaatctgcacctgtcgccagactctgtggtttatgctcctctaccgaccaccacacagaccttttcccttctgtgcaacaatctgaagcaattgaacagcctgaagtttatgctgcaaacatctacaacagacctcctcaacctcagcagcaaaatcagccacaacagaataactatgacctctccagcaataggtacaatcccggatggaggaatcatcccaaccttagatggtcaaatccttcacagcagcaacagccttattttcaaaatgttgctggcccaagcagaccatac

SEQ ID NO: 51250 - DNA, 624 bp, Glycine max
  Peptide Sequence Number=SeqID_142935
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctccatccaggacctttttccataaatctgtggatgcctctgcgtacttcaagaacaccaagtggctggctgatctttttgattctgtaattcaagagtttggcccagaaaatgtagtacaaattattatggacagcagtgttaactacactgttattgctaatcatattgtgcagagctatggaacgatatttgtatctcctggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 51251 - DNA, 164 bp, Glycine max
  Peptide Sequence Number=SeqID_142936
gtatctcactaagtaagatcaaggcaccagttcagggctttacactttttgcaagaatgctccaaccatatgatcagataggcttaaaggagcactcaaacccggtgacccccaaggcatacactctgaaaagtctcattccctccgatttaggtccaacctaa

SEQ ID NO: 51252 - DNA, 180 bp, Glycine max
  Peptide Sequence Number=SeqID_142937
atgaagaagcatgataaaggcagaaggaaatcaggacatttccagaaggattacctaaagtgcaagtcttggttcgaaaagaaaagtgagcttaatgctcatagattacttaccatccaaaccattagcccaaatgagaagttcgtcttcatggggaataaagtgaaagctccagtgtaa

SEQ ID NO: 51253 - DNA, 531 bp, Glycine max
  Peptide Sequence Number=SeqID_142938
atgggtgaccaagaggagacacaggaacagatgaaagccgacatgtcggctttgaaagagaaaatggcttccatgatggaggccatgtcaggaatgagacaactcatggagaataacgtggccaccgctgccgttgttagttcggctgccgaagcagacccaactctcccagctactgcacaccatcctctcccaaacgcagtaggacgagaaaagagcacactagggcacatcaacaacccccatttgggatacaactgggtggcttacccttatggattaccacctaattacacgccaccagtcatgcgtgatgacatgggtcatgtcccttcccccatccttgaaggggagcctcctcgacagcccgacgaggttcacgaggatcatcgagagtatgcccaaggggacgtcgatttctactccccggtccccatcgaggggccggcgcccaacacattgcctcagcacaaccaatattcttgtccacagagggaccaccccatcggcggaagaaagaaggaaacttga

SEQ ID NO: 51254 - DNA, 405 bp, Glycine max
  Peptide Sequence Number=SeqID_142939
atggaactcatagagaatatggctgctagtgatcatgctattatgtgtgatagaactcatgttggaggttgtagtatatatggaggagcgcatgaatctggttgttgtataccccttgatgatgctgcaaaggaagtgaattatatggggaatcaaaacagacaaggattcaatgcaggtggttttttagattaccagcaagggcctagcctttatgagaggaaaaccaagctagaggagactttggctcagttcatgcaagtttcaatgtccaaccacaagagcacagaatcagctataaagaacctggagatccaagtgggacaactagccaagcaaataactgagaattcttctggaggttttggggccaatactaagaaaaatcccaaggaagaatgccag

SEQ ID NO: 51255 - DNA, 337 bp, Glycine max
  Peptide Sequence Number=SeqID_142940
cgccacgcttcccgaagggagaaaggcggacaggtatccggtaagcggcagggtcggaacaggagagcgcacgagggagcttccagggggaaacgcctggggggcggagcctatggaaaaacgccagcaacgcggcctgcgatccgcaccgatcgccgcagttcccaacgagattgcgcagctgagtcagtggcggaagcgcgaagatgcggttctccaattacgcatgcggtatttcacaccgcatatggtgcactctcagtacaatcgcgcgttgagccgcatagttaatgccagctggcaccgacaggtcccgactggaaagcccgggcagtga

SEQ ID NO: 51256 - DNA, 478 bp, Glycine max
  Peptide Sequence Number=SeqID_142941
gagttaggacggttgatgggacccctccagatgtaagccttccgcaaggtgtacggaaagattttagatttgaccatagcggagtaccgactgttgaagaatttgaggagattctaggatgtcctcttgggggaagaaaactgtatcttttctccgggtttcttccctccttgagcaagattgcagttgtggtcagggattcggcgagagagttggatcgtgtaaagcaaactcaaaacggcgtagtgggcctaccgcggaagtacttggaaggcaaggcaagggatatggcgaatcaagaggagtgggtcccgtttgcggatgtactagctttgctaatctttggggttttcctctttccaaacgtggacggtttggtggacctagccgcgattgatgctttccttgcatatcaccatagcaaggagagtccggtggtagctatcttggcggacttatttgatacatttgaccaaag

SEQ ID NO: 51257 - DNA, 952 bp, Glycine max
  Peptide Sequence Number=SeqID_142942
gagggatgttctcattggctttggaggactttatggtgcttcaactcttaccaacaataacaaccctcctttagccattgctgctcgagttctccctcctgacctcaaaacccatcaattgttgcgtccaatatcttctaccatcatagacttcaagctcccttcccctagaacagctcttagggttagaccagctgctcatttagtcaacgatgtctacatagacaagtatagggaagcccttgagcgcatgaaagccctttcacttaatgaccctcgaaatttcaccctagaagctaatgtccattgtgcttatattactgtgatgagaatcttgggaaacttgattggtaacccaacttttgctcttccgttttggaactgggacaaccataaagtgggcaactcccaaggctcttccttggaagcccttatcgtgctggagatgaacctgaaccttgctggcacttttgagaacgttccacatgctcctgttcactcttggactgaatcctcctttctcttcaactatgagaacaagaaccttgtgcgtgtgaagaagaaggattctcttgacacaagaaatgtttaccaagatgttgacattccatggctcaagaataagcctaaacctaaaagatctaaagctaagaaggtggcattattggcacaagattttaactttggattcaaagctgtgaagtttgatgtttttatcaacgacgaagataacaaggtgataagaccaagcaatactgagtttgcaggaagctttgtgagtgtgtctcattcacacgtgcacaaaaacaagaagatcaaaacatgttttagagtgggattaacggatttgttagaagacttagaagctgaaaatgatgatagcattttgatgacgtcggtacctaaatatgggaaaggacttgtcacaattcagggcataattttaagatag

SEQ ID NO: 51258 - DNA, 81 bp, Glycine max
  Peptide Sequence Number=SeqID_142943
atgacggtggttcaacatgaaggttcaggatggtggcagcgtgaaaaggtcgccaacaccataggaacacaaaacgtgtga

SEQ ID NO: 51259 - DNA, 75 bp, Glycine max
  Peptide Sequence Number=SeqID_142944
atggctaatatgagcccttatttgacacaaattacatcgtatatgctgcagagagtattcaagcttcaagcttga

SEQ ID NO: 51260 - DNA, 1098 bp, Glycine max
  Peptide Sequence Number=SeqID_142945
atgaaagcccttccacctgatgatcctcgaagtttcatacaacaagcaaacatccattgtgcatactgtgatggtggctataaacaagttgagttccctaagcttgacttcaaagtccacaactcgtggctattcttccctttccacctttggtacctttatttctatgagaaaatcttggggaaattgatcgatgacccaacctttgctcttaggttttggaactggaacaaccctgatgtggcatgggataaaatccaccaaccccctactctcgtagacctaaactatagcaaaaacaatgacggcagtgcaaatgtagaaaacaacctctgtgtagtgtataagagtgttgtttcttgtgggaaaaccccatcagtcttcctcggaaaacctttccatcctggagaggagcctaataatagtgctggttctgtagagagtgttcctcacactcctgtgcacatttggactggcgatagaaatcaacctaacggtgaggacatgggaagattctattctgctggaagagaccccattttctattctcaccatgccaatgtggataggatgttgaacatttcgaaaacaatcaaaggtgggaaaagaagggatgtcactgaccctgattggttagaaaccgcgttttacttctacgatgagaacaagaaccttgtgcgtgtgacgataaaagatagcctcgacaccaaaaaactaggccaaaacccaaaaaatctagaaaagctaagaaggtggcatgcacaacattttggtgttggtgcagcacaggccgctgaagctaggccaagcgtcaagtttcctctcactttgaattcaaagaggtcgaagccgcgctcctggaacgagaatgaagaagaagaaaaaggcgtagaagaggtgttagtgatagatgttgagtatgatagcactgatggtgtgaggtttgatgtgttcatcaacaaccaaggcgacaatgagattggaccccaagattcagagtttgcgggaagctttgtaactttgcctcactcgccgcatgtcaatcacaacaacatcaccaaagcttctttcagacttgggagtaacaaaagacgataa

SEQ ID NO: 51261 - DNA, 138 bp, Glycine max
  Peptide Sequence Number=SeqID_142946
atgagtgatgatggaagacaacacacttctctttttgttacaagagtgaataaaaacagaaaggacaaaggaaagaaactaaaaacaaaaacagctagtctccgcgagggaagcaagttcccatctcatcctcgctga

SEQ ID NO: 51262 - DNA, 357 bp, Glycine max
  Peptide Sequence Number=SeqID_142947
atgcctgctcatcatgcgtataggaggaagttgcattgtgtgccacataagaatcatctatacagtggttgcagtgcagactcagtgagagaaagagagaaggagatacaaaatgagtggcgacgaacgacaaatggaggcgacgagcagcgagcagatctcgacaatgagcagcaaactagaggtgagggggagaacaacagtgaccgacgattgacgactggcatagatcgaagagagggagaccacgaacagatcacatcaaggaagggagcagccacaaacagattgcaacaaggaagggagcgaccacaggggagggagatcggtggcgaacaacaacaagcaaacgagtga

SEQ ID NO: 51263 - DNA, 1917 bp, Glycine max
  Peptide Sequence Number=SeqID_142948
atggctgaaagggactatgcactagaaatgtggagacttcttgatccagattcaaatttgataaattctaaagaactattaggtcgcattgtatgcgttaagtctggtttgaagaagtcattgttcaatgtcttccaagatggtttatgccatccaaagatggcattggtaattgatgatcgcttgaaagtgtgggatgagaaggatcaacctcgggtgcatgttgtccctgcatttgctccatactatgctcctcaagctgaagcaagcaatactatccctgtcctatgtgttgcaagaaatgttgcttgcaatgttaggggtggcttctttaaggattttgatgatggtcttttacaaaagattcctcaaattgcctatgaagatgatatcaaagatataccttctcctcctgatgtgagcaattatctagtttcagaggatgatggctctatttccaatggacaccgagatccattcttgtttgatggcatggcagatgccgaggtagaaagaaaattaaaggatgcactatcggcagcttcaactatccctgtgacaactgctaatctagatcccaggctcacttctcttcagtacacaatggtgccttctggttcagttcctcctccaacagcacaagcatctatgatgccatttccccatgtacagttccctcaacctgctacactagtaaagccaatgggtcaagctgccccttccgaacctagcttgcatagctctcctgctagagaagaaggtgaagtacctgaatcagaattagacccagatacaaggcgtaggcttctcatattgcaacatggacaagacaccagggatcatgcatctgctgagcctccatttcctgttagacatcctgtgcaaacctctgctcctcatgttccatcatcacggggggtttggtttcctgcagaagaggagattggttcacagccactaaaccgggtagtacctaaagaatttcctgtagattctggtccattgggtattgcaaagccccggcctcatcatccctcctttttctctaaggttgaaagttctatttcatctgatagaattctccatgacagccaccaaagattgccaaaggagatgtatcacagagatgatcgcccaagattaaaccatatgctctctagttatcgttctttttctggtgttatttgtttcagtgatttgattttgaatgttataccggctggattcgaacccagcccttatggaattgtcttacgacaattaccaaccatacggaccaagaatgccggtgatgatatcccctttagtaggtcattttccagccacagggatcttgactctgaatctggccattctgtattgcatgcagatactccagttgcagtactacaggaaattgcactgaagtgtggaactaaggtggactttatttcatctctggttgcaagcactgaactgcagttctccatggaggcatggttttctggaaaaaaaattggtcacagagttggcagaactagaaaggaagctcaaaataaggctgctgaggattctatcaaacatttggcagatatatatttgtctagtgccaaggatgagcctggttctacatatggcgatgtgagtgggtttcctaatgtaaatgacagtggttacatgggtattgccagctctcttggtaatcagccattgtctaaagaggattcagcttcattttcaactgcatctccatcaagagttttagatcctaggttggatgtctctaagaggtcaatgggttcaatctcttccctgaaagaattgtgcatgatggagggtcttgatgtcaattttctatctgcacctgctccagtgtcaacaaattcagttcagaaagatgaagtacacgcacagtttttcgttccttcaatagattag

SEQ ID NO: 51264 - DNA, 1027 bp, Glycine max
  Peptide Sequence Number=SeqID_142949
gggcgaggatgttggtgcgtacgcgtgttctgacaagttcaccgtcttggctttcaagaacggcatagaagcaacacgaagcactctctttctctctcttcactgtgtgactctctctcacacacaaactagagcgagaaatattatagctcagggttttgggatgtatgtagcttccatgcgcaagtctttcaaggactccttgaaagtccttgaagctgatatccaacacgccaataccctggtgatcactgttgctaaaggggttggtgattgccatgtgagggcctcagattttccaagggagtatgatggtgcatgccttcagatgagaatgtcatacagtccagctgcacacctgttccttttcttggtacagtggacagattgccatcttgctggagcccttggactgttaagaatcctaatttacaaggtctatgtggatgggacaaccaccatgtctacacatgaacgaaaagcaagtattagagaattctatgcagcggtcatttatccctctttgttgcaacttgaaaaaggtgtaactgatactgaggataagaagcaaaaggctgtgtgcatggagaggtaccgtagaagagatgatgaggagtataggcagtcttctgacatagacattgaaagagaagatgaatgtggaatatgcatggacatgaatagtaagattgtgcttcccaactgcaatcatgccatgtgcctgaaatgttaccgagaatgtctgaagagagtgaactcaggtgatctctgggtattcaccgatagaagggatgtggtagacatggcaacagtgacaagggagaatctcagaaggcttttcatgtacatagataagttgcctctgattgttccagactccctttttgacacatatgactctcacataaggatgcgaatgcggtcggtgcaggcagcgaagtcggtgttcttgttggttcagaagatgccggcagggatgagcgattcttgggtggcgttgagttatggcttggaagggaagggttag

SEQ ID NO: 51265 - DNA, 1368 bp, Glycine max
  Peptide Sequence Number=SeqID_142950
atgccagaggttaggatcattgccaagaatttcatggacatggtggcttccatgcctgccatgaagctcgataagctctatgaaaacggattcatctgtgaagctattctcaggtctgttccacctcttgcgaagaaatatgtcatacagatgctgcatattgatgtgccagtggcagctaaattgttggaggaatgggtgcttccggctggagtttcaaagcacagagtggccattgataggttggttcaattgagagttttccttgaagctgttgacaggaagaatgaaaagacttacaaagttaatccaacatttcagagaagtctccaaaaacttttagtacaaggtggaactttgccaagggaatcaatgccttctaatattactgtaaggctcccaacattagagaatcttgaggcttatgctctagaacaatgggagctgatggatacaaatgcacagctttggtacatcatcagggaatatatctctaattctgaggtagctctaaccagtgttatgaaacctagtccggtcattgacctggtcgagggatttggtgacctaaccggcagggtcaattgcatgaccaatctggttaggccaccgggtcttggttggaccagtccgaccggccgggatagaggtgttgatgcagctgatttgatctcattcatgctggaacttagttttcatgtcattggggaggcttatagtgttgacacattgactagttttcagaggaccataattaatgacctagcagaccttggattggtaaaaattcagcagggcaggaaagggagttggtttatacctactaaattggcgaccaatctttcaatgagcttggctgattcatcatctagaaaacagggatttgtggttgtggaaacaaattttagagtttatgcttactcaacttctaaattacattgtgagatattgcggctattctcaagggtagagtatcaacttccaaatcttattgttggggctattacgaaagaaagcttatatagtgcttatgaaaatggcattacagcagagcagatagtcactttccttcagcaaaatgctcatcctcgtgttgcagagagggtaccatctgtgcctgaaaatgtcacagaacagattaggctgtgggaagcagatctaaacagagttgagatgacagacacatattattacgatgagttcccttccagagatgtgtttgaaggagcatgtgactgtgctagagaatggaatggtttgttgtgggaagattcaaagaagatgcatatggttgttaagaccgagaagtgtcaggtatatcaccaggcagatcgatggggcgtacaggttgtggctttggcttcttag

SEQ ID NO: 51266 - DNA, 726 bp, Glycine max
  Peptide Sequence Number=SeqID_142951
atggccttagagcactacctttcgcaggaatggaaaaccagccccagcccgagcccgagccccatgacagtgacagaaaaccttgatgggtgttttgattgcaacatctgcttagattttgcacatgaaccagtggtcaccctttgtggccacctatactgctggccctgcatctacaagtggctccatgtccaaagtgcttctcttgcaccagatgagcaccctcaatgccctgtttgcaaggatgacatatgccacaccacaatggttcctctctatggccgtggccagggcatagctcatagtgaccgtgatggaaaggcatcatcctatagaggcagttttataccaccaagaccacctgctttgggtgctcaatctctcatgtcaacatcatctcaaagtgctcaacaacttccatatcgcaacccttatcagaatcagcatttcaaccctcctttgtaccaagatgaggatgaatcatcatcacaaatgctgaatcctggtgccaacatggtggcaccaggattcccccaccttgtggttgggatgtttggagagatgctttatgccagagtctttggcaactcagaaaatttatacaactatccaaattcttatcacctggggggaaataaatgtaaccgcaattacgttgctgttaaatacgcagttgcagacggattgagtgaaaaatcttttcctttgaagatattaagggaatag

SEQ ID NO: 51267 - DNA, 309 bp, Glycine max
  Peptide Sequence Number=SeqID_142952
atgcaaagtcaacaaacagtgaaagaagaagatgatgaaggtccacctccgggatggcaacctctccccgctcagccaccgccaccgccacgtccatccgatatccctgaaagagtccttgatttttttattttggtctttgatcaccattgcatgaaattgggtattaacttgatcactctgactggcaagctttgtgaacaggttgggctcaaatggtttgcggttcttgtcgtcgcctgctttcatatccacgaggtgccaaacatgtcaaatgttcatgctgtcagactgtcaacattgtattag

SEQ ID NO: 51268 - DNA, 1488 bp, Glycine max
  Peptide Sequence Number=SeqID_142953
atggatcctatcattagtgattcagactgggaaacttccagtgacagcaacagcagtgaggatcaagaggaaatcgattttctatacggtggaaaagctcagagtatattgtcaagtttagaggaaagcattggtaggatcgatgattttctttcatttgagagagcatttgttcatggagatgtggtctgctccttgtcagacccatctggacaaatggggagggtcacaagtgtggatttgtttgtggatttggaaagtattaaaggaaaagtattaaaaaatgtgaactctaagaaacttttgaggattcgctccatttcagaaggtgattatgtaattaaggggccgtggcttggtcgagttcagagggtggtggacaaagtgactgtattgtttgatgatggagctaaatgtgatatcactgccttggaaagagagaagcttttaccactgactggtaattttcctgaagactggcagtttccattctatccagggcagagagtaaaggttaagttctccagtgcttctaaatcaactagatggctatgtgacacttggagagacaatcatgatgaaggagctgtttgtgctgtggaagcaggcttggtgtatgttaattggatatctcatgttcttgtgggttgcaatttgagtatgagtgctcccaaatgctggcaagattctaaaaacttgactgtgttatcttttttttcacatgcaaactggcagcttggtgattggtgcatgctctcagttgcagaccaaaaggaacagattactcaacaagcacctataggtgatcttactatggagcattgtgtgtcaagagggtataagagaagcaaccttaactctaacattggtgagttgtttataattgggaagataaagaccaaagttgatgttgtatggcaaaatggtgaacatactttgggattggatccagagaatttactcccagtgaatgttataaacactcatgaattttggcctcatcagtttgtgctggaaaaaggtgcttctgatgatcctcctaaagctagcagtcaaagatggggtgttgtccaatgtatggatgcaaaggagtgtactgtacaggtacaatggaaaacaatgtccacatccgacccaaataatttggctggagacaaattggaggaaactctgagtgcctatgaacttgtagagcacccagattactcctgcttttttggtgatattatgtttaaggcggctcaaaaacagctgggtaaccaagctgataaagaacaagcaaaaccagtgaccaactttaatgcagaagctgttactaaaaatgggaaccaaatgagttatcaggatgagttccctgataatcatttcatgtcctgcattggcagcgttactggtttccaagatggtgatgtggaggttacatgggctactggtttcacaaccaagtttatgaggctgctagatgaatgtggtagtggagagtcatga

SEQ ID NO: 51269 - DNA, 438 bp, Glycine max
  Peptide Sequence Number=SeqID_142954
atgactgagacaagggttaatactctcatggtcacgagttccggcaattatggcatgttgcacaacaacaaaattcatttgaattgccaattccttggtctcgggcattccatcaaggaacatggtaggtttgggttagtgtgctcttcatcacttagtggtggtggtaataagatgaaacttagagtgaagaagaaggggaagcaaagttcttcaccaaccatgatggtagctctcaatgagggtcatgaggccatctctgaggagtccactaccgtgaagctcttggctctggtggctgtgaggaatagtaaagataataacaaggtgtttgcaaatgagatagtgaataaccttctaaccattttctggcctcaaaaccagaccaaaggtgttgttcttcaacttgttagcacacagcttgatcccagtacgtga

SEQ ID NO: 51270 - DNA, 516 bp, Glycine max
  Peptide Sequence Number=SeqID_142955
atggagaacaaccctagttcatcaagaactgatacaaaatccattgagcagaatagaagaaatcaaatgaaggatcttttctccaagctcaactcagttgtgcctcatcaaagctcaagggatgccacatcgcggccggataagataggtgaagccacaaattacataaagaatttacagattaaattagagaaaatgaaggagaaaaggaacaacctaatagacattgaaaggtcaaaaaatgctagcatgaatatggggttgaagtctccacaatttaagatccaacaaatgggttcagccttagagattgttctagtaaccgggatggattgtcaattcatgttcaatgagaccattcgtgttcttcaagaagaaggatctgatattgttaatgccagttatacagttgttgaaaatgcagttttccatacaatacactgtcaggtagggggatctgctaatggagctttgaggatatctgagaaaataaagaagtatctcaatggttgctag

SEQ ID NO: 51271 - DNA, 747 bp, Glycine max
  Peptide Sequence Number=SeqID_142956
atgcctgcatctcttgttggcaccttcccctcactcggaaagacaacaaaaagggtcaagattccttacccattcttctactctttctttgacagctcgcccaacccaacactgcttttcttttgccatcccataggaggaagaagaaccggaacctggggacgcggcggcggtggtggtggtggggaagaggggcaaaagacgaggcttttcgtcgcgaggagtggacgcgggagaagggtgcaagaagaaccctttctccttgatggctttctcttcagtagcttcggctgtgtccataaccataccggcgccgttttcgttgagggaacgggaacggttgaaggggtcgggtatgaggggcgtgacggggctgagaacgagcgcggggaagtcgaggatgctgggagagagaacctcgtggtgtttcctcggcgagaaagacgaaacgacgacgttgttgagagggttgatgctgagattcttgctgagcgagtttcttcgttcgaagagcttgaaacccgtttgttttttgatgggtgggatcatttggacgacttgcttgaaggaggtggtgtcggcttggacaaaggttgtcgggtacgggttggcggattcggatctggtcacgggcttcggaggaactcaaactgtggcgtggcgaaggaacaagactcacgccgccgcggtggtggtggtgctcttggtggtacctcggagagtccatggttgacggggagatattaa

SEQ ID NO: 51272 - DNA, 990 bp, Glycine max
  Peptide Sequence Number=SeqID_142957
atggaacctttgtactaccaccaccattgcttccttttcctccgttgtcaccacaattgctcccttttcctctgtttgaaagcctccgacagtatagtttccctccatgggtcatcgtccatttatttgcatcgaagaggcaagttgcatgatctccgatgcggaatgataactagacccggaaaaagaacgaaagaagaaaagggtatttttgtctattcaagttttcaatgggggtgcacaggaagcaaaagtggacatataagcccaaagtgtaaaccctatccttttttgtcgttaccgagtttacgtcgagcattttgggacaagaggatctcccaggaggttcttggtgatgctctgggtgaggagtttaaaggatatgttttcaaaatcaccggtgggtgtgacaaacaaggattccctatgaagcagggagtgctgacccctggtcgtgttcgacttttgctccatagaggaactccttgtttccgtggatatggaaggcgcaatggagagcgtagaaggaagtctgttcgtggttgcattgtcagtccagatctctctgttttgaacctggtaattgtgaagaagggtgagagtgatttgccaggtctcactgatgttgagaagccaaggatgaggggtcctaagagagcatccaaaatccgtaagctgttcaacctgtccaaggaggacgacgtgagaaagtatgttaacacataccgtcgaacctttacaacaaaagctgggaaaaaagtgagcaaagctccaaagattcaacgactagtcactcctttgacactccaaaggaaacgagcaaggattgccgacaagaagaagagaattgctaaggcaaaatcagaagcagcagagtatcaaaaactcctcgcttccagattgaaggagcagagagatcgccggagtgagagcttggcgaagcggagatccaaactctccagtgctgccaaaccaactgttacagcatag

SEQ ID NO: 51273 - DNA, 438 bp, Glycine max
  Peptide Sequence Number=SeqID_142958
atggatacatcaatcagttttgtggatgcaagggccttcgccaatagcataaatttgcttcactttctcctctggtttctttgtcttctgtcactctcaccatcactttcatcagaacttgctgagtctgactctgaactagctgatccagaatctgatgaatcagaactccctgactcatcatctgatgcagattctgaaccttgtttctgttatagcaggttaagacgtggcatatccttcaaatactcacgtaggttctcggtaagaccaccaagaccaatggatgtaaagaagttaatgcagaaccgtgtgttttttggattatcttttggaaatatggattcaaaagattctaggattgttggatcatttaaccgctcatttagcagctggattccaagatgttctgataattcctgcaacatcataaactga

SEQ ID NO: 51274 - DNA, 855 bp, Glycine max
  Peptide Sequence Number=SeqID_142959
atgggttgttgtgttagtagtcacaaaaccccaacctcttcttcactagcaaaattccatgatccaccaaaacctctcattaaaccttcagaaagcagtagtgcagaggaggctgtgaaggaactgctcttggaaacccccaaatggaacccgacaacctttgccaaatcaaaaccacaaaagccacaccaaaacacaaactttcacagatttaaggatgaaaaaagcaaggttgagaagagggcattgacattgtccatttacaaagccgaagacaccacctcagcagaagtttgcagcttgagcgaaaccgtgtccacagatacttcaatcgccaaccagatagaagaaacgcgcaaaagggtcgatacatctcagcccaaattgcagaaaaatcgttcatttcccggtgaaagaagagagagaacggtggtgcatggcgcaaggaacaatagtgttgggtctgtgaagttggttcagtgcagagaccaaacagctaagaaaattggtaacggcggaacgcgtcgccggagagatcccaccgagaattctctccggcggtcaaggtcgccggccaccgtttccggcgccggagaagctaggcccgtcacgggtcggagcccatctgttaaaaaacttgaccggtccactacaaggatcagaaccggaacggcggaaaacggttgccggaaaagggaaaatccgacgacggcggggaaatggtattccgccggggacacacgatggaatggaagaatgcaggttgattacgatgaagggagggatggactcgtgatgcagcaggaagggaaaggaggtgtcaatggcatgggtgattggtgtggggagggatga

SEQ ID NO: 51275 - DNA, 375 bp, Glycine max
  Peptide Sequence Number=SeqID_142960
atgccaaaaaagtgggccaggcatgttccaccgaaggaatggcacaaggcagacaacacaattgttacaagcgtgagcgagtttgccggaaaaggcgatctgggcctcgacgtcggaggggctgcggcggcggcgggcggcggcggagggggaggagagtggctgcgaggtggggcggaggaagcgctcgaagatggccatgacgaggaacatggagatgagaacggcggtggcgacgaaaccgaaggagacggcgttgacggagctgtcgaagttggtccaatgctcgtctctgtggacgtccagaggcgcaccgattggtggccacgcattggtgatggtgtggtcttcgaccagcattgttgttgcagttga

SEQ ID NO: 51276 - DNA, 465 bp, Glycine max
  Peptide Sequence Number=SeqID_142961
atggttcaacgcagctgtatacaggttttgataaaaggtagtgcagcagtggcagataattcaatttccaagggtttgctgttgcctgaatcttggaaatgtgaacaccatgtgagtaatatttgtttgttccttatcactgataaccaaagtgtagctttgtttttgaaatttgaatggtataacccaagttttgtgagcaggggaactacttcaatgacggtccttatcaaaacccgtctttataggtttatacgccaacagcgacgggtgcgtggaccaccgtcgttgaaacttcaaagaacaacgacggtgtactcaccactgacgttgccatactgtcaaacaacgacgggtgaacccgccaccgatgttgaaatggaaacccaacaaatacgggtgttaggcgtacccgacgttgaaatggaccacaacaacgacgggtctttgcgtacccaacgttga

SEQ ID NO: 51277 - DNA, 4275 bp, Glycine max
  Peptide Sequence Number=SeqID_142962
atggcggatgctgacgtggacctttcggaactgttctctggtaatgccgacgaagacgacgacatgttttatatagatattcagaccgtccagaaggttcttgatgaagacgatgattgttactttcaggagaatagtcccgaggattcttcatcaaaaaatgtttcacctagtgaatctggcattcatgacacttttcagatacaaaatgtcacgagctgttctccattctgctcagatgtgtcagatttcggggtcagaggttcagttggtgtatctgattctgcagctaattctatgcttgattgtgaacgtgaaaaccagggacctcaatctcgggcttgctcttccccaaatgcttttcctggtaatttcagtgattcattttctccaggtgaaagtgatgaggtttttcgcacagaaaggacccaagtttctaaacatgagatacctgcatatagtgtagaaacaagtttccctgaggcacagtcaaacaatatatcaatttgtggagataatttgaatctgagtatgtggattggtgaaaatgagagccaattcaagcatgtgagagaggatgttgaatctgaacatgcttcactcagttctattgttgacaatgatgatgtaaatattgaaggttatgttgaagacatcattgcaggagtttctgggcaacaggaaaatgactcgtgtacatcttttgaagcatcatttatggatgctgatagatctttgcatgtcacaacttcaactgattctagtgttggtcaaggttcccatgtttccagtgatttcattgactaccatgtatctccaaactgttaccagggaacacatgatggaccctttgttgctgactcttctcttggttttgtgcctaatgctattaattctcaattgtggccatatgaagaaatgatgaataacattaaggctgaaaatgtggagttaaatgctgatattgcatatatgagtaatggcatgccttcaagcactactgggtggatgccttttcaggatagtcaacttatgttagctgataatggttatccatcatttcattctggtaattttgatgacatgtcatcactgtctctttcagcttgtgcttcatacatgtcatatggagaccattaccagaacaattttcaccgtgatgatgccgagttcaatgtaggccaagaggtgaaacaaacacctggtattttttcttctgaagggtgtcaagcttaccagtgttttcagaatgaggataattatgcagttatatctgggatatccaatcaatatcaagatagcattggcagaactgctagttttcaaggaaactttgacaatttgaatttaaaagctgcagataattcttggctccatccccaagaactaattaccagtgagaagcagtttggttgtgttaagagagaaggagggattcaacataactttattgattctcatctttcaaaaggaagaactgagaatttccatgttgaggaagaccctgatgtttgcattattgaagacatcagtcatcctgctccgacgagtcgacccgcaggcattgggaattcccttaatatatctcaatcttgtagatatgttggaagtacggtcggaagtacaaggatgaaggcatgtgatgaacgaaatatattacgagttgcattgcaggatctatctcagccaaagtctgaagttagtccaccagaaggattgttggcagttcctcttttaagacatcagagaattgctttatcatggatgattcaaaaggaaacatcaagtttaaattgctcaggaggaattcttgcagacgatcagggacttggaaaaacagtatcaactattgcattaatattaaaggaaagacctacattacttaatgggtgcaccactgcccgaaaaagtgaattggaaactctggatgtggatgatgacatgcttcctcagaatggtatagtaaaggaagaatctaatatgtgtgaggataagccaagtggatatccaatgaatttgttgaagcaagcaaagggaaggccatctgctgggacccttattgtttgcccgactagtgtcctgcgtcaatgggctgaggagttgcgtagcaaggtaaatggtcaggcaactctctctgtgctagtataccatggaagcaatcgaacaaaagatccttatgaggtggccaagcatgatgttgtcctaacaacttattccattgtcagcatggaggtccctaagcagcctccagctgacaaagatgacgaggaaaaggaaatttttgaagatcatgctacaccaagtaggaaaagaaaaagcccttctaattctagtaaaagtggcaagaagaaattggatggcacaaatcttgaagctgttgctcggccacttgcaaaggtgtcatggtttagggttgtcctggatgaggcccagagtataaagaatcacaaaactcaagttgcaagggcctgttggggtcttcgtgctaagcgaagatggtgtttgtcagggactcctatccagaatgcaattgatgatctctacagttacttcagatttctaagatatgacccttattctgaccatgcatcattttgtactagaattaagaacccaattagcagaaatccagcaaacgggtatagaaagttgcaagctgtcttgaagacaataatgttacgccgaacgaaaggtacacttcttgacggggaacctattatttccttgccgcctaagtatatagagctgaaaaaagttgatttttcaatggaggaacgtgatttctattccaaactagaggctgattcacgtgcacagtttcaggaatatgctgatgctggaactgtcaagcaaaattatgtcaacattttgctgatgcttctgcgccttagacaagcttgtgatcaccctctgcttgtcaagcgatacaattcaaactctctatggagatcttcggatcctcctgaagatgcagttgtctcagtttgtggccatgttttctgtaaccaatgcatctgtgaacatctttctggtgatgacaatcagtgccctgctgcaaattgcaaaagtcaactgagcacatctatggtattttcaaaagccacactgaacagttgtctttctgaccagggttgtgataattcacccagttgctctggtcctgaagccgaagaagctgaaccttggtccgaaagtaagccatatgattcttcaaaaataaaggctgcacttgaggttttgaagtcattgtgtaagccacagtgctacacatcaaaaagtacttctgagcatagcactttcagggaagataaaaattgccttgggaacccctccattgctaagaatgggaaatccttaaaagattctcctgagagtcaaaatttgtctgatgagaatagaagctctaatgcttcagttactgttgtaggggagaaagctatagtgttttctcagtggacgaggatgctagatttgcttgaagcgtgtctcaagaattcttcaattaattatagaaggcttgatggaacaatgtcagttgttgcaagagataaagctgttaaagattttaacaattgtcccgaggtaactgttataattatgtctttgaaagctgccagtcttggtctcaacttggtagtagcatgccatgttcttatgttagatttatggtggaatcctacaactgaagaccaagcaatagatagagcacatcgaattggccagactcgtcctgtgactgttttgcggttaactgtgagagatacagttgaagatcgtattctagctctgcagcaaaagaagagaatgatggttgcatctgcatttggggaggatggaactggtgatcgtcagactcgcctcactgtggatgatttaaaatatttgttcatgatcgagcagccactccaagatatcgttccgaacaatctcaacattctcatcggtttccccgaagagcaacaaatgcatcatcccttcataaaccctaatcgtcttatcctcactcctggcctcacggtacaactctctactcccatgcaacactatgaagggaagactcacatcacagagcctccgattcagcaaatcggtgaccctcaaaagctccaccacagtccccaacctgggtttggcgcgccaggatcttgtgaagagtttgaggccaagtggggtggtgaagaaggaggaggagcttttcttgctcttcttccattgctctgtgaagatgatgctggctttgtgattgtggaattgtggctgtggtttttgtattga

SEQ ID NO: 51278 - DNA, 132 bp, Glycine max
  Peptide Sequence Number=SeqID_142963
atgatgcaggaaatatgtggagcaacaatcatgggtaaaacccaccaatacgattgcagctcaacttcgcaaagattctttggcattctagctcctaaggatgcatggatacagtgtatcaccgtcatgtaa

SEQ ID NO: 51279 - DNA, 267 bp, Glycine max
  Peptide Sequence Number=SeqID_142964
atgacatcgacaacaagaatcttcttccctgaggtttctgatgcagcaacaaccgagcatagaagccagaacacatcgaaactcgcgagtttgaagaacatgcatgaacctcgccatcaactcgattcacacgtgcgtcaagctaatggaggtctgcacacgcgtgatcgacatgaagctcaccctacatccattcagaatccaatcaccccaccaccgcactttccctccgcaagcaccgacactgccatctgttactatcgatag

SEQ ID NO: 51280 - DNA, 237 bp, Glycine max
  Peptide Sequence Number=SeqID_142965
atggctactagtgatcatgctattttgcgtgatcaaaatcatgtacctacaaatagaagcttgctagagctttcttcacaagatgtattgttggcgcagaacaagctgctagctaagcagctagaatcattgatggagacacttacaaaggaggtgaattatatgggaaacaagcacagactagggtttaatacaggtggatttgcaggttaccagcaaggtggccattttaattag

SEQ ID NO: 51281 - DNA, 364 bp, Glycine max
  Peptide Sequence Number=SeqID_142966
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctcaagccagttacctcggttcaagagtgtagctcagaaaccttcgaaaaccgccctgcaggcg

SEQ ID NO: 51282 - DNA, 483 bp, Glycine max
  Peptide Sequence Number=SeqID_142967
atgacggtgaaacctctgacacatgcagttcccggagacggtcacagcttgtctgtaagcggatgccgggagcagacaagcccgtcagggcgcgtcagcgggtgttggcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggaagtggaggagagggagaaagtggtgaggcgcatgtgggatgtgtatactcaaagcaagagtggcaggggaagtggcttacctcgtttttggagtgatgcttttcatgcggcttacgaccacttggtcagtgatgttcagagcgtccgagatgctgctgtctccgaaattgccaagatatccctccattctcttcctctgcaccacctcaaatcacattcc

SEQ ID NO: 51283 - DNA, 156 bp, Glycine max
  Peptide Sequence Number=SeqID_142968
atgggggggggggggtttggttgtttgggaaaactgccaggaaaccacatctacaagcgaaacctcaaagagagttgggcttcgtcctcaaaaggaaacaacaccaaaaaatctagccttccatggattcaaacagaaaatgcaattgaaacatga

SEQ ID NO: 51284 - DNA, 207 bp, Glycine max
  Peptide Sequence Number=SeqID_142969
atgaattgtgttttcgttcatgtgtcctccaccttcgagtttggagccatgcgtagtgattgcttagtgcaattctccattctcaaccctttttcggagccccatgaagaagaaaaaagaaggagtagagacgagagtcgtcatcacggaaagggcaggacagacgaaatcagtgtcttatctttgctttcctcttatctccgatga

SEQ ID NO: 51285 - DNA, 896 bp, Glycine max
  Peptide Sequence Number=SeqID_142970
atggcgcctgatgcggtattttctccttacgcatctgtgcgccccgacacccgccaacacccgctgacgcgccctgacgggcttgtctgctcccggcatccgcttacagacaagctaaacgctggtgaaagtaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggccacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtaattatctacacgacggggagtcaggcaactatggatgaacgaaatagacggatcgctgagataggtgcctcactgattaagccttg

SEQ ID NO: 51286 - DNA, 342 bp, Glycine max
  Peptide Sequence Number=SeqID_142971
cagcagttcgaaaggttgactatatcgggaatccccggatctacgcttattttcaactcccgaagcatttcgtcgcttactacgcccttctcgtctctgggtgcctagctttgtatcgactaagttcacgagttggagataagcggactcgaaccgctgacatccgccacagggatccagctacaggagaaccgggaacggagagcttcccccgccccccttttttttccgcccgactctttgctcttaagaatactgggttctatggtcggtccgcgacccctggatgccgaaggcgtccttggggtgatctcgtagttcctacggggtggagacgatggg

SEQ ID NO: 51287 - DNA, 303 bp, Glycine max
  Peptide Sequence Number=SeqID_142972
atgttacaacaggaagaagaagcttcatcctcaaagaaggaagacacaagttctgttgaagaagacgaagaagatcccttttaccgaaacgaagatgattgtattgaaagtggatccatggaagaatgcaggaacacgagccagacatttcaatacaagaaaaaagaacctagtagtgaaagacctttcttgaaaaatttccaacgacaaagccttccagccattttgggaccagggaatcccatcaaactcaatattgaacagggaatgtggtcaccaagagaagattatggcaccaaataa

SEQ ID NO: 51288 - DNA, 518 bp, Glycine max
  Peptide Sequence Number=SeqID_142973
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgcttcagccgaccgctgcgccttatccggtaactatcgtcttgagtccaacccg

SEQ ID NO: 51289 - DNA, 810 bp, Glycine max
  Peptide Sequence Number=SeqID_142974
atggcctcgatcacagatgaaattgatcaaattatatcagtaaagatactttcacaacaagatgatccagaactgtattcattagtaaaaaaccatttggttcatggtccatgtggaagtctgaatcctagatatccatgcatgaaaaaaggcaagtgtagtcgtttctatcctaaaaagttccagccgcatactgttttagatgctgatggttttccagtctatcgtagaagaaacaacggtaatgcaattgagaaaaatggtgttatagttgataacaagtatattgtaccttacaatgcaagattgctcagaaaataccaagtgcatatcaatattgaatggtgtaaccaaagcacttctatcaaatatttatttaagtacatcaacaagggatatgatagggtgactactattttgattgatgaagataacgatcaaactgagaatggtggcacccataatgatgagatcaaagaatatctagattgcagatacatatctccttgtgaatctacttggagaatctttggatttccaatacatggcagaaaacctgttgttgaaagattacacttccatcttcctggccaacatagtgttctctatgaggaccatgatgatattgatgatgtattgtctaagccatgtatctctgattcaaagtttatttcgtggctgacaccaaccaaaattctgttgaagggagaaatcttacttatgcaggatttgtttctaagtttgtatacaatcagaagaaaagatgttggcagcttaggaagaaaggctataccattggcagatactatg

SEQ ID NO: 51290 - DNA, 393 bp, Glycine max
  Peptide Sequence Number=SeqID_142975
gaacctaatggaaaggatcaaaaagttcactatctagtgacaactaccgagggtggttttatggactaccagcaacaatgcatcaccaaaagaggaaaactcttgatgagtcttcactgttatcaagcgagtcagagacctagcatgaccacagatcgacctccactccctatgtctcacacagactcgggtatatggcctaatatctcaatgtgtgtgaaaacgtgtaggtgtcatgtgtgcatagagcaatctaagaattaccccactgatgcaatcctccctaggaagggaccggtcactagaaccatgagcaacaagctccaagaagattgggctagagctgttgaaaaaggccctagggttctcatgaacctcagggtagatttctga

SEQ ID NO: 51291 - DNA, 423 bp, Glycine max
  Peptide Sequence Number=SeqID_142976
atggccagaacacgaggtttaggtcgtgccataggtagagttgtaggcagagatagagctgctgacgaggatgctggcgatgttcccgagaggcgtaggcctactgcctcagcccgtaggctacgcgttcatcagatgactacggagggacgtgatatggctgaggacgtcgctgacatgactgatgatgtccctgagcagcctacggaggcacctgagatgcatgcggacgcacagggtgctgatagtggtgaggggtcagatggtgatgatgctgcagagggattccctggtggtccacgtgacccgtcagtgctcacatcatttgccgagcatgttgcacatgccgtgtggagtggacaggaacgtcctgatttgaagttagtgtcacatgggaggaagctgacactgattgggaggcca

SEQ ID NO: 51292 - DNA, 816 bp, Glycine max
  Peptide Sequence Number=SeqID_142977
ctgcgtggaagactgagaaagtccttgtagctgattcattagaagaagtgaataggaaacttgacaagttctacatggttcttattttgaaaatcttgcattcagactttgatcatgtgcgtgatcaagtacttgctggagaccagattccatcgatggattccctcatcactaggcttctccgcgtgcctcatttattgaaggatgagaatcctactgatggagtggagacgtcaaccatggttgtgtctcgaggaaaaggaagtagtcgcaacaacagaggaggtcgcagtggaaggggtggacgtcctcattgcacttactgcaagaggatgggtcacacccaagagaattcttattcgttgcatgggtttcccgacaaggagtatttgaagcttaaatccgagaaacccaacaaccaagctcaatcctcatctgtaccatgtgtttcaacagcctgtatctctcaatccattgaaggttctagtccttggatactcgactcaggtgcctctgatcatatttctggtaacaaatcctccttttcatccttctcttttccaaaaattcctcaccacgttactgtagccaatggttccaaggttgtgtctcaaggaaatggtcaagaacatgggacggggcgactgattggagaaggacatgaatcacgaggaatttactacttggaatccagtccacttggggcttgttttgcaatctcaaagcccaaatttttgcatgatcgtctaggttacccaagtttaccaaaattgaagatgatggttcctagtctcaagaatcttcgagtcttagatt

SEQ ID NO: 51293 - DNA, 159 bp, Glycine max
  Peptide Sequence Number=SeqID_142978
atgatgttcttacatatcaagtggtatcagacattgaatgaatctcctattggacataaccatgcacaatcagttgaagtcacctcacatacaacagaccttggatgtgatggtttattggaggaagatgaaaatggagcaaagcaaaggatagtataa

SEQ ID NO: 51294 - DNA, 79 bp, Glycine max
  Peptide Sequence Number=SeqID_142979
atggacaaaggcatgacactagctgatgctcctagatctagcatggcattctcaaatttactgttcccaataaggcaag

SEQ ID NO: 51295 - DNA, 132 bp, Glycine max
  Peptide Sequence Number=SeqID_142980
atggccgaccagcaggcgaccaagtccaaagccaaagataagcaaagtactagtaggacacacctagttgctcatgatcctaggaatttaaataaaacaagcacaagctcagaaggtagaaagataccttag

SEQ ID NO: 51296 - DNA, 273 bp, Glycine max
  Peptide Sequence Number=SeqID_142981
atggcctttttagattctttgtttttcaaaagtattttcaggaacaggttattccaagatcatgatgaagaccaagtcaacttgtgtctcatgacaaaatctcatgacaacaacaaagaagaatctgtaaggaagaagtggtacatcgacagtggatgttccaagcatatgacaggatatgtgtctaaatttacaaccatttctcccaagaaaagtggacatgttacatacggtgacaacaatattagtaaaatctcaaaaaagattaattga

SEQ ID NO: 51297 - DNA, 469 bp, Glycine max
  Peptide Sequence Number=SeqID_142982
ttgtaccttctgatagtggacaggtgctatcctatacactctgggaaaattactgcttacagtttttgtcttatttgaatgatattgaagatgaaaggccaatcgttattctcttgactcatgctaggattaaggaagcgcagggatcatatctggcatcggtcagtaattctttcaaggcgtctaaactcatgatcaatgacctcgtgctggaaattcaagaatttagagagagccttttagatttagggatcgaggttagatcaattttggcgcctattggacaaaggagttcacaggtttcaggacaggaatttgtttgtgttactgtcgccaagattacaactatagtgatggacaactattcatggtgctatccggcttgtggtcaatgttataaaaaagctgacatgcaaactgtcctgttcacatgtccgtgtggcaaagagaatgatcaacctgtactcag

SEQ ID NO: 51298 - DNA, 357 bp, Glycine max
  Peptide Sequence Number=SeqID_142983
atggggacaaatcaaatcggaaaaagattctatcaagtcaagattaagggccaagatgtcactagccttaaggagttgggacggttgatgggacccctccagatgcaagccttccgcaaggcgtacggaaagattttagatttgaccatagcggagggattcggcgagagagttggatcgtgtaaagcaaactcgaaatggcgtagtgggcctaccgcggaagtacttggaaggcaaggcaagggatatggcgaatcaagaggagtgggccccgtttgtggacgtattagctttgctaatctttgggattgtcctctttccaaacgtggacagtttggcggacttagccgcgattga

SEQ ID NO: 51299 - DNA, 203 bp, Glycine max
  Peptide Sequence Number=SeqID_142984
ggctttttccggaggagctttggtgcttaccaacatggatggcgaagagctaccttcacccggatttcctgtctgttgtatctctcgttacaatctttcaaagaaatgaacgtggattcgaggcttttagtcctcacgggcaggatcaccttgggctaccttctggaatggagacaaaacatgaacggcagaaaccaatcaag

SEQ ID NO: 51300 - DNA, 507 bp, Glycine max
  Peptide Sequence Number=SeqID_142985
atgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcgatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgattag

SEQ ID NO: 51301 - DNA, 363 bp, Glycine max
  Peptide Sequence Number=SeqID_142986
atgaaaattgaagaatgtgaggtttatggccaaaagaatggagcaaacattcgaaccagtgacaaaaaacatgccaaggtttatccaatgaaagctagaaatggcattttagacaacaagattgactacttggaaaacaagataaagatggttgaaggagagttaagagaaattgctactattgaggctgctttatattcagtagttgctgaccatatggccttgacaacaggactaattgcgttggagagcaaaacattttcatgtttcaccttggcagtggtacttctaacgatcaaggataagctattccaagataaggttactgctggaaacactcacttaaggtggataggactttga

SEQ ID NO: 51302 - DNA, 636 bp, Glycine max
  Peptide Sequence Number=SeqID_142987
atgtgcctttctgctcatcgtcgtttcccgctgggcagtgaagatgacgcggtgcgggcgcaggggctggagattatgcgtaaagctatccagttcgcccaggatgtcggtattcgcgtgatccagctggcgggctatgacgtttactatcaggaagccaataacgaaacgcgtcgtcgtttccgtgacggcctgaaagagagcgttgagatggcaagccgcgcgcaggtgacgctggcgatggagatcatggattatccgttgatgagctccatcagcaaggcgctgggatacgcgcactatctcaacaatccgtggttccagctctacccggatatcggcaacctgtcggcgtgggacaacgatgtgcagatggagttgcaggccggaatcgggcatatcgtcgcggtacatgtgaaagacaccaaacctggcgtcttcaaaaacgtgccgtttggcgaaggtgtagtggatttcgaacgttgtttcgaaacgctcaaacagagtggctattgcgggccgtacctgattgagatgtggagcgaaacggcggaagacccggcggcagaagtggcgaaagcgcgtgattgggtgaaagcgcgcatggcgaaagcgggcatggtggaggcggcataa

SEQ ID NO: 51303 - DNA, 114 bp, Glycine max
  Peptide Sequence Number=SeqID_142988
atggcgtttttccaaagctacttggactataaagctcaaaacgcacaagtgagtaatgctcttggaaatgggaatgtagtgcacagtccagatgtcttctcaaagatcccaatg

SEQ ID NO: 51304 - DNA, 587 bp, Glycine max
  Peptide Sequence Number=SeqID_142989
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatcccattaatgctaaatcttggacgccttggtggtgatcccagcttcggggcaggaatgtattcatctgaagctacattggcggatttgcatggtcttatagaaggtgctcacttaggaaaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 51305 - DNA, 255 bp, Glycine max
  Peptide Sequence Number=SeqID_142990
atgggggtgcaaataacaattttcaaatttttgaatttggcccttccagaaaaatttcgaatcagggttgcttatggaggaagcaacccagctcgcctgggcgagctgggcgacaacctcctgcccccttttcctataaataggcgaagagaggctgttccaaagatccctaacccccttggctatgcatttcaggtgttttgggtgaaaaaaattgtttccatgaagaaaatccaagccgaggtgcttctgtaa

SEQ ID NO: 51306 - DNA, 787 bp, Glycine max
  Peptide Sequence Number=SeqID_142991
gtcgactctagaggatcccacctcgccggtcagcagtttggagaggcggccggtgccgccggcgcccagatcgatcaccacctgcggcatgcgcggcaggcctttccagtaggcggcgttgcgcgccaggcgaatatattgccccgagcggtattcgttgagcaggaacgggccgctgccgaccggctctcggtcgatcagctcctgatggccttcgcgcgtcagcgtgtcggcgtattcggcggacagcaccggcgcgtagtgggtcgccaggtgccacaggaacgaggcgtccggcgactgcaggcggatctccaccgtgtagtcgtcgagctttctcacgctctgcaccgaatcgccgaactgcaggctgtcgaaataggggtattcgccgccgttgacgtcgtgataagggtgtttttggtcaaatacgcgcgcgaagctgaacactacgtcgtcggcgttcatcttgcgggtgggggtgaaccaggcggtggtctggaacggcacgtccttgcgcagatggaagcggtaggtggcgccgttgtccagcacttcccagctttgcgccagctcggggatcagccggtaggtgtagggatcgacatccagcaggcgatcgtacagctgggcggccagggtatccaccgtcaggccgctgctggccatttgcgggttgaaggtattcagtatgccgctgacgcaatagacaaagccgctctggcgaatgtccggcagcggcgccgcggcgggcgcgggcggtgttgttgtggccagggcggagccg

SEQ ID NO: 51307 - DNA, 144 bp, Glycine max
  Peptide Sequence Number=SeqID_142992
atggaggaaggggctactaaagtggatgttggagtaggagctgcagaagtagaaggaagctcagctggccttgcccccgccctcctagcccctcgaatagaaactgttagatcctcggggttccaacaattcttcctaatgtag

SEQ ID NO: 51308 - DNA, 231 bp, Glycine max
  Peptide Sequence Number=SeqID_142993
atggtaaaacaggggcaggatcgccttgggctaccttttggagtgaagacaaaacatgaacggcagaaaccagtcaaggtgcttaaggatgaacgcaagcggggatggggtcacgaccgaccgatcgttacccttctctgtgcgaaacaagcagggaatgtcgctgcaaggcagccccgtatcctttgtattttgcagctttcttttactatttgtttgggaaaagagtaa

SEQ ID NO: 51309 - DNA, 96 bp, Glycine max
  Peptide Sequence Number=SeqID_142994
atgggggtgcaaatagcacccaggcccacttgggccctccagaatattcctccagaagaaaatctaagccgaggcgcttccgaaacgtttccgtaa

SEQ ID NO: 51310 - DNA, 939 bp, Glycine max
  Peptide Sequence Number=SeqID_142995
atggggtgcttttggaggggatttatttccgatggaggagctacatttaatgatctcgcgatcgatacattgaacaaatatctggttttggtttattctcaggatggaacacgcgtaaaaagaatttcaattgccggttcatctcaaacctgtaccaatgcagatccgggaaataatcccggagatacaggatgtgtttcttttacctataaaggaagtcaggtttcttattctactgttagaggtaaggatgggaaaatatggcttcagcagaatctgggaagcattcaggtagctacctcaatgacagatgaagattcttacggagacttatttcagtgggggagatgggatgatggacatcagaaaagaaattctcaaacagtaggcattcctacgccgaattctccagatgggttaaccggaattacttcttttgtaaccggatcctggtggaatgccaattcattaacagatcactggtcagcaaacaatatgaatgcggtaaactcaggaaacggatatgatccttgtaaagcaataagcctggattggaaaatgccgagccaggcagattgggctgcattgcaaagtgctgaagtaatcaataatcctgcaaccgcatacagcagtactttaaaattgtctgcgggaggatacagaggagcttcaacagctgactttacttttgttgggcaaagaggctattactggagttccaccccgtcagccttcggagccaaatacttttatatcgggaatactattggaaatccaaatgcaggcggaccaagaggccaaggacaatcggtaagatgtgtcaaggatgtatctgcgctaagtacttccgaaatcagacttaatacaataagtgtatatccaaatccaacgaatggaattgttaacattgatgtggattcagcaatagaaaatgtgcag

SEQ ID NO: 51311 - DNA, 180 bp, Glycine max
  Peptide Sequence Number=SeqID_142996
atggcatggagcagaatcgtctcaagccacggtcagaagtcaagacaagtcaatggtagaaatcaaccaaggtacttagggatggaggcaaatggaggatatggtcacggccaaccgttgtcccttcccagcgctagacaaacagagaacgtcgctgcatggcaggccaatatcctttga

SEQ ID NO: 51312 - DNA, 246 bp, Glycine max
  Peptide Sequence Number=SeqID_142997
atgtatcttcctattcctcaggcctttaaaattgtcgaaactgatgcatcagacaaagaatatatcaagggcacctcaaactctctacctgactaccttatgaattcttacagaaaaatggtaatgcctcctaaggcatcaggagcctccctgagaggaggtcgaagtacaggaaaaggatctaggctggctctaccggagttgtccactaaaaaatcatcaacttcttctgggtcaccaacctag

SEQ ID NO: 51313 - DNA, 336 bp, Glycine max
  Peptide Sequence Number=SeqID_142998
atggctccgaaaaagctttccacaaagagatctaggagggacaccgtggctgaagggtccagtgccgcccccgagtttgatagccaccgtttccggagcgccgagcaccagcagcgcttcgaggccatcaaaggatggtcgttccacagagagaggcgcgtccagctcagggaggatgagtatacaaattttcaagaggagatagctcgcagacattggacgtcactggtaactcccatggctaagtttgaccctgaggtagtcctggagttttatgctaatgcttggcccacagaggagggagtgcaagacatgcgttcatgggtgaagggttag

SEQ ID NO: 51314 - DNA, 150 bp, Glycine max
  Peptide Sequence Number=SeqID_142999
atggagtcgccaaccgtcgcaacatgcccttttgtgggcgtgcgaggcgaggctcacggtgcgttttccaaaggaggaaagatgcgcggagtcgccaccaacgtcgacaaaagcgaggctcttgctcctacgtaccctcccgagaaatga

SEQ ID NO: 51315 - DNA, 231 bp, Glycine max
  Peptide Sequence Number=SeqID_143000
atggtagccataacctctgccagggttcctcaacctccattttttcgaggatacgactcgaacgcaacatgtgcatatcatggaggagttcctggacattccattaagcaatgtatgaccttgaagcccattggtttgtttgctcaagcgacatgtgctcctaagttttttgacttccaagaccgttcaatcagagattactcatcctgcacatcgatgggggtgccgtaa

SEQ ID NO: 51316 - DNA, 180 bp, Glycine max
  Peptide Sequence Number=SeqID_143001
atgaccaagtgcccctccactacgaatttcagtttttggtggagtgtagaaggcacaactcccactgagtggatccacgggcgccccaacaggcagctggcctatttgtactgggagatcgatctctcccctaacctctcggcgagtgccgtcgaaggcccgacaccggggatcctctag

SEQ ID NO: 51317 - DNA, 272 bp, Glycine max
  Peptide Sequence Number=SeqID_143002
atgaccaattgcccttctcgattcgattcttctttctcatacgaggttgtgaagacccttgggtacttgtacctaatgccttacactggaggctacaggcatcctcgccttcagaggacatggggcacgatcaaatctcacccattgttagaggactacacgtcctcgcctaggctgtacgccctcaccttgagaggactacacgtcctcgccaacagagggctgcacgccctcaccttgagaggactacacgtcctcgccaacagagggct

SEQ ID NO: 51318 - DNA, 456 bp, Glycine max
  Peptide Sequence Number=SeqID_143003
atggttgtggttgtgggcgaaactgagggccctccaaagtgttttcaaagggtataccaccaactgcttgcccttcagtggcatatccgagccaaggctcgaagtcagctaggttgtggtggggaatttcatgtgtctcccccatggccagatgggggcatcaggttcaccttagcaacaacgttggtagcggcaactgcaaccataccgacttcccttatctttttcctgcttattatggcctccatcattgtggccatttgctctttcatggcctccatgtcggccttcatatgctcttgcaccttctctacctcacccattactatagctctagcacggggtttggaaagaatgtgtcgcaacctacccttcggcgggagggcgacgcgagactcgcgggatgcgtgttccacgaaaggaatacgcgcggagtcgccaccaacgtttatttga

SEQ ID NO: 51319 - DNA, 423 bp, Glycine max
  Peptide Sequence Number=SeqID_143004
atgacggaggagattataacaatgatagtggacacgttgtcggtgttctactatgagaagatggtgggttccatgccttcaagctttgctgatttagatttcaccggcgaaaggatcgaagttggtctaagaagaggaaaatttgattatcctgctttgatggatgggaagcttggggcaaatggagagagtaataaggagggaggaacccatgttgtgaccattgttcctacatggccaaatttcccaccagctcaacaatgtcattactcagccaatatcggctcttcttattacccaccaccctatcagccaagaatacccaatcaaccacaaaggccacccctaaatcagccacaaggcctgcctgccgcacatacaataccgaacaccacccttaacacaaaccaaaacactaactag

SEQ ID NO: 51320 - DNA, 210 bp, Glycine max
  Peptide Sequence Number=SeqID_143005
atgagcgataactttgtgtcgcaacgtgcccttcgcgggcgagcgagggcgaggctcacgggtgcgctttccaaaggaggaaagatgcgtggagtcgccaccaacgtcgacaaaagcggggcttttgctcctacgtaccctcctttggagaggaaatcagacctacgtagttctttcttaagcgtgaatcaagtgattctctttacttga

SEQ ID NO: 51321 - DNA, 495 bp, Glycine max
  misc_feature (41)..(41): n is a, c, g, or t
  Peptide Sequence Number=SeqID_143006
gtgattgctgacgccatctatttgtttgcaggtatgccacncaccaggcaccttctagacccggataagtctaacagggccctggggttttcggcattgatcacgggcctctgccaatcgttcagggcacagggtgacgcacctcagggcacggccgcaccgccaccacctcatcaggccggtcccgctggatcactaggcatgaagcgttatctacagcacttggttcgccagcaggcagccaaccaccgtggactggtgcagatacacgagtgtctctaccatttcagccgcagtcagcaggggcaaagttccaccccttttgtgtgccctaccccagagcagtttgcggctgaggacgcatggccaggagactggtccgatgcccaggtaggggaggagcctacaggatcccccggtaggatggatgagccccgcatggacgaggatatgactgacctgttcgatttcttgggagggagcggagccacatga

SEQ ID NO: 51322 - DNA, 312 bp, Glycine max
  Peptide Sequence Number=SeqID_143007
gtcttgggagtctaaactcaggagcacaggtcgctcgagcaaacagaccaatggcttgcacccacattccggatttacacgcgattctcctcaaatttcagccagcccgcatcaattagaccttgcaccttacacttcagagccctacaatgctcaatggaacgccccggggcttctccgtgacaagcgcacgttgcgttcgagtcgtattctcggagaaatggaggttgatgaaccatggctagggttatggctaccattgaattatcaagtagatatgggagcaagtcagcataggacactggaattggg

SEQ ID NO: 51323 - DNA, 162 bp, Glycine max
  Peptide Sequence Number=SeqID_143008
atgagaagaaaagctataaagaaagaagatccaagaaggcgtatatcgcttgggatgacaatgactcatccgatggtttggagaaggagatcaaacttctatccaaggactatgaaagtgatgagaacatctctcaagaagtttaaaagaagtgtctggtaa

SEQ ID NO: 51324 - DNA, 1089 bp, Glycine max
  Peptide Sequence Number=SeqID_143009
atgtccgctcctgagccatcgctcgtgtactcccccccccccccaatggattgggaccagctcttggccgggataggaagtagaacaatcagtccccccccccccgacggaaggaaggaaaagaaggagtccttttctcatgtggaagatacccaaacattccgctgggtaccccatgaggggagcaccgacggaagaaaacatgtctcctttccttgtgagggatctcggcgcacaaaattccaagactatacaaagatccataaggcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaggatgtccaagctctcaaaagcgagttaggaaaggcaaaactcgccaaggagaagttcaagttggctgctacacacgttcggaaggagtgtgccgggttacgggaagagaatgcaattaccgcaagagcccttgaacgagagaccaagagggctcgcaaggaagagtatggccggaacaaatttcgcggagccctatggggtagcaataatgaactcaagttgcgaagggaggaaagggaccagtcgcgagcacatagcatggttttgaaagaggagttagttgcctgttcaaggtccaaaagaagcttgtctcagcgtttatgcgagacggagaccaacatgctagctatcatcgccaagtaccaagaagagttaggtctagccacggcccacgagcatagaatcgcggatgagtatgcccaagtatacgcggaaaaagaggctagaggaagggtgatcgactctttacaccaagaggaaaccatgtggatggatcggtttgcccttaccttgaacgggagtcaagaacttccccgattgttagccaaggccaaggcgatggcagacacctactccgcccccgaagagattcatgggcttctcggctattgtcagcatatgatagacttaatggcccacataattagaaatcgttag

SEQ ID NO: 51325 - DNA, 366 bp, Glycine max
  Peptide Sequence Number=SeqID_143010
atggtcatcagttttcacacggaaggtcagattcaggcgcataatatatcaagacgactcgaaattgaacaatcggaagctgctcgagaaattcaaatggtcataacttttgcactcggaggtccgattctggcgcataatatatcgagatcgctcgatattgaacaatggaagctcttgagcatttcaaatggtcataacgtttcactcggaggtccgattcagggcgataatatatcaagacactcaaaattgaacaacggaagctcttcgagaaattcaaatggtcataacttttcacacggaggtcagattcaggcgcataagatatcgagacgctcgaaattgaacaatggaagctcttga

SEQ ID NO: 51326 - DNA, 213 bp, Glycine max
  Peptide Sequence Number=SeqID_143011
atgggtaatgtagaggaggcgcaagagcagatgaaggccgacatggaggccatgaaagagcaaatggccacaatgatggaggccttgatgagcatgaagaagataatggaagccaatgcagttacagttgctgctaccagcgctgttgctaaggtgaacccgatgcccccatctggcctcaaccaaatgatcatccaacctcagctatggtag

SEQ ID NO: 51327 - DNA, 367 bp, Glycine max
  Peptide Sequence Number=SeqID_143012
atgtctgtgcattgggtgtacgatggaaggggacatatgactattaccagagctcctaggaataccggatccaagcaatcttttactagacttgaaggaggtcataataatcagtttagggagtgggggaaaggaatgacaatctccgtaggaagtctcatcttagctatcgcccacggctcttataaaaggctttggttggattgctgctatcttgctcagtggattgttagccagttgcttttctcccttgaccttgctactttcatagccatagcaggaagcctggcaactttctttcgagacatggttgaagaaaaggctaatgccctgactccaacggcgcctactccttcccctaaagcgg

SEQ ID NO: 51328 - DNA, 210 bp, Glycine max
  Peptide Sequence Number=SeqID_143013
atgaagtctgacaaggcagtggtggccttccttggaaggcagttcactgcgatacagaacctggacaggaggcagaaaccacatgtccagaacatccctttcgacacagaaggaaaggcagtaaataccagaagagagaactatgctccagaagtgagaagattctcagcagaaccaactgaagaaggcttgcgaaaatctggaggctga

SEQ ID NO: 51329 - DNA, 303 bp, Glycine max
  Peptide Sequence Number=SeqID_143014
atggcggcgcagctaatccatgatcgagtggagatggagtgtctagagggagcttgggagaccctcgaaggcaacacgaggtgggagccagtccacgtgattgaggtaacgtcatccgaggaagaccctgaggaggatctcgaggagctacctcctgtggatgctcttgactttctagagggtgatgaggacccactccctgaggtggattctcccgaggacgtcatgtcggcatccgaggcagactctacagaggatagtggccttggggagatggcgattagtggaggctcttcatcatag

SEQ ID NO: 51330 - DNA, 498 bp, Glycine max
  Peptide Sequence Number=SeqID_143015
atggatatgaatatgggatacctcatttcccaccagatcttcctcactgctcagcatgatacatctagacttggattcccgaccttgattacagctttatgtaaggctaggggagttcagtctgactctagatccttggagagcctaagtcctgccattaatttggcttatattaagaagaactattggaatcttgatgatccaataatagctttcagaggacccaggaaggccaaagggaagagatctgaggccccttccacttcaacatcagaggcaccaataccctcttcttctacacttcctccttcttcctccacagatattccagtgattcctccaacgccttcacagataccactaccagctcctctttctgcagatgcttcactccatgctccagagcatccacagagggcagtacatcatcatgcagatccttcagggcttgggcttgacctccattatgagcacggaggagtttgggggatcctctag

SEQ ID NO: 51331 - DNA, 480 bp, Glycine max
  Peptide Sequence Number=SeqID_143016
atggcatctaagaagaggaaagctccttctatacctacccaggccagatttgatagatccagattcacatccctagaggcttgggagagatacactgacattgtggtgcctcgaaagctactgctagagaggaatgtggtagtttattacacagagttcgacgagttcaagaaggaactcgagagaagacattgggatgagaacctgactgatttttctgatagtagcatagacatcactattgtgaaggagttttacgccaacctttatgatcccgaggataaatcacctaagcaggtgagggtgagaggtcacttagtgaaatttgatgaagatactcttaatacatttctgaagacccttgtagtgcaggaggagggggagaatttgtgtacttattccagatttgcactcctaaggtcggatcctcaggagttggctgctaagctctgtatcccagggaggggattcgagcttaat

SEQ ID NO: 51332 - DNA, 273 bp, Glycine max
  Peptide Sequence Number=SeqID_143017
atgcaagagaagactagctccatgaagtgcttcaaatgtcttggaagaggacacattacttctcaatgccccaccaagaaaaccatgattatgaggggccaagacttttatagtagccaagatgaggctactacttctcctttctctagtgaaagtgaagaagaaaaaggggaagaatctagtgaagagatctacccccaagaagaagggcaacctttaatggttaaggaggagtgtaaggaggtattattaggcaccaaatccctaaaatag

SEQ ID NO: 51333 - DNA, 219 bp, Glycine max
  Peptide Sequence Number=SeqID_143018
atgggtataccaccaactgcttgcccttcagtggcatatccgaggtgtcgcaacgtgcccttttacgggcgagcgagggcgaggctcacgggtgcgctttccaaaggaggaaagatgcgcggagtctccaccaatgtttatttgtggaaaacgtcggaaaaaccgaaggaaaccggtcaaaatgaaaattctaagttcgggagttgtatttacgcttga

SEQ ID NO: 51334 - DNA, 552 bp, Glycine max
  Peptide Sequence Number=SeqID_143019
atgcaaagaagatctactgtaggtgatttgatccccattgatttggagattaacgacccttgtagaaggcgtaatcaagagagaattagaaattttttgcacgatttagaagcagcaacaattccaaaggaagaacctcaatcttctaaggcatcttctagttttcctattgcagggcattctcatatagaaccttttgaagatacaatcatggctgaagagccaagaagagtaaccttggaggattattcaagttctaatgtgccacaatttttcaccagcattgctcaaccagaagttcaagcccaaaccattacatatccaccatcattgattcagttgattcaaaataatttgtttcatggattaccaaatgaagacccatatccaccatcattgattcagttgattctgtggtttattgagaaaaactctcactcatggattctcagaaccgatacagctcaacatttttatagatgggttaagaccgcaatccaagcagctattggacgcttctgcaggtggaaaaatcaaattgaaaacccctga

SEQ ID NO: 51335 - DNA, 729 bp, Glycine max
  Peptide Sequence Number=SeqID_143020
atgtctctatcagtagcagctaacagcttggcggttacatcacactgctgcagtgctagatttacgagcactttccctcagtcgcggagtccactgctgatcaggactacgacgaggattcctcgcgtgcatggagcgcctagaccgactctggattccagatgtctgttggatcctgtatggggagcaccgaccggtccaggacttccatttgatttcatgctattccggtctcctgcgctgggggcttgttgctgtttattaccaaccagagagggtcgtgcggcagtttggatacacacagaccattcttgctttggttgtcgattcatgtatgatgatatacacgacaggtggatgcactactcgaatcatatcgttccagtaggtgaggtgtgcactgtgccaggtcagtgtgctagtgactacatagattggttcttccgcatctcgcatcctttcaagacaccaagccacacatcagatcctccgcagccccgagtcatccctcaggccccacagacagatatccctcacgtgtcggagccaggagcaccgtcgacatctgcgaggctcgctgaggagcctagacatgcagtgaaagtttgccatgggattgctgagaggttggagcgccatttgagcctaggggtggtcacaccaggctcatcgacacatgaggtgatcgaagaatgtctcaggatggccaggagtgtcacacaagactag

SEQ ID NO: 51336 - DNA, 294 bp, Glycine max
  Peptide Sequence Number=SeqID_143021
tgtaagactagaggcaatccatctgacttacaaccctttgatcctgagatagataggacatttcatagattagttaggcatcatattgtagcttttgaacatcctgagcattctgttattggtgagtctgagcattctgtggttggtaattttgaacatcctgattttgagcattataattttgaacattctgagaacatggcacaacctccacctcgtgagaggactctaagggaaatggctgcacctgatttcacctacgaaaacttgtgcatccaataccctgatgaggat

SEQ ID NO: 51337 - DNA, 589 bp, Glycine max
  Peptide Sequence Number=SeqID_143022
ggcttctccacctgcctcacctcctcctcctctgccttcagatgcatcagcttcaccgtgtgccgtgaagcagacacgcaaagcctcacgtctacgatccttgtctgccagaccacctggtgctgatagactagtggtccacgttgatcctactactggcaaggccgacgatccccacaggaagaaattaagaacatatttggggattgtggcaggtgataaggtggacgtcacgtataagaactggaagcaggtccctactgctcagaaggacttgatttgggaggatattcaagcggaatttgaaatctcagaggcttctgatagtaggacgaaaaagaagttgcttcagattgtcgacgagagatggaggcagtttaaatcaaatctcacgaggaaatgggcccttgcagtcgatcaggacggtgtggacgacactgtctgtgagaaatatggcataagcaaggaaaaaataggctcagttttgccaaactcacagagacccttcttgggaggatgtgcgcaaaaaggcacaggccatccagaaatagaacactaccccccacgttttgtctcgtgggggttatga

SEQ ID NO: 51338 - DNA, 245 bp, Glycine max
  Peptide Sequence Number=SeqID_143023
agcttcgggaatccatttcgagcgttccgatatattacgagactcaatcggacatccgagtaaaacgttattgtcgtttgaatttgttcagagcttcaacattcaattttgagcatctcgatatattacgggactcaatcagacatccgagtaaaaagttattgtcgtttgaatttgctcagagcttcggttttgcatttcgagcgtctcgatatattacgggactcaatccgacatctgagtaa

SEQ ID NO: 51339 - DNA, 395 bp, Glycine max
  Peptide Sequence Number=SeqID_143024
cccatgggctcgaaatctaccctaaggctcatgagaaccctagggccttcccttggatctctggcccaatctacttggagtcttttatccaatgcccttgcggggtaggattgcatcaggatgcacatgccaaagttgagtatgtgaaaagattgtatgaccaagcgaaggtgcaaattgcaaagaagaatgaaagctatgccaagcaagccaacaagaaaaggaaggaagtggtacttgaacccggtgatgatcctggacatttgagggcaaatgttttccaagaaggagggaatgatgagaatcctgaaaatggccaaatacagactaaaggcccaagtggagaagggcgaaggcccaagtggagaaggacaaagcccccgagtggagaatga

SEQ ID NO: 51340 - DNA, 306 bp, Glycine max
  Peptide Sequence Number=SeqID_143025
atgcaacagggacaggcagatattctcatagctaggttccctgaccctaactatggtgtcaaaatggtaaattttataataactcccctcacctatcgtgagctccccgtcagttcctctttgcgtcacttagagatccctctctcgttcgcgcttgtcgattcaacgcaagtctctattacgccaaaacgaaaggaatttaatatggatttcaaaaacaaggtcaaagggtttttcaaaggaattgtaaaaacaccttattacagtactcaacacataagagacactaagaggaactcaaactag

SEQ ID NO: 51341 - DNA, 220 bp, Glycine max
  Peptide Sequence Number=SeqID_143026
atgaccctcattattggaaaaccatttggtggtggccatacctggaaaagtcttccagtcaccgtaccccaagtgggccccaacattaagaccaatccactagccagtcatggaggagctagcataaacgccattgaaaaggataggccgtcagggtcaaagagattagaaaatgtggctacatctagaagattcatctaccagtcgctgcaggcagcat

SEQ ID NO: 51342 - DNA, 396 bp, Glycine max
  Peptide Sequence Number=SeqID_143027
atgttgctaagtagcaatgtcatctatatctgtgtaagagtggtcatgttggtgcgcctgatccgcactcgtctctttgcagcggcacgggtgaaatcttgccccagtatgcatagtagcagtgtgatagcctccctctctagttgtgctcgcatagttggcgctcctccaatatcagggggtggcccaggaaccgttaaaaggaaactactggtgtggatatggagcccactgaaagtgaggacacgtagtcctctaaaggtgagggcgtgcagccctctgaagttcaggacgtgtcgcctttcgaaggcgagggagtgtagtcctatgatggcaaggacgtgcaatcctctgaaggtgagggcatgcccccctttgaaaatggggaacatgtag

SEQ ID NO: 51343 - DNA, 225 bp, Glycine max
  Peptide Sequence Number=SeqID_143028
atgaatattgaagaatccattcatgtttcctttgatgagtctaatgttatttctccaagaaaggatgtgttagatgatgtttcagatttcttagaagagatacatactcatgaaagggattctaaaggaaaagagatgaaagcaatgaggattctcaagactacgaaactcaagcaaacgatgatcttccaaaagagtggaaagcttccagaaattatcctttag

SEQ ID NO: 51344 - DNA, 255 bp, Glycine max
  Peptide Sequence Number=SeqID_143029
atggcggacgtaaactcagctcccgaggaagttcataggcttttcaattattacttggacaagataaacaatgtttatcccttgtcgcaacgtgcccttcgcgggcgagcgagggcgaggctcacgggtgcgcttcccaaaggaggaaagatgcgcggagtcgccaccaacgtttatttgtggaaaacgtcgggaaaaccgaaggaaaccggtcaaaaagaaaattctaagttcgggagttgtatttacgcttga

SEQ ID NO: 51345 - DNA, 513 bp, Glycine max
  Peptide Sequence Number=SeqID_143030
atgcctgcaatcgactctagaggatcccccttttatcagtttatgggccacccccctgatattggagggcgaccaactgtgcaagcacaaccagagagggaggctatcacgcagctactatgcataccgggggatcgcgaccacaaggcacccagtggacccggaggagtccaacggggccctggggtctccagctttggttacgggcctctgtcagtcctacagggtggccgttcccccctagcaaggtcacgccattgtgacatagggatcgcgcctgcaggacacccggtggacccggagacgtccaacagggtcctggggtttccagctctgattacgggcctctgtcagttctacggagtgcctgccacccccagcaaggtcatcagccccctactaatcgagttttcatcaagaggtattgcgcccccaggcaggcgcaaggcgaaacaccacagcagcctggggatggccagcaataggcaacaaatgcaccgtcgccacctctag

SEQ ID NO: 51346 - DNA, 261 bp, Glycine max
  Peptide Sequence Number=SeqID_143031
atgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttggaacaaaagctggtcccgggccccccctcgaggtcgccggtatcgataagcttgatgaggattttactggccataagggcacaattggtcctggttcctgcagtggatga

SEQ ID NO: 51347 - DNA, 622 bp, Glycine max
  Peptide Sequence Number=SeqID_143032
aaagggacacgctttacgacgcccttaccgaactcgtgctagagctagagtaatgggtgaagtagaggagatacaagagaagatgaaggccgacatggaggccattaaagagaaaatggcccacaatgatggaggccatgatgagcgtgaagaagataatggaaagccaatgcggttgcaattgcccgctaccagcgttgttgctaaggtgaacccgacgtccccatccggcctcaagcaaatgaatcatccaacctcaaatatggtaggcaaagatttaggaagtacgggtggcccccatgatgtgcaaattcaaaacgagcacgccttcccgtcatatggcttgcctctcaactatacgccatccaatgtggcgtacactcccaataagaatacccatgaaattccccatcacaatctagccgacttcgagccttggctcggatataccactgaagggcaagcagttggtggtatacccctacaaaaccctttggagggccctcagtatcacccacaactgcacctcttgcattccacagcggttaaaaaccctcatgactatggcaggaatgggaaagttggatcatctagaggaaaggctcagttgccattgaaggag

SEQ ID NO: 51348 - DNA, 299 bp, Glycine max
  Peptide Sequence Number=SeqID_143033
tctccgttggtggtcccgtgaagtatttgaagatttggtggtcccgtgttccgtatttgaagttttattagtggctgttgttcctatttcgtcggaggtacgcatctatttcgttttccggccaattccagaagaagtgcttccggaaactacttccggaattggacttagtaacttccgaaagaccttcttctggaagttactaaggccaattccggaagaaggtcttccggaagtattttccggaagcacttcttccggaattgggcttagtaacttccggataccttctttcggaa

SEQ ID NO: 51349 - DNA, 444 bp, Glycine max
  Peptide Sequence Number=SeqID_143034
atggcgcctaccaggcaccctttggatccagataagtccaacagggccctggaatttcccgcgctgatcacaggactctgccagtcgttcggagtccccgtggcacctaccaaggtgattcggccgcccatcacccgggcttttattgagaagtactgcacccagagacaggctcaggggaatgctccacaggccgcgggcgcgccaccaccacctcatcaggctggcccggctaggtcatttgacatggatcagtatttacggcatttggttcgccagcaggcggccaaccaccgggcacatgtacagacccatgattgtctgtaccagctgagcctcagcatgcagagccagggcttcacttctttttcatgccctactccagaccagttcagggcagaggtcgcatggcccgaggattggcccgaggcccaagcaggatag

SEQ ID NO: 51350 - DNA, 667 bp, Glycine max
  Peptide Sequence Number=SeqID_143035
gggttatgattatttggagcagaagctcctggctgagaagacgaagaagaagctggaggaagctgaacagtcaggaagcgttgatggcatcatcaacccttcatccccggtcagacgccatgtgaagtggaagatggcctgcacaaagaagacaggggagatgacgactgaggtcgcaaaggaaatcgctgagaagattgattcctttgaggagcaggccacacaaggatcgttcgtcccccatggacgtcaggatgatctcgccgttgctattggacatccagagcaccctggacgtgtccgtgctgttggagccgatgtcaccatcaagcaatactttggatcggctccacggacgtcccacagcgcttcctccctacctcttgacaaattgcagcaactaacccagcaaatcagggaccagctaaaggagtccatcacagagaaagtgacgaggcaggtcatggcatccttcagccacatgcagccccagcttcagtcgcagatgcaatctcagggacttgcagtgtctcctgagcctctagttggtccctccggtcctcgagtgagcacaaaggggagttgtgttgatccctcaggaaacgatcctgagacgggtgactctgacaagtgcggcttgtacatagaagcagatcctgcccgcctg

SEQ ID NO: 51351 - DNA, 393 bp, Glycine max
  Peptide Sequence Number=SeqID_143036
atggggggtggtcagcattgcagaatggcaaagttcattgctgggattctcactggtggaaagaccttaggagattatatcagcacaatgatttcaagattatccatcagaatatggcatggaaggctgcagaatgattttatctccaccatgggtagcttctcacagaatatttggagatgggatttgaaatggaggagacatctcttcgagcatgaggagggtgtagctgtggcttttatggaagacatcactgcttatactcttcagaatcacttgaaagataagttgctgtggaaagctgatcctagtgggctatactctactaggtctgcttataggcttctatcaagtcaaaacagtactgctttagatgggataaatttccagctt

SEQ ID NO: 51352 - DNA, 840 bp, Glycine max
  Peptide Sequence Number=SeqID_143037
gatgtgcgcatgaaggcccaggccatccagaagcagaatactgccccccacgttttgtctcgtgggggttatgattatttggagcagaagctcctggctgagaagaccaaaaagaagctgcaggaagctgcacagtcaggaagcgttgatggtgtcatcgaccctccactccccggggagatgacgactgaggccgcaaaggaaatcgctgagaagattgatttgtttgaggagcaggccacacagggatcgttcgtcccccatggacgtcaggatgttctcgccgctgctattggacgtccagagcaccctggacgtgtccgtgctgttggagctggtgtcaccatcaagcaatactttggaccggctccacggacgtcccgcagcgtttcctccctgcctcctgacgaattacagcagctgacccagcagatcagggaccaactagaggagtccatcacaaagaaagtgacgaggcaggcacctcctgagcctctggttggtcctggtccctccggtcctcgggtgagcacaaaggggagttgtgttggtccctcaggaaacgatcctgagatgggtgactctgacaggtgcggcttgtacatagaagcagatccttcccgcctggttgccatggcgagagtttatgagggatcgactcttgttcatagcactcctttgtttcctggccaagtaaaggtgagtgtggacgaggttaaagatgtagatgctccagttcctatacctaatgctgagggatcgactcttgttcatagcactcctttgttgcctggccaagtaaaggtgagtgtggacgaggttaaagatgtagatgctcca

SEQ ID NO: 51353 - DNA, 144 bp, Glycine max
  Peptide Sequence Number=SeqID_143038
atggatgtacgctccaatgtgttaagacaaagaattcttaggcgagggaagaggaagaatcagaagaattctcaggtggttagtcctatgaattcttttgggaagagggtgaaggaagaatcaaaagaattctcaggcggttag

SEQ ID NO: 51354 - DNA, 447 bp, Glycine max
  Peptide Sequence Number=SeqID_143039
atgcatgaacaacaacgcaattcatgtggctccgaaagaaggggtaaagaatggaaaattgcactaagcaaatcgaattcctgcagcccgggggatccactagttctagagcggccgccaccgcggtggagctccaattcgccctatagtgagtcgtattacaattcactggccgtcgttttacaacgtcctgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 51355 - DNA, 921 bp, Glycine max
  Peptide Sequence Number=SeqID_143040
atggcgcgattctccgatggcctggacgagatcctggtggtcgaggaaaagcgccaggtgctcgaataccagttgaaggaggaactgttcagctggatcggcagcggcaagaagatcccgcgcgtggtcggcaagttcgacgacaaggatggcggcgaatgggcggtgccgcagggcaactggttgctgccggcgcactacgagttttcgccggcgatggtggccaaggccatcgccgcgcgcctgttgcgcttcgaattgccggccgacgtgcgcgccggcatcgaggcgcggctggccttcatcgccgatcgcgaacaggaaagaacgcgcccgcgcgtggtggaagaccgcaagccgtggttctgttcgggctgtccgcacaactacctcgacgcgggcgtgacctgggccgggcaggcgccgttcaccgataccccgcacgtgttccagaacctcggcgacggcacctacttccacagcggttcgctggcgatccgccaggcggtcgccgccggcgtcaacatcacctacaagatcctctacaacgatgcggtagcgatgaccggcggccagccggtggacggcccgctgagcgtgccggacattgcaaagcagatgcgcgccgaaggcatccacaccatcgtggtgctgtcggacaacatcggcaagtggaccggccagcgcgagcacttccccagcgacgtcgagttccatgaccgcagcgagctggacgaagtgcagaagcgcctgcgcgaagtgaagggtgtttcgatcctgatctacgaacagacctgcgccaccgagaagcgccgccgccgcaagcgcggcaagctggaagatccgcagaagcgggtgctgatcaattcgctggtctgcgaaggctgcggcgactgcggcaagaagagcttctgcgtgtcg

SEQ ID NO: 51356 - DNA, 375 bp, Glycine max
  Peptide Sequence Number=SeqID_143041
atggcagaaccatcgaagaagcggaaaggcacttcaagtcgaaaaatccatgaaggtaccctaatgtctgaggtttatgggattaagatggtcattgaccaatccctattttatgatttaacaaaattgcctagtgaaggtgtgccttttgagggtgcactgattgatgattggaaattcgatttttctgtgcatgatgtccgctggttagtttgcaccaaccaagcagatatgaccggaaggcttcttgccggttcattggcttttgaaagccgcatcctccattaccttattgttcgcattttgcttcctagatcttcaaaccttgcccaggtttttgaagaagatctcattgtcatgtggggcctttcataa

SEQ ID NO: 51357 - DNA, 525 bp, Glycine max
  Peptide Sequence Number=SeqID_143042
atgttggaaagttttaaacaacaagaacaaatgtcagttctggaattgtacatagaaaaggatgtggctggtggttcaatgtttcattctgcaaattcgcttacatcatgtggaaattatttatctaatgatgagacacaaccgacaataaatatgagcaatttacatattgacgaagacgatgatggtgatgatgatgattatcttgtgtctaactcatacgttgaagagtctttagacgaagatgacagtgttgacggtatatctgataccgacgatgaagtcaccaacattcctcaaccagtaaggattgttcacccaacaaaaggtgcacaacgaattgaaaatccattttggaatgatgctatgcattataacaatatcaacaggagttatcctgatgaagaggacatttgcggtttggagttgtcgtcgacctttaatattgaccaagaattatatgttggcatggaatttgatagtaaagatgcggtcaaaaatgcagtcaaacaatatgttatgaag

SEQ ID NO: 51358 - DNA, 327 bp, Glycine max
  Peptide Sequence Number=SeqID_143043
atggtgggttacacaccttcaagctttgcggatttggtcttcgctggcgaaatgatcgaagtgggtctaaaaagaggcaaatctgatcatcatgctttgataaatgcaaaaaaaactggggcaaatgaagagggtgagaatgaaggagaaacccatgctgcgactgccgttcctacatggccaagtttcccaccaacccaacaatgtcattactcatccaataacaacccttctccttacccaccacccagttatccacaaaggccatccttaaatcaaccacaaaacccacataccacacaaccaatgcccaaacaccacctttag

SEQ ID NO: 51359 - DNA, 586 bp, Glycine max
  Peptide Sequence Number=SeqID_143044
ttctccagaaggtgccttctggaggaagcaacctaactcgcctgggagagctggatttcgccaaggtgtgagaagagcagtacgaggattgtttgctgtactccagctctttatgtatggttggtttcgcacctttttcgccaagaggaagaactaccctatgagaggggcaccactagaggaagagctcgcgcttgtcatttcacgaggtttcaataagaacaacatggagacacttcaaaaggtctgcaaggcatgggaggtgttgcaaaagaaggacaaggaactcaggggcagtaacaatgggcccatcggtggctaccgtaagtggttgaaagcccatgttcaaggtttggattggattccgagtttgagaaccgataaaagggaggaagttgaggcaccggaggaagacgaagaggtgcaggcccttaggacagaactcgagcaagctcaaacagtcaaagaaaggaaaccaagagggctcgtagggaagagcacggctggaacaagttctgaggggctctgtggggcagcaacagcgagattaagcttcggagagaggaaaggaaccaatcatgaatag

SEQ ID NO: 51360 - DNA, 126 bp, Glycine max
  Peptide Sequence Number=SeqID_143045
atgggctcaaaaatctaccctaaggttcatgagaaccctaaggccttctttatcaactctagcccaatcctcttggagcctcttgctcatggctctgtacgtcatttcagtgtgcttttgccttga

SEQ ID NO: 51361 - DNA, 1272 bp, Glycine max
  Peptide Sequence Number=SeqID_143046
cacggctgcccggcgtgagctcctcgcccaggcggaggccgctccggctgccgggtccgtcgtcgacacgggggacccgcgcctgctccgccccgggcagatgaccgcgcgcatcgccgagctcgtcgccgagtcgggcggacgcatgcccgcggaccgccccgcgatcatccgcctggtcctggagagcctcggggcattcgtggcgcaccaggtggagcaggctgccgcgctgtccggcgtcgacgtgcgggtggtccacctcgtcggcggtggctccgagtcgccgatcctcgcgcaggcggtcgccgaccgcacgggacggcccgtcgtcgccggccccgcggaagccacctcgatgggcaacatcctgcggtgcacggtgggctcggggatctgcgccggatcgttcgcgcgtccacggagctgcgtcgctacgaaccgtcccgacgctgacgagagggttcgagcggcccggtcagggcgccatctcgagcaggcgccgcgcgagtgcggcgtcggtcaccagcgagtcgacgatgccggagcgcagtgcggcagcgacggctccggtcttcgatggcccgccggcgacggcgatcacctcggggatgtgccgcagctgttcggtggacacggcgagggagcgctccgcgacggaaccgacgaccgcgccgttctcgtcgatgagcgtggcgcagatctcggccttcacgcccgcggcgagcagttcgtcgagcgcgccggcacggccggcgttgtcgtagagctgcgagtccggcggactccaggacccgatcgcgacgaccgccttggtcacggagtcgaagcggcggaacgtctccaggatccccggctcacgccgcagggccgatgccgtggcggcggtctcgacgagcagcggtgcgaagatcgcccgcgaccggccaccggagatgcggctcacctgacggatcacctccaccccgttctcgggcgtgggggcggcgacgccggcgagctgcaccacctcgcaggtcgccagggtgcgcaggtggcccgccatcgctgtgagcgttcgacccgccgtgagcccgaggacgtcgccgtcggtcacgatctcgctgagcagttccgcggcagcgcgccccagccggtcctggatcagttcgggtgtcgtgcctggcgtgatcacggcaagcgccctggtgaggccgaaccgggcgcgcagctgcatcgacaggtcgaggtcgagggagtcgggggcctcgatcgtgatcttcaccaacccct

SEQ ID NO: 51362 - DNA, 705 bp, Glycine max
  Peptide Sequence Number=SeqID_143047
atggtaatccgcacaccttctcggcatccagagacgatcgagtccgatggcaagatgagacaaattatggtcattctgcaccttttgtcatccagaggcggcgagctcgatggcatgcgcagacaaattatgctcatccgcacacctttttgccatccagagacgatcgagtccgatggcacgcagagacaaataatggtcattctacaccttttgtcatccagaggcggcgagccctatgacatgcgtagacaaattatggtcatccgcacacctttttggcatccaaggacgatcgactccgatggcacgcagagacaaattatggtcattctgcaccttttgtcatccagaggcggcgagcccgatgacatgcgcagacaacttatggtaatccgcacacgttttcggcatctagagacgatcgagtccgatgattcgcagagacaaattatggtcattatgcatcttttctcatcgagaggcgtcgagctagatgacatgcgcagacaaattatggtcatccgcacaccttttcggcatccagagacgatcgagtctgatggtacgcagagacaaattatggtcattctgcaccttttgtcatccagaggcggcgagcccgatggcatgcggagacaaattatggtcattctgcaccttttgtcatccagaggcgacgagccccactacatgcggagataa

SEQ ID NO: 51363 - DNA, 654 bp, Glycine max
  Peptide Sequence Number=SeqID_143048
atgtccaaatcttgtggatttgggatgaccggccctctcgatgagtcgatctcttgctttctcataagggtggacccttgggtacttgtacctatcgcctttagaggactacacatcctcgccttcagaggactgcacgtcctcaccttgagaggactacacgtcctcgccttgagaggactacacgtcctcgccttgagaggactacatgtcctcaccatcagagggctgcacgccctcacctccagaggactacacgtcctcaccttgagagggctacccgccctcgccttggggctacacgccctcacctttagaggaccacacgtcctcacattcagagggctacacgccctcgccatcagaggactgcatgtcctcatcttcgtagggctacacgccctcacctttagaggactacacgtcctcgccaacagaaggctacacgccttcacctttagaggactacacgtcctcgccaatagagggctgcacgccctcaccttgagaggactacacgccctcacctccagaggactatacatcctcgccttgagagggttgcacgccctcacctttagagggctacgtgtcctcattttcagtgtgctccacatccgcaccttaagagaatttaaggtcctctatccttaa

SEQ ID NO: 51364 - DNA, 174 bp, Glycine max
  Peptide Sequence Number=SeqID_143049
atggatccaaaactcgctaagcgcgctgtcgcaaccaacccttcggcgggagggcgacgcgtgactcgcgagtgcgtcttccaagaaaggactacacgcggagccgccaccaacgtttatttgaggaaaacgtcagaaaaaccggaaaagacgtggtctacgaattttaagtga

SEQ ID NO: 51365 - DNA, 282 bp, Glycine max
  Peptide Sequence Number=SeqID_143050
atgaccaccctgactcagatctggatgactttgctgctcagcaacatccagcccagcgatcataattccgacctccccctgccgaagtgtatggcgcctaccaggcaccctttggacctggataagtccaacagggccctgggatttcctgctttgatcacaggactctgccagtcgttcggagtcccaatcgcgcctagcaaggtgattcggtcatccatcacccgagctttcattgagaagtattgcacacagagacaggcccagggggatgctcagtag

SEQ ID NO: 51366 - DNA, 581 bp, Glycine max
  Peptide Sequence Number=SeqID_143051
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatctagagccatgcgcagtgattgcctagtgcaattctccattctccacttttattcggagccccaggaattgattgtcgttcatgcatcctccaccaatgagtctggagccacgcgtagtgattgcctagtgcaattctccattctccacttttattcagagccccatgatttgattgtcgttcatgcatccaccgcaaatggttctggagccacgcctagtgattgcctagtgcg

SEQ ID NO: 51367 - DNA, 282 bp, Glycine max
  Peptide Sequence Number=SeqID_143052
atggaactccaacgtcttaatcaaaatgaagaaaatgacaaaaagaagaaaagtatagcccttaaagcctcatcatcaatgcaagaagaaaacgaagaagaagattcagatgatgaaggagatttttctttctttgtgaagaaatttctaaaatttatcaagaaaagaagaattgataggcatctgaacttcaacaatagaagaaaatcacaagatgattctcaagtccttaggtgttacaaatgcaatcaaattggtcacatcaagaccaattgtccttaa

SEQ ID NO: 51368 - DNA, 267 bp, Glycine max
  Peptide Sequence Number=SeqID_143053
atgaatgttttgagtggtgcaaccctcttttgtaaaatcactcgtgcatccaacatcttcatgatttgtgtacatagggactcattaggtagtgatcaaggggttcccatgaaccctaagagaataaaggtcattcccgagtggcccactccaccaacaccactcattgagttggtgaggaatcatgttccttcatgggaagatgcccaggaaataggttttcagaccttaccttacttcaacataccaaacaccactaatacatag

SEQ ID NO: 51369 - DNA, 288 bp, Glycine max
  Peptide Sequence Number=SeqID_143054
atgattcttgaaactccagtcatccgaggtccatcagaaaactggtctgttgagaggtacaaggccaggctagtagccaaaggccacccaaacactatggtattgcatatcaaagatttagtgctccagttgcaaaacttattacaccatacccgtccagtagtcctcttaccattaggctgcaaatttagattggccaattcagcaaccctgacgaaagaacattgtccatttttaaatggggaccttagaggaggaagtactccatggactcgcctcctggattaa

SEQ ID NO: 51370 - DNA, 135 bp, Glycine max
  Peptide Sequence Number=SeqID_143055
atgacgtcctcgggagaatccacctcagggagtgggctgatgcaatcctaccccgcaagggcattgggtagaagactccaagtagattgggcaagagatccaagggaaggccctagggttctcatgagccttagg

SEQ ID NO: 51371 - DNA, 309 bp, Glycine max
  Peptide Sequence Number=SeqID_143056
atggagaaatggtctcttaatgagttcatttcatattgtgcgcaagaagagaaaagtaagcctggacatgtaaagaagaaatgtaccaaatatcatgtttggcgtgcaaagaaagattctagtgtcactactaacatcagtgtttcaataaagggttgtctaagctactggaagccaattgattctgaaagatggatatacattggagatggtaaattagcgaaggtggaagctatagcttcctatggtgaatcctttaatgcggaattgtgtggtactaagcgtagaattcatagtacaaattcatga

SEQ ID NO: 51372 - DNA, 237 bp, Glycine max
  Peptide Sequence Number=SeqID_143057
atgcacgaaacacaatgtggaccactacgggtacatagaatgaatcgaaaagcttggttcgagcaaaatagggagatgcttgccgcccagctcgcccaggcgagctcagctcgcccaggcgagctcagctcgccaggcgagcagagttgcttcctccagaagcaacagcccttctggaggaaccttctggagggcccaaatgggcctgggtgctatttgcacccccatttttactaa

SEQ ID NO: 51373 - DNA, 327 bp, Glycine max
  Peptide Sequence Number=SeqID_143058
atggaagaaggaatagaaaaaaatgaagaagaagggagggtaagaggaccaccatcttgggcaatagactatgtaacaggtgaaggtttgttagatgaagatggtctgaatgctatgataatgctcactgaagatgacccatttacatttgaacaagttgtcaagagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 51374 - DNA, 324 bp, Glycine max
  Peptide Sequence Number=SeqID_143059
atgcgaggtagaactgcatctggagacgttgttcctattaacctagaaattgaagctacttgccggtgtaacaacgctgcaagaagaagcagggagcaagacataaaaggaagcagttacaccttacctcctctttctccaaatcacactcagatggacggggaaccgacacgaagagtcacacttgaggacttctctaatattgccactcctcagttcttcacaagtattgcaaaatcagaggtccaagcaagccaacatctcctacccgtattctcttatttagttaattcaagggaacctcttccatggtcttgcaagtga

SEQ ID NO: 51375 - DNA, 601 bp, Glycine max
  Peptide Sequence Number=SeqID_143060
aggactacacgtcctcaccttcagaggactacatgccctcaccttcgtaggactgcatgtcctcgccatcagaggacttcacgtcctcgccttcatagggctacatgtcctcacctttagaggacttcacatcctcaccttcagaggactacacgtcctcgccttcatagggctacatgtcgtcaccttcaaaggactacacgtcctcgccttcagaagaggacaacaaatcctctccttgaaaggacttcacgtcctcgccttcagatggctacatgtcctcgactttagaggactgcacgtccttgcctttagagaactgcacgtcctcgccttcagagggctgcatgcccttgccttcagaggactacacgtcctcgcttttagagggctccacatatgcgccttcggtggacttaagggaggctatcgtgcaaccactatgcatactagggcaagattgcacccagctgctacaaagagacgagtgcgaatcatgcgcaccaacatgaccactcttacacagatatggatgacattgctacttagcaacactctccccagtgaccaatttgccgatctccacctgcaaaagtattag

SEQ ID NO: 51376 - DNA, 205 bp, Glycine max
  Peptide Sequence Number=SeqID_143061
atgcgtctgtccctgaagctgatggaagatgtcccaacatcttccaccccaaatgtttctgtgcctgatgttgataaagatgttccaacatcttccgctccaaatgctgaagccctcccttcacccagtgaagaggaatcaacagaagaagatgatcaagccacagaagagacccctgcaccaaaggcaccagaacctgctccag

SEQ ID NO: 51377 - DNA, 261 bp, Glycine max
  Peptide Sequence Number=SeqID_143062
atgtctgaggcaacaaaggaaattacagataggattgattccctggaaaagcaggccttacagggaagctttgccgcacatgaacatcaggatgtagtgactgctaccattgggcaaccagagcaccctggttgtgtccgagctgctggagttgatgtcatgatcaaacactactttggaccggcttcaaggggctcctgcacttcttcgtccatggttcctgatgacctagagcaactgatacaaaagatcagagactag

SEQ ID NO: 51378 - DNA, 255 bp, Glycine max
  Peptide Sequence Number=SeqID_143063
atgtacaaagataattggaccaaaccttggcccatgggctcagaaatataccctaaggttcatgagaatcctagggccttctttagtagctctagcccaatcctcttggagcctcttgctcatggctctagtgactggtcccttcctagggaggattacatcacccgagatgtccttaaagatcaaggaagagctcgatacctagaatgggtagccaatattgtgccagtccctaagaaagatgggaaagtatga

SEQ ID NO: 51379 - DNA, 615 bp, Glycine max
  Peptide Sequence Number=SeqID_143064
ttgttgcaagataggacaatagcttccattatagaagaagaagctcaatcttctgactctacatcatctgattcactagcatcaagggaatcagctatatatttatcagaagcctctgtcatggctgatgaacaccaacaaaggattacccttgaggattattctagtagctcagtgtcgcaattctttacaagtatttcacgtcctgaagaggaagttgttgagaaatttctgaagaaattcttccccgagtcaaagactgtagaagggaaagttgttatttcatcatttcaccagtttcctgaagaatccttgagtgaagcattggagaggtttcgggaaaccctggctcaattcatgcaagtgaccatgtccaaacataagagtactgagtcaaccctaaaaaaccttgagattcaggtgggtcaactggctaagcagttagctgagaagtcatccaacagctttggggaaaatactgagaagaatcccaaagaagattgtaaagcttttgtaacaagaagcaggaagcttgtggcggctgaggatgaggatgttgttgctttgaaggagcaagttgctttgaaggacactactgttaaaaagaagaatgag

SEQ ID NO: 51380 - DNA, 228 bp, Glycine max
  Peptide Sequence Number=SeqID_143065
atgggtactattgggcaccaaatccctaaaataagtgatatgatgaatgtgttaagtgttgcaactctcttttgtaaaatcactcatgcacccaacatcatcatgattcatgtacatagggactcatttgcaccactcattgagttggtgaggaaccatgttccttcatgggaagatgctcaggaaataggtgtcgagggaaggaacctagagtatgaagaaccttga

SEQ ID NO: 51381 - DNA, 444 bp, Glycine max
  Peptide Sequence Number=SeqID_143066
atggctccgagaaagctttccacgaaaagatctaggagggacgccgcggctgaagggaccagtgccacccccgagtttgatagccactgtttcaggagcgccgagcaccagcagcgttgcaaggccatcaaaggatggtcgttccaccgagagagacgcgtccaactcagggacaatgagtataccgactttcaggaagagatagctcgccggcgctggacgtcgctggtcactctcatggctaagtttgacccagatatatggatttcctttgatgcagatgccctcagccaattcctgggtgacccgctggtgttagaagaaggccaggagtgtgagtttagtcagagaaggtacatggccgacgggtttgatgaagaggccattgcccatctattatgtatgccgggtcaggattttgcccagaccgctgtagggaggcgg

SEQ ID NO: 51382 - DNA, 419 bp, Glycine max
  Peptide Sequence Number=SeqID_143067
atatacttgagtgggtccggaattttaatgctcggcttaccgtaagaaagaggcggagccggccgataagccgggttctgtcgtggacagtcattcctgtaggcgttacgtcaccgcaacgctcaagcaacctacccggatccaacgcgggccgcgccaaaggatccctatttggtcttgctccaggtggggtttgccgtgccggtctgttgccagactcgcggtgcgctcttaccgcaccatttcacccttaccggccttccgaagaagacgtaggcggtatctttgtgtggcactttccgtcggcatgcgccgaccaggcgttacctggcacattgccctatggagcccggactttcctcggcatccccgaagggatgacgcgactgtctggccgactccgccagcgcacattctag

SEQ ID NO: 51383 - DNA, 393 bp, Glycine max
  Peptide Sequence Number=SeqID_143068
atgattttgagggggagactgctgctgctgatgatgactgatctgatagaagatgctggagtaagagcatggagacagggggagcagaagcagaaagctgatgtcatgattcacgatgtcggatataatgtccaggacatcctgcctgaaaatactggaattgctaaaagcattgaagctgcaggatccacgatgtcggatacaatgtccaggacatcctgcccgaaaatactggagctgctaaaagcattgaagttgcaggatccacgatgtcggatacgatgtccaggacatcttgcccgaaaatactggacatataaatctgttatatctttaacagattattgtgcagttagcaagagattagatgatctatctttaggaacgaattaa

SEQ ID NO: 51384 - DNA, 279 bp, Glycine max
  Peptide Sequence Number=SeqID_143069
atggaaatttatgtgagtgatcgactaggaaaaagtgtaagttgtcatcatcaaaaagggggagattgtagaagcaagcttcatgatgaatcaagaccgattcaaagagtcttgatgataacaaagatgatgacaaaaagcaaagctcaaaagtcaagaacacttcatgataacaaagatgatgatcttcaagaatcaaagaatgagttcaagattgaatcaagaacacttcaaggttcaagaggaaatttgatttcaagaatcaagaatcaagtttaa

SEQ ID NO: 51385 - DNA, 460 bp, Glycine max
  Peptide Sequence Number=SeqID_143070
gttacaggttgtaccatttgtggtggtgttcatgaatccggccattgtattccttttgaagaaaaaacgcaggaagttagttacatgggaaatcaacaaaggcaaggatacaaccaacgaggattctcaggtttccagcaaggtccctacaatcagcaaggacaataaagatcacaccctgaggactaccaatctggaagaaaccctggctcaattcatgcaagtgaccatgtccaaccataagagtactgagtcagccctgaaaaaccttgagattttggtgggtcaactcaccaagaagttagctgagaagacatccaacagctttggggcaaatactgagaagaatcccaaagaagagtgtaaagttgttgtaacaagaaacaggaagcttgtggcggctgaggatgaggatgttgttgctatagaagcaagcttcatgatgttgaatcaagattga

SEQ ID NO: 51386 - DNA, 117 bp, Glycine max
  Peptide Sequence Number=SeqID_143071
accacccctttccggtttttccgacgttttcctcaaataaacgttggtggcgactctgcgcattttcctttcttggaagatgcacccgtgagccccgcgtcgccctcacaccgaaag

SEQ ID NO: 51387 - DNA, 327 bp, Glycine max
  Peptide Sequence Number=SeqID_143072
atgacggtgaaaacctctgacacatgcagctcccggagacggtcacagcttgtctgtaagcggatgccgggagcagacaagcccgtcagggcgcgtcagcgggtgttggcgggtgtcggggctggcttaaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 51388 - DNA, 384 bp, Glycine max
  Peptide Sequence Number=SeqID_143073
atggattggagaaaagctctcagatatgaaaatcctccgccttcgatcaaatcaaatgaaatatgtgagatgaatcttcttcaagttttagacgttgcacaaaacaatctgtctggcaatatatgtagctgtttcagtaacttgagtgccatgacactaatcaaccaaaatacagatcctcgtatctattctcaagcaccaaatggtacagattcctcttccacatatagtatagttagtgagctacttttgctgaaaggaagagcagatgagcacagaaactttctggatttgggaaaaatgccaacaggaactcaattgcaaacctttgatgctccagctttattggcacaatctatgttgtcaccactgcctatagtgtag

SEQ ID NO: 51389 - DNA, 444 bp, Glycine max
  Peptide Sequence Number=SeqID_143074
atgttaggattcacaagtgattctcctcaattttcagccaacccgcatcaattagactttgcaccttacgcttcaaggccctacaatgctcaatggaatgccccggggctcctccatgataagcacgcatgggggttgaggaaacctagcaggggctttttcgctgcaaaatttatttcttggttggtgttttggttcatgctaaaggtggtgtttagcattggttgtgtggagaagggttgttattggctgagtgatgatgttgtcgagctggtgggggattttccatgtaggaacgacagtcgtagcatgggtttctccttcattctcaccctcttcatttgccccaattttctcattcgtccaagcaagatgattaaattagcctcttttcagacccgcttcgacccttttgtcggcaaagaccaaatccgcaaagcttga

SEQ ID NO: 51390 - DNA, 252 bp, Glycine max
  Peptide Sequence Number=SeqID_143075
atgagctgtaatggttcgctaagcgcaccgcttcatctctttaagcacaccgctttagttcatctgctaagcgagaaagatctgcagagacaagagcttgaagcaggagcctgtttgagagctggagatgagtttgtgagtgattgtgagatcctagagatgaaggagacatcctcaccacttgtatttttgcaatctttcatcttgttcttctctttgttgttaagaaggcttcctggtatggaaagctaa

SEQ ID NO: 51391 - DNA, 2272 bp, Glycine max
  Peptide Sequence Number=SeqID_143076
ccatccgattaaaggcgcatccggtgttccaaccggttttttcctggccgagctgacccatccgctgaaagtactggaagatgccggactaaaaacgatgatagccagcattcgcgggggacagccgccggtggatggatttgacctcagtgatcctgtcaacgcctggtactggaacgaaaccaattttcagcagcgcctggccacaacgcctgcgttatctaagctgaacggtaccgattacagcaccgttttctttgcgggcggccatggaaccatgtgggatttccgcgacagccaggatgcccagcgtattatccgcgaagtgtatgaaagtgacgggattgtcgcagccgtctgccacgggcctgcggcactggttgacgcaaagctcagcagcggcgaatacctggtgaaaggcaaaaacgtggcggcctttaccaacaaggaagaggaagaagttcacaccacagatgtggttccctacctgcttgagactgcactccgcgagcatggcgcgcttcatcatgaagccccgaactggtctgaaaacgtggttaccgacggacgccttatcacggggcagaatcccgcttcagcgcacggtgtcggtgagctgaatatgaaaacactaccttccgtcgcgctgggcacatggtcctggggcacaggtttcgccggtggcgacaccgtcttcggcaatcatctttctgatactcagatggcagacgtgttcaccacggccatgagtaagggcctcaatctctgggataccgcagcagtatatggcatggggagttccgaggcagcgctgggagcattagtccgtcagttcccccgcgaggatatgattttatccaccaaattcacaccgcagattgcgaacgaacagtcagcgcagcctgtcagcgatatgcttgaggccagccttggacgtctgggcgtggacgcgattgatatctactggatccataatcccctcgacgttgagaaatggacgccaggactgatcccacttttacaaagcggtaaggtcaaacgcgtaggtgtttccaaccacaatctggtacaaatcagacgcgccaacgaaatccttaacgcttccggttattccctcagtgcagtacaaaatcactacagcctgctctatcgcgcttctgaagaggccgggatccttgattattgccgacaaaataacatcacgttctttgcttacatggtcctggagcaaggcgcgctcagtggtcgttatgattcaaatcatcccatgcctgccgggagtggccgggccgaaagttataacgcagtactgccgcagatagaaagactaaccgccgccatgaaaaaaatgggagccgaaaggaatgccagcgtggcacagatagccatcgcatgggctattgcgaaaggtacccttcccctcgttggtgcgactaaagtccatcacgttctggacgccgcctgcgcttcagacatccagttacgcgatgaggaaatcatcctgctggaacaactcgccgcagagaccagagtggatacacgaggcgcctgggaaaaaccgatgaatatgaaaatcatttgccttgaagaacattatctcgacagcgagttagggcgagcgtgtatgcctgttgcgcttgagcaggcgcctttccttggcgactgggggaaaaccgtcgctgatggtcataatcctgaccgaagccggccgcagatagaaaagaatgcgctgataaacgcgaaaggcgctgatttgggaagccgccgcctcagggatatggatgaggctggaattaccctgcagatactctctgtgggcggattcccccagctggcacccgaggatgaagcggtaacattaaatacggcggcaaacgatcgccttgccggggcggtaagaaatcacccggatcgcttcgcggcatttgccacacttccctgggcacagccgaaagatgctgaaaatgagcttgtccgcgcagttgaaaaactggggtttaagggggcacttctgaatggccgaccctcttcatgctttctcgatcatcctgactatgactccctgctttcccgctttaataaactgaatgtgccactctatcttcatcccggattaccgtttaaaagcgtacaacaggcctacttcacgggcttcagcgcagaggtcaacgcccggctctctatgtttggctggggctggcatcacgaagccgggatccatttgttacggcttatgttatcgggcgcatttgataaatatccccacctgcag

SEQ ID NO: 51392 - DNA, 699 bp, Glycine max
  Peptide Sequence Number=SeqID_143077
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtgcaggcggcgtaattttttaagcagttatgtgcctagaaatattttatctgattaa

SEQ ID NO: 51393 - DNA, 806 bp, Glycine max
  Peptide Sequence Number=SeqID_143078
gagaagtaaaattcttctaacaacccgcagtgaaaagacagcatccgtagtccaaacggttcaaacctatcatctaaaccaattgtcgaatgaagattgttggtcagtgtttgcgaaccatgcgtgtctttccttggaatcgaacgagaacacaacactagaaaaaattggaaaggagattgttaaaaagtgcgatggactgcctttagcagcacagtcccttggaggcatgttgagaagaaagcatgacattggggattggtataatattctcaatagtgacatttgggaactttgtgaaagtgagtgtaaagttataccagcactgagacttagttatcattatctccctccacatttaaaacggtgctttgtttattgttcgttgtatccccaagattacgaatttgataaaaatgaattaatcttgttgtggatggctgaagatcttttgaagaaaccaaggaaaggtaggactttagaagagattggtcacgagtattttgatgatttggtttcgagatcatttttccaacgttcaagtagctggcctcatgtcaaatgttttgtgatgcatgacctcatgcatgatctagcaacatcagtcggtggagatttttattttagatcagaagaacttgggaaagaaacaaagatcaatactaagactcgtcatttgtcatttgccaaattcaattcttcagtcttggacaactttgatgttgtcggtagagcaaaatttctgagaactttcttgtccattatcaattttgaagctgctccattcaacaatgaggaggcacaat

SEQ ID NO: 51394 - DNA, 324 bp, Glycine max
  Peptide Sequence Number=SeqID_143079
atgtctcttgtcactctctttgggaaacttcaagaacatgaaatggaacttatgagactcaaccaacatgaagataatgataaaaagaagaaaggaattgcactcaaagcctcatcttttattcatgaagaaagtgataaagaagacatgaatgaacaaaataatttagaagaagatgatgatttcagtcactttgtaaaaagattcaataaatttctgaggaacaaaggaaataaaaggagatcgaacttcaattcaaagaaaaaggaaaagattcctcctcagtttcaaaatgctatgaatgcgatcaacctcggcacctga

SEQ ID NO: 51395 - DNA, 366 bp, Glycine max
  Peptide Sequence Number=SeqID_143080
atgaccgaccctctcaatgagtcaatctcttgctttctcataagggtggacccttgggtactagtaccctcaccttcaaagggctacacatcctcaccttcagaggactacacatccacgccttcagaggactacacatcctcgccttcagaggactatatgtcctccccttcagaggactacatgtcctcgccttcagagggctacacgtcctcaccttcagaggactacacgtcctcgccttcagagggctacacgccctcacctttagggggctacacgccctcacctttagagggcttacgccctcgccttcagagggctgcacgccctcaccttcatagggcgacacatcctcgactttag

SEQ ID NO: 51396 - DNA, 219 bp, Glycine max
  Peptide Sequence Number=SeqID_143081
atggataagagcttgaaggttggagaaaatgagtggagggagagggagagaaggggcacgaaattttgtgcctcaaatgagatatcccaacatacatcatgtcccgccatttgcaggccttttgagccgaatgtcaactttttggtcataaccttgacctgggatggaaatttccagccttaccctaggaagagagaacataaggatcttccaagataa

SEQ ID NO: 51397 - DNA, 391 bp, Glycine max
  Peptide Sequence Number=SeqID_143082
atggagacacttcagaaggtctgcaaggcatgggaggtgttgcaaaagaaggacaaagaacttaggggcagtaacaatgggcccatcggtggctactgtaagtggttgaaagcccacgtgcaaggtttggtttggcttctgagtttgagaactgctaaaagagaggaagttgaggcaccggaggaagacgaagaggtgcaggcccttagggcggaactcgagcaagcccaaacagttaaagaaaggttcaaatcagcaactctgaaaattcgaaaggagaatgccgaactgagagatgtaaatgtggctaccaccaaagccttggaacgagaaaccaagagggcttgtagggaagaacatggccggaacaagttccgaggggctctgtggg

SEQ ID NO: 51398 - DNA, 219 bp, Glycine max
  Peptide Sequence Number=SeqID_143083
accaatggcttgcacccaattccggtgaaagttgaaaatcctggggttatggctaccattgcgttatcaagtagatatgggagcaagttagcatatgacaccggaatttggggtggtcttcgtcattggaagtgcggtagaacaggctttgtggttgatttagggatggcctttgtggataactgggtgtgggtaaggaggaggtttgttattgactga

SEQ ID NO: 51399 - DNA, 395 bp, Glycine max
  Peptide Sequence Number=SeqID_143084
atggctagaacacgaggtttaggtcgtgctataggtagacttgtaggcagagatagacatgatgaccatgatgtagctgatgttcccgagaggcgtaggcctactgcctcagcccgtaggcaacgagttcatcagatgactacggatgtacgtgatttggctgaggacgttgctgacaagactgaggatgtccctgatctggctgaggaggcacctgagatgcgtgcggatgaacgtcctgatttgaagttggtgtcacatgggaggaaggtgacattgattgggaggccagtgcctgagattgaaggactggttggtgccacaggattaagaccactgatcgattgttcagttgttactggcgatcctggacttatattcacatttatggagag

SEQ ID NO: 51400 - DNA, 489 bp, Glycine max
  Peptide Sequence Number=SeqID_143085
ggccctgggattccggcgctgatcacagggctctgccagtcgtttggagtccccgttgcacctaccaaggtgattcggccacccatcacacgggattttattgagaagtactgcacccagagacaggctcagggggatgctccgcaggtcgcagacgtgccgccacctcatcaggctggccagactggatcgtttgatatggagtggtatttgcggcatttggttcgccagcaggcagccaaccaccaggcacatgtacagacccatgattgtctttaccagctgagcctcagcatgcagagtcagggcttcgcttctttttcatgccctactccagaccagttcagggcagaggtcgcatggcccggggagtggcctgaggcccaagcaggagaggcgccagaggctcccgacgatggagaggaggcccacgaggatgaagagatggccgatttgcttgacttcttgggagggagtggagctacatga

SEQ ID NO: 51401 - DNA, 258 bp, Glycine max
  Peptide Sequence Number=SeqID_143086
atgcgtaaggagaaaataccgcatcaggcgccattcgccattcaggctgcgcaactgttgggaagggcgatcgggttttcccagtcacgacgttgtaaaacgacggccagtgccaagcttgcatgcctgcaggtcgactctagaggatccccggctgaagccaccactgtggacgcctttgctctggatgacactatgtattttgtaaaactcccatattttggacagcttttagatgatgaatgtactcatgtttaa

SEQ ID NO: 51402 - DNA, 491 bp, Glycine max
  Peptide Sequence Number=SeqID_143087
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctttcgctccaagctggactgtatgcacgaaccccccgttcagtccgaccgctgcgccttatccggtaactatcgtcttgagtccaacccggaaagacatgcaaagcaccactggcagcagccactg

SEQ ID NO: 51403 - DNA, 205 bp, Glycine max
  Peptide Sequence Number=SeqID_143088
ccgcagtcagcagggggagagttccaccctttttgtgtgccctaccccggagcagtttgcagctgaggtcgcatggcccggagactggcccgatgcccaggcaggggaggagcctgcaggatcccccggtaggatggacgtgccccgcatggacgaggatatgactgacctatttgatttcttgggagggagcagagccacatga

SEQ ID NO: 51404 - DNA, 414 bp, Glycine max
  Peptide Sequence Number=SeqID_143089
atggaggaacataaacaactactagcacctaagccaacacttgaacccgtttttgattttgtagaacttgaagagattaatgaggagatgaggagaggcaagagtgaggcaaacactgaaaagaagaaggatactactccaaatgaaggcaaggaagtaccttatcctttggtaccttcccagaaagagaaagaaagacatttggccagatttcttgatatcttcaagaaagtggaaattactttaccctttggagaagcacttcaacaaatgccactctatgccaaatttttaaaagatatgctgataaagaagaaccggtacatccatagtgacaaaattatggtggaaggaaaagctctcatagacctgggagctagtatcaacttaatgtctctctccatgtgccgatga

SEQ ID NO: 51405 - DNA, 216 bp, Glycine max
  Peptide Sequence Number=SeqID_143090
atggaccacgttgtcgcaaaggtacttatcgacaatggatcgagtttaaatgtaatgccgaagaccactttggaaaagcttccttttagtgcgtcacgtttaaaaccgagctcgatggtggtgcgagcctttgatggaattaatgaagcattcggcttgaatctagcattgggcttgaatctagaattgggcttggacttgaagagggcagactaa

SEQ ID NO: 51406 - DNA, 180 bp, Glycine max
  Peptide Sequence Number=SeqID_143091
atgaacactcatcctctggataagtacttgtggctaagcgaggctgattcaccaagcccaagtaatactgctaagtatggctcagggagagctaagcgtacatcattgcggcaagttttaggcttagcgggatctataggtcgccaagcgggtatagtgttttctgtgaagactcgctaa

SEQ ID NO: 51407 - DNA, 449 bp, Glycine max
  Peptide Sequence Number=SeqID_143092
cggatgccgggagcagacaagcccgtcagggcgcgtcagcgggtgttggcgggtgtcggggctggcttaactatgcggcatcagagcagattgtactgagagtgcaccatatgcggtgtgaaatacccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggtagttgaaacacaagaagttgcaaccacttctaagaaatctcttgaggccacttctgagccttcagaaccagtggcagatacggcttcaattcagcaactagcagacccctccactcctgaggatcaaactacagcagtttaa

SEQ ID NO: 51408 - DNA, 349 bp, Glycine max
  Peptide Sequence Number=SeqID_143093
gaagcggaagagcgcccaatacgcaaaccgcctctccccgcgcgttggccgattcattaatgcagctggcacgacagcggataacaatttcacacaggaaacagctatgaccatgattacgaattcgagctcggtacctccggaaaaaggttcttccggtagaacacaaattgttcttccggaagaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 51409 - DNA, 165 bp, Glycine max
  Peptide Sequence Number=SeqID_143094
atgtcgtgtcataagttatcagactggccacctggagtgatggctggacggaatgatcgtgcgatagctgatgctcttcaagccttagctcagactatagggaatccaaataggggagaagctggtggagctattgagtaccaggggttggaccgcttccaatag

SEQ ID NO: 51410 - DNA, 210 bp, Glycine max
  Peptide Sequence Number=SeqID_143095
atgtggaccatcattgaccaatacaaagagaagctaagtctagcggcaacccatgaacaaaggctagaggatgaatatgcaaagatggataggttcgctttcaccttgaatgggagtcaagagcttctgagattgctagctaaagccaaggcaatgatggatgtatactcggcccccgaggaagttcatgggcttctcgattatcgttag

SEQ ID NO: 51411 - DNA, 246 bp, Glycine max
  Peptide Sequence Number=SeqID_143096
atggaccttccggcttcccgtgacaaaagacgagaccaacatattgcggcagtagggactaccaataacaatatgttatcaaatagaaaaactctagatgtgggttcactgttatcaagcaagtcggagactcagcatggccacagattcacctccattccttatgttcccatggacccgggtataggcccccttttcaactcaccgtgtgtacaaatggtgttggtgtttgtgtgcatcaaatga

SEQ ID NO: 51412 - DNA, 774 bp, Glycine max
  Peptide Sequence Number=SeqID_143097
gtagctgtgtctccgccaaaaccacctccgaagcccgatccgaaggtcgatgatccgctttatctgatgacattgaccatcccagagcttttcttgaggccttatcaggttagatgggatgccaccgtgttcggggtcgttaatccagatttccccctgtacataaagcacgaagacctctccgaaatcgcacacggtggtcaatgtctcagcatatcagtgttacagttgtggattctgcatctcactgaaacatgtatgcgagcggggaattctgatatctatggattcctcgagcctcagtccattcagaggtctgggcaatcgcagtttgaatctgaaagttacataaagagttggatgcagagttcacaacgcgatgtgtatcttggagcctacctaaatggcggacactggcagatggtggtcatcctgcccaaggaacacttaattgtctggttttgttcatcgcttaacaggccaaacaactaccttaaggggattattaatagtgctttaaaaggtcttgatgatgctccacagcctaaatcaaaggctcctgctaggtggattatcgtcaagtgtaatagacaaaaaggaagtactgaatgcgactactatgtgatgaattggatgtccaccatcattttaggaacttttaggaataatttggaagcgtattttaaagatcctagaccattggagccagagagattaaaggcattgcggatccagtggacacagttttatctccgtgttagagatcagacctag

SEQ ID NO: 51413 - DNA, 513 bp, Glycine max
  Peptide Sequence Number=SeqID_143098
atgctaaacatccaaaatctcatttatggttatgagaaaatttcatcagcatactctccttccccggtagacgcattgtttttcactcaaaaaacatgtttgcattttagtggagaaaacaccgagactttttcaagtctcacaagttatccagaactacgtaggtctgagttcctcattggaggatacgtaggagcaagagcctcgcttttgtcgaccacaccaccttttgttgtcatgacccaagagctggtagcccgcggagacaccttacggttatccgcacctcgtcattcagtgaccccaagtgtgattgacgagcagaggccaatgtggtcatctgcgccctttccggagatgtcagcatcttccgatggagacttttcaagtctcacaagttatcaagaactacgtaggtctgagttcctcattggaggatacgtaggagcaagagcctcgcttttgtcggccaccttcacaagatctgtcatactgacttttgaatcgtgctga

SEQ ID NO: 51414 - DNA, 254 bp, Glycine max
  Peptide Sequence Number=SeqID_143099
gagttgaagccaggggattcatttttggttcctcaattgcgttaggcattggtgcaaagtttgctcctttatgcaaacctggaaagctaccaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 51415 - DNA, 553 bp, Glycine max
  Peptide Sequence Number=SeqID_143100
atgcagttcatgttgtccccatataggagaagggtgtcaaatttggacgatttggcaccgtgccttgataagatgactcttttaactgaggaagaggataaaattattgaggcacgtgaagaagctccttctttggttccacaatttgaacgtcaacagtttgatatgttgggtaggagtgtggagacccaaggtttagggcaacgtagggaaagtgtggatgcagaagcacatgttattcctgcgatgccagagcgccaacatggaatgtattacacacctgatcagttcacccaagagccgtctcaaatgtcatccctgtatccgtacccatatcaaagcggaacttcatcagatgcatatttcattggaacgcaacctccgctacaaccaggatatgttatggctgacttatttgggtctctttctcctgcgggaaccccttcatttgcacatggttgtcagatatcaacgcctaacgccccaatgggccctccatggactgtgtcgggaaacattcctaacattactgatttattaggaatagattttg

SEQ ID NO: 51416 - DNA, 433 bp, Glycine max
  Peptide Sequence Number=SeqID_143101
cgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcgaaaggaagaaagggaccagtcgcgagcacatagcatggttttgaaagaggagttagttgcctcttcgaggtccaaaagaagcttgtctcagcgtttatgcgagacggagaccaacatgctagctatcattgccaagtaccaagaagagttaggtctagccgcagcccacgagcataggattgcggacgaatatacccaagtatacgcgaaaaggctagaggaagggtga

SEQ ID NO: 51417 - DNA, 771 bp, Glycine max
  Peptide Sequence Number=SeqID_143102
atgaaacaaaccgtatccgcgcgaccaagaaaacagcccgtgcatttgctggccagattttatctctatcaaaagaactggtccgaagctatcaaatacgcatcatatatccttgatgataataccaattacggcttggtgactccctatcgttcgttttacgcaaacaatacatctaatacgaaagaatcggtgttcgaactggtttacgatatcaataataccagcggccaggctagtcagtggctgtcgggcagcaatggcgggacagcctggatcaggccttcgcaggatatttacgacctgctgatagatccggctgtggggggcgaccggtcagcactggtatctaagacatcctcatcaacagatcccaatatcctgatcggaaacctctattatcggaccgatcggaccgaccctgtctttcttatccgtacagcagaactgtttctaatccgtgctgaagcgctcgctcagcgaaatggttccggcgatctgactgcgagcttagccgatttaaatgccatacgtgtccgtgctggagtgaagcctgtacagaggcttggggcaaccgatctgctgcaggcaatcgaacaggagaatcgggtagaatttgccttggaaaaccatcgctggtatgatcttttgcgaacaggccgtgcgcagcaagtactcaatattacctctgtcaacagattattgcttccgatcccttacgcgcaggtttccatcgatcctgacctgcagcaaaatccgggcttggattaa

SEQ ID NO: 51418 - DNA, 288 bp, Glycine max
  Peptide Sequence Number=SeqID_143103
atgacattaacctataaaaataggcgtatcacgaggccctttcgtctcgcgcgtttcggtgatgacggtgaaaactctgacacatgcagctccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 51419 - DNA, 372 bp, Glycine max
  Peptide Sequence Number=SeqID_143104
atgcagctaccgcaaaagcccttgaacaagaaaccaagagggctcgcaaggaagagcacggccgtgacaaattccgtggagcattgtggggcagcaacacgtttgtgcgagacagagaccaacatgttagctatcatcaccaagtatcaagaagaactaagcctagccacaacccacgagcatagggtggcggacgagtatgcccaagtgtacgcggaaaaggaggctagaggaagggtgatcgactcgttacaccaagaggcaaccatgtggatggaccgatttgctcttaccttgaacgggagtcaagaacttccccgattgctagccaaggccaaagcaatggcggacacctactcctcccctgaataa

SEQ ID NO: 51420 - DNA, 459 bp, Glycine max
  Peptide Sequence Number=SeqID_143105
atgaatatcttgacgacacacgatcaagggtgggaacaggagttaagtccttacaatcaatatgaagaagaagaaaaaactcctaatcttgaaagtgtgtttgaagaattcatggcataccatgctagctcaacagctaatcaaaattcaatgaaaaatcatgaaattcattttggtaagaactactcaatagaaaactttcaagggggacaagaattacaaccttactatcaaaatgaagcagaaagaggttccaatctggataaactgttgatgcaattcatggaaacaactaaatcaactcaacaagcactccaaagtgtagaaatccaggttggtgagctggcagaagcaataactcaatttaagtctagacaagaaaaatcctttatagaggctgaagctcaagagaaaagccctgtaaaagagcatgagtcaagagaaaaagatgaggaataa

SEQ ID NO: 51421 - DNA, 114 bp, Glycine max
  Peptide Sequence Number=SeqID_143106
atgggtgagggatggaggcaaatggaggataggatcccgaccgaccaattgtcaccccttcccggcgctgggccagcggagaacgtcgttgcaaggcagcccagtatcctttga

SEQ ID NO: 51422 - DNA, 438 bp, Glycine max
  Peptide Sequence Number=SeqID_143107
atgccgggagcagacaagcccgtcagggcgcgtcagcgggtgttggcgggtgtcggggctggcttaactgaatgcggcatcagagcagattgtacggggagagtgcacatatgcggctgcgcatcggtcgttcggctgcgggcgagcggtatcagcctcactcaaggctattacggttatccacgaatcaggggatgtgaactgcaagggattaagattgccaagcttgctgcgcaggtttttcctagaggctccccccctgacgagcatcacagaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatag

SEQ ID NO: 51423 - DNA, 156 bp, Glycine max
  Peptide Sequence Number=SeqID_143108
atggataagagcttgaaggtaggaaaagatgagtggagagagagggagagaaggagcatgaaattttgtgcctcaaaagagggctccacaatgaaggtaacataccctagaaatgtaggatttttcagcccttgtattttagggcacctagactag

SEQ ID NO: 51424 - DNA, 261 bp, Glycine max
  Peptide Sequence Number=SeqID_143109
atggataagattctaaaggaaaagggaaaggaagcaatgaagatcctccagaagaagccaaatcaaatgatgaacttccaagagaatggaaagcttcaaaagatcatccccttgacaacattattggtgatatctcaaaagggtaatatggcttttgtgtctatgattgaacctaaaaatttaaatgaagccataatagatgatcattggatagttgctatgcaagaagaactaaatcagtttgagagaaacaatgtgtag

SEQ ID NO: 51425 - DNA, 222 bp, Glycine max
  Peptide Sequence Number=SeqID_143110
atggtggttcgcacttctgttatactcggcttcaaaagtcctttcgctaagcacaagcctcgtgctaagggcatctttgttcatgcgctaagccgcaagtctcaagcacttagcacccaacccttgcatctgaggctgatttggtccgctaagctggccaaggctgagctaagccaacttcaattcgatctgaattcggctaagcgacagccaaaccgctaa

SEQ ID NO: 51426 - DNA, 159 bp, Glycine max
  Peptide Sequence Number=SeqID_143111
atgtccttttggtatcatcttgattctcatatcattgtcaatcaagtggtggttgtcatcatcaaaaagggggagaatgtaaatcatgaagattttgatgatgtcaaagaagaatctaacaaggctgcttcaaatgataagcatttgcttcaagaataa

SEQ ID NO: 51427 - DNA, 541 bp, Glycine max
  Peptide Sequence Number=SeqID_143112
atgaaaagagaaaaacatgcctcttatagtagtcataactcttgcaagagcctaagtgaagaacttcgtgactattacgaaggaaggcatagacctcactcccatagaagagaaaaggaaagaaagcctcaaaaggctaacattaacctctcatacttccatgggaaggacaatgtagaggctaacttagtttgggaaataagggtagagcaacaacttaaaaagaagtctacatcaaaatcttatggctctcactcttatccaaagaaagaccaaggtcaaggcatcttaggggtgacaccttctaagcccaaagatgataaggggaagacaatagaaaagcaagcccctaaggctagtatgcaagagaaaactagctctataaagtgctttaaatgtcttggaggaggacacattacttctcaatgccccaccacaaaaaccatgattatgaggggccaagacatttatagtagccaagataaggctactacttcaccttcctctagtgaaagtgaagaagcaaaaggggaagaaccta

SEQ ID NO: 51428 - DNA, 296 bp, Glycine max
  Peptide Sequence Number=SeqID_143113
caccgccatacctcttgagcttgaggttattcctcaagtaaaggagttgttggatgagggtttggtttgcatgagcttaaatccttgtgctttgttggtgcctaaaatagggcttcccatggaccctaagagaataaaggtcattcctgagtggcctactccaccaacaccactcattgagttggtgaggaactatactttcttatgggaagatggccaagaaaagggtgttgaggaaagaatcaatgagtttcaagaacctctggatttgaggtcaaatccttttcaagggggag

SEQ ID NO: 51429 - DNA, 510 bp, Glycine max
  Peptide Sequence Number=SeqID_143114
atggctgtagtgagcctgggaaaggtttatcaacctccatttccccgatggtacaatcctaatgccatatgctcttatcatggtggcatcccggggcactccatcaagcagtgtgtagcttttaagcacaagatacctcgaggtttccagccctctatagcaaagacatcaacacccttcccttataagagtgacaaggcagtaccatggaaatatggcgtacagtgcctcgatgaaaggaagaacgcgtccgtcatacgtgttgggaggggcatgccaactgctaagatcacaaatatttccagtacgagcggcatgactcatagtggacatattttttctccttctgaactaccggcaaggtcgaaagacaaggggaaggcaaaggcagatatgggcgagagggagaagatgggtctgaccgcgaatgacgaggcccctgttggaaagtttgcagaggaaggggatgcaagagggagatatcggctgaggaggcaactgaatttatga

SEQ ID NO: 51430 - DNA, 655 bp, Glycine max
  Peptide Sequence Number=SeqID_143115
acattctcgcactattgatcttcggaggagtcctctttccgaatgtggatgggttggtggacctagcagcgatcaacgcttttctcgcctatcatgaccacaaggaaaacccggttgtcgctatgctagctgacctatatgacaccttcgatcgaaggggttgcatcagttacaatcccgttcttgctataaggcaacttggctaccctatgagaggggcaccattagaggaagagatcacgcctgtcatttcacgaggtttcaataagaccaacgtggagacacttcagaaggtttgcaaggcatgggaggtggtgcgaaagaaggacaaggaactcaggggcagtaaaaatagacccatcggtggctaccgtaagtggttgagagcccacgtgcaaggtttggattggctcccacgtttgagaactgctaaaagggaggaagttaaggcactggaggaagatgaagaggtgcaggcccttaggatagaactcgagcaagctcaaacagtcaaagaaatgttcaaattagcagctctaaagatccgaaaggagaatgccgaactgagagatataaatacagctaccaccaaagccttggaacaagagaccaagagggctcgtagggaagagcacggccgaaacaagttccgagg

SEQ ID NO: 51431 - DNA, 324 bp, Glycine max
  Peptide Sequence Number=SeqID_143116
atggatgaatactttagggtgtcaaattgcaagagtgcaaaagatatgtgggataccttacaagaacacaaaatggaactaatgagactgaatcagcatgaggagaatgataagaaaaagaaaggaatcacacttaaagcttcatcctcaattcaagaaggaagtgataaagaagatttgaatgaaatagacgaagatgatgatttcagtttctttgtaaaaaggttcaacaaatttctaagaaacaaaggaaatcaaagaaaagagcagaagattcatcctctcttccaaaatgttatgaatgcaatcaaccaagacatctaa

SEQ ID NO: 51432 - DNA, 451 bp, Glycine max
  Peptide Sequence Number=SeqID_143117
ccgaacgaccgagcgcagcgagtcagtgagcgaggaagcggaagagcgccaatacgcaaaccgcctctccccgcgcgttggccgattcattaatgcagctggcacgacaggtttcccgactggaaagcgggcagtgagcgcaacgcaattaatgaataataaggagcttctgaaagagagggttcagtgttcgaaaatgaagacgacgaagggcggcaaggtcatgaaccctaccgatgcttaccgaaaggagattcggaagaaagaattgaaaaggagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 51433 - DNA, 276 bp, Glycine max
  Peptide Sequence Number=SeqID_143118
atgaggtggaaggtgggggatggagagaaaattggattctggaaagacaaatggattaatcaacaggaatcactagcagaaaggtaccccaggctgtttatcatatcctcacagcagaatcacaccattaggcagatgggaattcacaatgacaaggactgggaatggaaattttcatggagaagactgctttttgacaataaaattgatacatccatcagttttcttagggaggtagaaggacaaagcatagagcaacaacaaactgacatttag

SEQ ID NO: 51434 - DNA, 105 bp, Glycine max
  Peptide Sequence Number=SeqID_143119
atggccgaccagcaggcgaccaagtccaaagccaaagctcaagatgttaaagatgcgctactaggaggcaacctagtaacttttaaatctctgcttgttatttga

SEQ ID NO: 51435 - DNA, 127 bp, Glycine max
  Peptide Sequence Number=SeqID_143120
atgacaatagcaatgatgcagttcagcgaagacaagacttaccttgggtggccaccacgatggcagtgagggttttagggcaaaaaattaaaagtgagagtgagacagatgaagagaagaagaagcg

SEQ ID NO: 51436 - DNA, 213 bp, Glycine max
  Peptide Sequence Number=SeqID_143121
atgtcaataagatttgtgttgagtaacctgattgcaaaagcagtgtggacagcaaggtcaatgtctggagctaacaaaaagatgattgaggcactagctgctaggaagaaggaagagtatctaaagaaggaggagtacctgcaacaatttaagatgaattgtcataagttccattttcaaagctttcatccaatatatgcatgttttcaataa

SEQ ID NO: 51437 - DNA, 423 bp, Glycine max
  Peptide Sequence Number=SeqID_143122
atgggtgatcaagagaagacacaggaacagatgaaagccgacatgtcggctctgaaagaacagatggcttccatgatggaggccatgttaggaatgagttcggttgctgaagcagacccaactctcttggcaactgcgcaccatcctccctcaaacatagtaggacggggaagggacacactggggcacgatggcaaccctcacctgggatacaaccgagcggcttacccttatggattgccgcccaactactcaccacctgtcttgcaagacgatgcgggccctattgcttctcccgtccttgaaagagagcctcttcaacagcccgacgaggtccacaaagaccctcaagactatgctcgaagggatgtcgagttctatactccgatccccgaagggccggcacccagcacgttgccttag

SEQ ID NO: 51438 - DNA, 467 bp, Glycine max
  Peptide Sequence Number=SeqID_143123
atggtcattgaccaatcccttttccatgacttaacccaattgtccagtgatggtgtaccatttgaaggtacactgaatggcgattggaagtttgatttctctgcacatgatgcccgccagttggtttgcaccaaccatgcggatatgaccggacgccttcttgccggttcattggcttttgaaagccacatccttcattatcttattgtgcggattttacttccacgatcttccaaccttgcccagagatcctttttaattggtgctgctgtgattgcttcttttggttaccgcaaagagcatgatggctcttgggtcaaaaagggcgctcaacccgctgatgaagaaggcaacctaccagttgaagataattccactcttcttcgaaggcttatggacaagtttgatggttttcagacctttgttggtgacaagtttgatgccatggaattgcaagtcgacatgcg

SEQ ID NO: 51439 - DNA, 165 bp, Glycine max
  Peptide Sequence Number=SeqID_143124
atgttgttggggattgatggggactcggcgttgagaggaacgaagataagggctacgtgggagtacatgagctcagttggaggtgggcaacaggggatggtgggtttctacgtgatttgtggatgtggagaaattgttttgcaccatcgcccgaccgccacctag

SEQ ID NO: 51440 - DNA, 378 bp, Glycine max
  Peptide Sequence Number=SeqID_143125
atgactgtctctctcgatgagtcgatctctagctttctcataagggtggatccttgggtactagtacctatcgcctttagaggactacacgtcctcacctttagggggttgcacgccctcgcctttagagaactacacgtcctcaccttcagagggctacacgccctcgcctttagaggactacacgtccttgccttcagaggactacgcgtcctcaccttcagaggactacacgtccttgccatcagaggactagacgtcctcgcctttaaaggacaacacgtcctcgccatcagagggctgcacgccctcaccttcagaggactacgcatcctcgccatcagagggctgcacgccctcacctttagaggactacat

SEQ ID NO: 51441 - DNA, 396 bp, Glycine max
  Peptide Sequence Number=SeqID_143126
tcgtgtcttaccgggttggactcaagacgatagttaccgggataaggcgcagcgcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 51442 - DNA, 276 bp, Glycine max
  Peptide Sequence Number=SeqID_143127
atgtcaggatttacacgcaattctcctcaaatttcagtcagcccgcatcaattagaccttgcaccttacgcttcagagccctaccatgctcaatggaacgccccagggcttctccgtgacaagcacacgttgcgttcgagtcgtattctcgaagaaatggaggttgatgaaccttggctagggttatggctaccattgaattatcaagtagatatgggagcaagtcagcataggacactggaattggggtggtgttcgtcattggaagtgcggtag

SEQ ID NO: 51443 - DNA, 261 bp, Glycine max
  Peptide Sequence Number=SeqID_143128
atgttactgggagttttactgcctttgccctattttagtggttttgttatgtccatgatgattggatgtggaattacctggatgttgctggaagcttgggatggattgatgggacccgacgttgagagagaacgaggagttaagggctacgtggagagtgacgatgagctcagttggaggtgggcaacaggggatggtgggttatacgtgatttgtggatgtggagaatcgtttgtgcaccatcacccgaccaccacctag

SEQ ID NO: 51444 - DNA, 390 bp, Glycine max
  Peptide Sequence Number=SeqID_143129
atggtggagcacatgagtccggttgttgtattccccaagaagaaacaccacatgaagtcaactacatggggaaccagccaagacaaaatttcaatgcaggtggatattctgaatttcaacatggccaaccatataattcacagtagggacagtggaggaatcaccctgaaaattagttcaaataaagaccagggtggtccatctaacaggccacaacaacaagggcctagtctctatgatcgaacaacgaagctggaagagactcttgctcagttcatgcaagtatctatgtcaaaccataagagcacagagtctgccataaagaatctggaagtccaggtgggacagttggctaagcaattggcagatcgtccgtcttgtagcttttga

SEQ ID NO: 51445 - DNA, 474 bp, Glycine max
  Peptide Sequence Number=SeqID_143130
atggtcaaaggactacatgtcctcaccttcagagggctacacgccctcgccttaagaggactacaggtcctcgccttcaagggacaacacgtcctcgccattagaggactacacgtcctcaccttcagagggctacacgccctcaccttcacaggactacacgtcctcaccttcaaagaactacacgtcctcacctttagagggctacacgccctcatctttagaggactacacgtccttgcctttagagggctgaacaccctcgccttcagaggactacacgtccgcgccttcagagggttggacgccctcgccttcagaggactacacgtcctcaccttcagaggactgcacgttctcaccttcagacggctacacgccctcaccttcagaggcctctccgcccttgccttcagaggattacacgtcctagccatcaaagggctatacgtcctcgccttcagaggactacac

SEQ ID NO: 51446 - DNA, 84 bp, Glycine max
  Peptide Sequence Number=SeqID_143131
atggagagtaaagtgaaactaaggctaaaatcaactcgcaaagtcaagctcgtccgcaaaaaaatcactaaaaaggattttaag

SEQ ID NO: 51447 - DNA, 758 bp, Glycine max
  Peptide Sequence Number=SeqID_143132
ccttcctcgccaaactacagacgctccctgagcgcgatatcgtgctgctgcatccatgttgccacaacccaacgggcgccgatctgagcaacgctcattgggatgaagtcgttaaagtgttgaaagcacgtaacttaattcctttcctcgatatcgccgatcagggctttggcgccggtatggaagacgatgcctacgctatccgcgcgattgccagcgccggcctgccgatgctggtcagcaactcattctccaaaatcttctcgttgtacggcgaacgcgtcggcggcctgtcaatcgtctgcgatgatgctgaaaccgctggccgcgtgctgggtcagttgaaagcgacggtgcgtcgtaactactccagcccgcctaattttggcgcgcaggtggtggcggcagtattgaacgacccggcgctgaaagcttcatggctggcggaagtggaagctatgcgtacccgcatcctggcgatgcgtcagacgctggtggatgcgctgaaagaggccgttcccggcaaaaactttgactacctgctgaagcagcgcggcatgtttagctacaccggattgagcgcggcacaggtggatcgtctacgcgaagagtttggcgtttacctgattgccagcggccggatgtgcgtggcgggacttaactcgcgtaacgtccagcgtgtcgcccaggcgtttgctgctgtaatgttgccgctaagcggcctggcgcatgaggggcatagggataaatatgcgtaa

SEQ ID NO: 51448 - DNA, 411 bp, Glycine max
  Peptide Sequence Number=SeqID_143133
atgactagaggcaatccatctaactcacaaccctttgattctgaaatagatagaacatttcatagattatttaggcatagtgtgcatcctactttccctgaacattttgtgccttttgaacatcctgagcatcctgttactgatgagtctgtgcattctgtggttggtgattttgaacatcctaattttgagcattctgattttgaacattctaaaaatatggctcaacctccacctcgtgaagaccctcataaacatctaaaagaattccatattgtctgctctaccatgaaacctccagaagtccaagaagatcacatctttctaaaggcctttcctcattctttagagggagtggcaaaggactggctatattaccttgctccaagatccatcacgagctggggatga

SEQ ID NO: 51449 - DNA, 564 bp, Glycine max
  Peptide Sequence Number=SeqID_143134
atggcctctaggaagcgtaaaagcattggggcaaggccaactgctcagtatgacactagacggttccattcgcttgatgcttggaaccgttatacagataacgtcttaggaaggagcattttgccagagaggaaggtagagatataccacacagagtttgatgacttcaagatagagttggagaggcgtaatcttcacaaatgcctcaccaacttggctgatgggactattgatgttgctttggtgaaagaattttatgctaatctctacaggtctgaggatccttcaccaaagcaagcaagagttagaggccacttggtgaagatagacgcctacagccttaacacatttctagagactcctgtagtcctagaggagggggagacattacccacctactctaggtactgcaggttaccatcagaccacagagagattgaggctgctctttgcataccagggatggggtttattttaaatgttgagggccatccgaggaggattctcaagaaggatctgactaccttggcccaggtgtggagtgtctctcgtactccaacctga

SEQ ID NO: 51450 - DNA, 58 bp, Glycine max
  Peptide Sequence Number=SeqID_143135
atggagcttacaccattgaaagaaatctcaaggaccgcaggtcgcttggggactggat

SEQ ID NO: 51451 - DNA, 207 bp, Glycine max
  Peptide Sequence Number=SeqID_143136
atgaagaaacaacaatggagaagccatggagttgcagcggaagtaaaggagaagaggcactatccactagggaataagccatggaagaagaagcttcaccaccaagagagtgtcttagataagaagcttagagaggaagcttcaatggaggaagaaaatgagagagagagagagagagaaagtggcatgggattgaaggaaagatag

SEQ ID NO: 51452 - DNA, 471 bp, Glycine max
  Peptide Sequence Number=SeqID_143137
atgttttgcgagaatgctccaaccatatgggatcagcataggcttaaaggagcactcaaacccgatgacccccaaggcctacactccgaagagtccgtcaaggcctctccctcctcattcagaggacaaaagtcagataaagtagatgtcactttactgccacaagagttggatgccatggaaaatgttttatccgcgaagtatgaagatgcaagggaggaaaagaagttacgaaataagtgtgaggattccagtgacatggtggcagaggctcgaagggaaaagattagtgaaaggatgaaaattcttcaagatttggtccctggttttaataaggttattgggaaagcattggtccttgatgagataattaattatattaaatctcttcagcgccaagttgagatgccattcatgtcatcagagtgttttatttgcaaatactttaccatatctatgattatcctttaa

SEQ ID NO: 51453 - DNA, 291 bp, Glycine max
  Peptide Sequence Number=SeqID_143138
atgaaaacaccaagagaactcaattttatcaaccaattcacatcaggacatcaatattggttcccaaacgttagagagaaggagaagggattgaagcctccattccactgtctacgttcgatgagtatttctccctccacagatggctttttgcaaatctcaatggtgaaggaaaaagagaaggttttgggaggaggaaaagggaaaacaaaattgagaggaagaggggacgtagaaagtatcgtgattgatgtcaagaaagcacaacaatggcagcagagttttgtgtaa

SEQ ID NO: 51454 - DNA, 369 bp, Glycine max
  Peptide Sequence Number=SeqID_143139
atggagtgcctagagggagtttgggagaccctcgaaggcaatgcaaggtgccaattccggggcacgattcgattcacggctacttcattggtacatccagaggaaccagcacgcacgcttcaacgcactgtggagtggatattacctacacctactccatatcgactagtggaatcagtccaagtgatagaggtgacgtcatccgaggaagaccctgaggaggacccagaggagctacctcttgagcctgatgtggatgctctcagctttccagagggtgatgaggacgtcatgtcggcatctgaggcagactctacggaggagagcggtcctgagggaatagcgactagtggaggttcttcatcataa

SEQ ID NO: 51455 - DNA, 312 bp, Glycine max
  Peptide Sequence Number=SeqID_143140
atgtctcctccacctctagaacctcacaatcactcacaaactcatctcaagctctcaggacgacttcctcttcaagctcgattctctacaggtggccttgatggtgcttgcacgcttagcgcaactctagatcgcttagcgcgcattagtgaatttcggcttagcgcgcgtcttctcgctcagtggatggactcaagtggtgcgcttagcgggatgggacctcgctcagcgaacatgcacagctcatccttcttccagattcttcctcatgctcagccaagggaatggtgcactgagtggatggctcgctaa

SEQ ID NO: 51456 - DNA, 645 bp, Glycine max
  Peptide Sequence Number=SeqID_143141
atggcagctgggaatatgcatcctcagccgaaagaaaaattggtggctcaagaatatggtgaccttagtcagctagctcccaaggccaattggatagagcaattcatacatgagaaagaattgaaaagagctaacaaaggacgaggatcccatttgatctcattagttaatgttgatgaggaaaatggggaggtctttgaagaggaagttgaaatcatggctactgagatattacgggggaaaccttattcgtgtccagctttaaagccaaggaagaataaagttgtacagagggctttgaaagaaggttgttttaaactagccgataaaggtgcaaccgaaagggaagtagatacatgtcccttcccaaaactagatattaatatggtgtcttatgagcatcctaccaccaaaagaaagaagatgaagcagattcgccaaagtgtgtttgataggttagaacctcaaataaaaggcacatttaatgggtcaacctatcaaattattggtcctaagttagtcgatatgcggcaagccatgaggaggaaggaagaacccatgaagtttgagaaattaaggcagcaaatccatggcaacatgaaggtggctcacgtgccagaaattgataatagcccaatcccatga

SEQ ID NO: 51457 - DNA, 426 bp, Glycine max
  Peptide Sequence Number=SeqID_143142
atgaaggttttctctcctttgctaaaggtgaaggatcaagataaattcgtttggggagaagagcagcaacaagaatttgagcaaatcaagcaagtgttagccaaaccatcagttctagtgtcacccatactagggaagtgtcataccctaatttcgtccggggacctttgctcgatgacgtgcgaccattctttggtcctcgtgaggtgcttggcacccatcattaggcaatttgtgaaattccaggacatgccgaaaaaccaaaaaaatattgatgcacaatcccacccaggcccacttgggccctctggaatattcctccagaaggcggttgcttctggaggaagcaaccctgctcgcctgggcgagctgagctcgcctgggcgagctgggcggcaacctcctcccctattttgctataaatag

SEQ ID NO: 51458 - DNA, 615 bp, Glycine max
  Peptide Sequence Number=SeqID_143143
atgtctcgcaaagaaaatctgatatctgagttacacaccagaaaaggaacatggaaaatagctatgcgtatcactgatctttggcaagctcgaaagcaaaatatgtttcagggttcaaaaattggagctactctctggcaagaactcttcactgaattgcgggacaagttacagtgtggttcttcgtatttgattcagaacctgaggattgttgacaaccaatctgaatacagagtcagcccagctccatatttggtttatttgctaaaaactacatctgtcaaggaaattcaccatccagaaattccttctaatgtttatctcataactccttttactgatataatctctggcctcgcaccatgccatactttagtggatattgttggtgtcgttgttgatctgatcgatgttaagacagttaatccccctcacaggatgacagtcaggctcagggataacaataactgcgacattctaataactgtttgggaggacaatgctattcagctacatgatgctattgacaaaaaccttttgtttcaggaaccattggttgttatgttgaccttaggtaaaatcaaggatgctacaggtgtgtctggtgttggttag

SEQ ID NO: 51459 - DNA, 708 bp, Glycine max
  Peptide Sequence Number=SeqID_143144
atgttgaattcagagggatcttcgttgttcaagcctaccggtgatagggtagatgccttttggaaatggaacagtttaaaggataaaaataacaggaagagtgtaacctgtgatttttgtcacaaaacgactacgagaggaatttctagagcaaaaagacatcaacttcaaataaaaggagatgtgggttcttgtaaaaaagtaccggaggatgttaaattagaaatgattgctgcttatgagaagaaaatagctgaaactgcagcatacatggaggcaatgcaagaagaagacgaggaagaggaagatgggatcctagagattgcaagacttaaaagtggaaaaaagcatccaacaacatcaaatgaagcctcctcaactgcttccaataagaggatcacaactaaaaaaggccctattgattttttgttctccaaagcacctgaagaaagtatcaaattaggaaaaaccatgagacaatcaagtgtaaatgaaacttataacaaggctacaagagacagggcagttcagtacattgctcgtttcttttttaggaatggaataccattcaatgttgctaaatcaaaaagtttcaagttgatgattgaggcgattggaacctatggtcctcatttaaagcctccaagctatcatgaattgagagttccactccttaaaatagagttggatacacgaagggcttattga

SEQ ID NO: 51460 - DNA, 1043 bp, Glycine max
  Peptide Sequence Number=SeqID_143145
atggctgagattgttcctcaattttttattgttgattcaacactttgctacacagagccgcagacacccaagaggccaagacccaacagcaagaggccaagacccaacagcaaggacgaagactcatcgggttgcagcttcgtcgggtgcagagtcgtcgccggagtcgctggacgggatcgtcggagtcgctggacggagtcgtcggagtcgcaggtcgaggttgcagcgcagcttcaatggagaaagggtttctcaagccgtttggataacagatcggggagggagcttcaatggccagccgcgacggccgctactctgaactgccccgcttctcctgccttcgtcgcgttacttggtgctccccgggtttttgagaatgatgtacctacatcagcaaatatatttgatgatcctttgttcaactactacagagatgtccttgatgagcaatggatccgggcaattgatttcacttctgatagtcgtattgggcagtcctctgccatatgtctggagcttcctaatggccgacaatttccaaatttcagtgaaaactttgcttattacgaggaaagtgagaggcaatacactttacagactggagttcccttttctcaaaattggggtctggtccccattgttgctcctcctcaaggtggtcaaattccatatgacatcttgtttaaagtcaattcattggttcagcatgcgtgtcttgcagaaccttcacttgatggtgacttctatcgcttggttgatccctgtagaatgccccttgaatttattgaacatgcttcagaaaagatttaccattcaaagcaattctgcgatgaacccacaaagtggctgacggatcagtacaaaacgtaccttaaatcaaagaatcatcctcggtcacctgcaatatccttggatacacggttgttatacgttctctgggttcagatcacaccttgcaaagtatacttttgtgttccagagattaatatctcaaatcgtgttctccgtcatttccatgaacatattgataatgttggact

SEQ ID NO: 51461 - DNA, 428 bp, Glycine max
  Peptide Sequence Number=SeqID_143146
atggtgaagacggtgatcacaatgatggtggtgacggtgtcagtgatgacgacgacaacaatcatgttagtagtggtggcagtgatggcgacaacaacaatcatgttagtggtggcgacgatgattgacgatcatgatgatgattatagtgatgatcatgacaattatggtggaaatagtcataacggtagtggtggtcatagtgatgataggggatcagttttgcaatggatgccgccacctgcaattgcgataccattgatactgccatcagcagtggcgagaatggtgctgacgtggctgggtgccgccagcaccaatagcgatactgcccatgccgccaataccaatggcgggacatgtgccaacgtggacagtcccgccattggctcctgcgtgaccaacgtggacgtgaatctacgagaaag

SEQ ID NO: 51462 - DNA, 96 bp, Glycine max
  Peptide Sequence Number=SeqID_143147
atgtccaggttgaacaacctctatgtgaaagtagcagtgaaagaagagcttgaagatgatggagatgaagatggtggtggtggtggtgatatttga

SEQ ID NO: 51463 - DNA, 816 bp, Glycine max
  Peptide Sequence Number=SeqID_143148
atgtctaggttcaagaatgaggttcgacaagccggacaaaagtgtgacaagcaagaaggaagcaccaagaccgactcacacaagtcaaacaagaggcataagctcgacacgtgccaccttctcccaaaagggcctaggtacgagtgttatacacccctgacggccaatcacactataatccttgaggaggctttcaacttggaggtacccatcaagatacctccgatgctttctcccaggatggggttagacaagactacatactatgaagaccatcacagttatggtcacaacacaaaagattgttgtgccctgaaggacaaaatagaagagctcatacagactaggtatctagccaagtttgttaagaggctggaaaaccaccaagcaagagaaagacctgaaggaaaccaagaggatcaacataagatcgaggaagatagagacaccattaatagagacatgatcgacaacctccacaagaataggagcccgcccaacaaatcagagtcagtctcgcaagcatcacctccatgccatttaggacatcgacatcaactatgtcgatacaccatcaccatgaagtctccttcctatcactttcactggcagagacttcaagggtcctcatcgacctgggtagctccactgacatcttattgtcgcaatgtgcccttttgcgggcgagcgagggcgaggctcacgggtgtgctttccaaaggaggaaaggtcgacaaaagcggggcttttgctcctacgtaccctcctttagagaggaaatcagacctacgtagttctttcttatgcgtgaatcaa

SEQ ID NO: 51464 - DNA, 261 bp, Glycine max
  Peptide Sequence Number=SeqID_143149
atggtttgcaccaagaaaattggccaaatgacgtctgaggcagcaaaggaaattgctgacaagatttttcaagattccatggacaagcaaacctcacagggttcctttgtcgcccatggacatcatgatgtaatgattgctgccattgggcgactagaacaccttggtcatgtgcatgctgctggagctgatgtcaagatcaaaaaaatactttggaccggctccaaggacctcctgcacgtctttgtccatggctcctga

SEQ ID NO: 51465 - DNA, 825 bp, Glycine max
  Peptide Sequence Number=SeqID_143150
atggtttgcaccaagaaaattggccaaatgacgtctgaggcagcaaaggaaattgctgacaagattggttcctttgtcgcccatggacatcatgatgtaatgattgctgccattgggcgactagaacaccttggtcatgtgcatgctgctggagctgatatgcaatcacagggactcacattgcctcttgagcctgaagttggtccttcagctactcgtgtcagcacaaaggattgttgtgttgatccctcagggaacgacctaggcatgggtggcttagagaaatgcgggttgtacgtcaaagaaaatccttctcgccaggttgccctaggaagaatttatgaggggttgacaaccattcacaatatctctttgcgcaatgatcaagtcaaggttggtgttgaggaagttagagatgcagatgctcctattcatgtacccactcaagaggttcagttagtggggcaggcacttaacaccttcgttgcttggccaactaatcttggacccgtgcgaccagcaaaacctgcagataggccggattatgatgttgatgatcccatatatctgatgacatggatcatcccacaactttttctaaagccattgcaagttacgtgggatgctaccgtgtttgggctgtttaatgaaaactttcccttgcacataaagcataaagatctgtctgaaataggatacgatggtcaatatctcagcatctctgttatactgtgtggattctacaagtatgcgagtggggaattccgatgtgtatggattcctcgagccacagtctatacagagatttgggcaattgcaatttga

SEQ ID NO: 51466 - DNA, 279 bp, Glycine max
  Peptide Sequence Number=SeqID_143151
atgagggtgactgggtttggctccatcttaggaaggatagattccctactaaaaggaaatccaagcttagcccaagaggggatggaccttttcaggttttggagaggatcaataacaatgcctataggttggacctcccagaagagtggagctgctattgaggaggaggaactaacagatttgaggtcaaatccacttcaaggggtaggggatgatgcaatcctccctagaaagggaccattcactagagccatgagcaagaggctccaagaggattag

SEQ ID NO: 51467 - DNA, 1752 bp, Glycine max
  Peptide Sequence Number=SeqID_143152
atgctggagaggacgtggtttaggaggacaatgaagagggaggcggagagtgagtggtatgtgaatgatgatagtggggatgacgggcacagtgatgacaacatggatagggatgacgacggtgacaaaaggctagggctcgagaggttaagaggagcggcaccaccaacgtgggaagcttccccacaaagcgtcctcgtgaagagcccacaacgctcacttgctgtgtgcgccactgacacaacgtctcaacagtggagcgcaaacatcgatgtttgggccttcatggaccctgccatcacggtggcctctgtcgaccatgccgacgaggtgacgcacaagagagatggaatcggtgagcgcctttacacgactagttcatcgctactgcagtgtcgaaactgcaatgctggtgacgacagagaaatcaggacgcagagcagtccttctatgaaggaggaaaatgatctttacaaaggcttgttcgacgacgagcagaggaagattctagacattaaagagcaactcgaagaccctcaccaggctgctgaagtattgctaatcaaaacttctattcctgggattatggggttgaaccaagcacatgtttttaaggaaaggttcatcaagtcaaggaaagaacgcgctttatggcacccttaccgaacacgtgctagagctagagtaatgggtggaataaaggaggtacaagagcggatgaaggccaacatggaggccatgaaaaagcaaatggccacgatgatggaggccataatgagcatgaagaagataatgcaggtcaatgcggttgtagttgccgctaccagcgctgttgttgaggtggacccgactcccccatctagcttcaaccaaataaatcatccaacctcggatagggtaggtcagggggacaaagaattgggaagtacgggcggcccccattttgtgcaagttcagaaccagcatgccttcccaccatatggcttgcctcccaactatgcaccaccaatgtggtgcatcttcccgatgagaatatacgccactgaggggcaagctgttggtgtacccctgcccaacactttggaggaggaaaggctcaaggccattgaaggaggcggagattatgcctttgctgacatagaagagttgttcctagtacttgacgttgtcatccctccgaagttcaaggaaaatgggagcatatttgcgaaagatgaaaaattattgatgcactttttcaaagaaagtcttactggggcagccgtcacctgctacagaacatgtgcaaaaaagagcacgaatctttcaaaggatatgcctaaaggtggagggatatggcagctcaagatcgaagtgggtctgagaagaggcaaatttgatcatcctgctttactgaataagaaacctggggcaaatggagaggatgagaaggaggaaggaacccatgctatggctgccattcctacatggccaaatttcccaccagctccacaatatcaatactcagccaatatcagtccttcttattacccaccacccaatcaaccacaaaggccacccctaagtcagccacaaggcccacctactacacatccaataccaaacactacccttaacacaaaccaagacaccaaccagggagggagttttccaggtaaaaagcctatagaattcaccccaattccagtgtcctatgataacttgctctcatatctactcgataattcaatggtagccataaccccagccaag

SEQ ID NO: 51468 - DNA, 771 bp, Glycine max
  Peptide Sequence Number=SeqID_143153
atgaggaatcttctcaaacaactcggtggtactcgacgagcgcgacgtgttgctgcacggggtgttactgaaagaggtgaaagagctggtcgacagggaaggggtggcactgccgagggtcttcgtgaaggggatatgcgtgggtgggttgagaggatattaaatgtgacgcgtgtcgagagggggattgagagggaaacatgtggagggtgtggtggggctaggttcgttccttgcttcgactatgctggaaattgcaagattgtatggagaggagatgaaagggtggcggcgaagggaggaatgaaggagggagaaagacaggctaggagatctaacatccctttccattcaatactccgtgatgttcttgatactccgcaagagctcattgaatacttccttgacactaaagctcaggagaccgtgatgtttttgcaacccaaattggagttaggacagcttcaattcgctgaacaaaacacaggttacttttactctaatttatcttcaatgccgttgctggagatggttgaagagaatgaaattaatagatcattattggaacttctagatgaaaacatagcaagtgcacaaaagggcaaccaggtttttgtccagctagcgatcatgttcatggggatgttcaattatgtagtgaaaataatgatgataaaatcggagttcctcgatttgtgtggtgtgcctactgtgaatcttgatgaattgttaggtagatacatggatttgttatacagttcgggagaatag

SEQ ID NO: 51469 - DNA, 894 bp, Glycine max
  Peptide Sequence Number=SeqID_143154
atggttgtgcagtgttggtttctgctgtcatgggaaaggtgggcaactggggatggtgtgcttatgcctgggcttgtggaaatgggatgcttgttttgcgccatcgcccgatcgccacctagtaccacatatgacagagtggtacctggggatatgtcgcgggggtcaggagactttggggacgccaggtggaatgctattgcccaaaaccaagcttggccaatcacgacccaacccgggcatagtcagtcagtgagaacatgtgatgtacctaagcagacgagctcctggcagtcaaccaataaaagaacaaaagtccacgaagcaaggaggcttgtgtggcggctggccagctatctatcttgtgttttatctgaaaaataccctctgggttcaaaaattgaaaacaggacgctcagtagcttctggttccaatgtgcaaaggctgtggtaattcgttttttgggcactggtaatcgattacttactttgatcacgatggcagcgcagttgatcgatgatcgcgttgtgatggagtgcctagagggtgtttgggagaccctcgaaggcaatgagaggtgccgattccgtggcacaattcaactcactgctacttcgctacctgtggagtggatactacctacacctactccatatcgactagttgagcctgttcaattgatagaggtgtcatcatctgaagaggatcttgaagaggacccagaggagctacctcctgaacctgctatggacgcccctgacttaccagaggatgatgaggacccactccctgatgttgattctctagaggatattatgtcagcatctgaggcagactctacagaggagagtggccttggagggacagcgaatagtgacgactcttcatcatag

SEQ ID NO: 51470 - DNA, 561 bp, Glycine max
  Peptide Sequence Number=SeqID_143155
atggtgaatggcttggacaagtataatggagttggacatggatccatggacatagggatcccttgtatcgaaagtcttcctagcaaggccaccattagatactcatcgattgaatatggcttccgctcgatggggagactaccatgtgaaagagactcatacttgagagagaaattgttgaagtacaagtatgaggaatgcgctggctggttatcacctaaatcggggtggtatttttcaagagatgaaggtgacgaccagcgtattcaagccactatatgggcatcttcttctgcctatctggaatcatcataccttgccaactcgttggtggacccccatgagtcagatttacatgacatcagagggtctgatgacaaaagagtcatctttgacgttgatgtgggaagaaagggtgccttgtcaatagtgtatttcgacgatgtgcaagatttttctggtagtgaagtagggaatgaagaagtgagggatggagagttcgatggtgagattggtgatgaaatcggtggtgaggtcctagccgacactgaatatgactag

SEQ ID NO: 51471 - DNA, 135 bp, Glycine max
  Peptide Sequence Number=SeqID_143156
gaaaatgagggaggagcttgccacccagctcgcccaggcgagctaggttgcttcctccaaaaggcaccgccttgtggagaacttcctggaaggcccaagtgggcctggttgctatttgcacccccttttaactaa

SEQ ID NO: 51472 - DNA, 1005 bp, Glycine max
  Peptide Sequence Number=SeqID_143157
atggaagaagaatatattgagcagctatgcatgcatatattgaagtttaaaccggacttggttattttggacaaggttgatgctcaagatcgaggtataatgctgggcctagtaaaaagctgcataggtaccaaattcacaggtcaatttggggatttaattgctgacttagctattgaagctactacaacagtaggtgttgagattggccaaggtttgacagatgtagatatgcatgcagaagactggattctcttattaaagattgaagaagaatatattgaggagctatgcatgcaaatattgaagtttaaaccggacttggttattttggaccagggtctgactgatttggcaacacattatctcagcaagcatggagttagtgcaatgaggaggctgagcaaaactagaccagatgaattgcaggagtctgatgtcggtactggtgctgggttatttgaggttaacaaaattggagaagagtacttttcatatattgttaattgcaaagaacccaaggcttgtactattctactaaggggtgctagtaaggatctattaaatgaagttgaaagaaacccacaggatgcgatgtctgttgcaaggaacattataaaaaatcctaaacttgttcctagaggtggtgctatagagttgacggtgttggctggcttgaaacaaaagagttcatctattgagggcatagagaagtgcccttatgaagctgctgccgtagcttttgaagccataccacgaactttggctcaaaattgtggagtaaatgtcatccggactatgactggtctacaaggaaaacatgcaaatagagaaaattatgagggatggcaagggagtgaagggacaaagtcttcgtgtatgcttctgaggattcatgatatagtgagtgggatgaagaagaagcaagcccctggagctcctccttcaaaactgaaggttgagaccgaggcagatgctgacagtgagcaaatccttgctgactga

SEQ ID NO: 51473 - DNA, 756 bp, Glycine max
  Peptide Sequence Number=SeqID_143158
atgggtatggaaggttgtttgaagaattcgtcactggaggcgtcccttgagtttaaagagtttttcaagtctctgtatgaagaagtggcttcttcttcctccaagaagaatgaagaggatgtgtcttcccctttcaatctatgcccaaagatcccagtttttatggaaaaatatgaaggctggccattcttcaacctgtatgataatgttgtcaagaaagttgtgctttgggtaaggattcctatgtttctcattgaactttataataaagagtttctttgggaagttggaaatatgcttgggatgatgcttaaagttgatgaaaatacctccattcattctagaggaaatttttctcagttttgtgtcgagttggacctgagcaaggagctagttccttcttttatggtgataggtatgatcatcgttccaacaaatgccctgaagctagttccaactctgtatctcaagaacaaaaagtcttttagtaggggtggcggtgtgcaaccttctcaaactaaccctaaagacaaacctgacattcctttttctaatgctgacgtgggtgatgaggacaaggcaaggaataaggacaaggaaactttagaaggacttggaggacctatggaaagggctagaacaaagaaggccaaagaagctcttcaacaagtgttaagcatgttacttgaattttggcccacattacaagtggagaagcttcggattgtcaattgcaccatgttccaagaagagtag

SEQ ID NO: 51474 - DNA, 549 bp, Glycine max
  Peptide Sequence Number=SeqID_143159
atggccacacctctgaggtctcctccccagtctgatggtcaatcagaggccacttcgaagcggagtagaacaatgacacggcttagaagattgacattaagaaccatggatcagcccagaccggcaatttatgtcgatcccgctaccgggagagcatcgggacctatgcgtgaaaagttccacagctatataggggtagttgcgcgagaaaaggttcccattatccacaacaattggaaagatgtacctgaaacgctcaaggagatagtgtggaatgacatattggtaagtcctcattttgatatcccagaagccgcaaaggagaagacgaaggttatgcctacggttgcgacgagatggcgacaatttaagtccacattgactagcaaatttgtctttggtaacactaaagggcaacaaacgcaggatgttgttacaaaatatggactagatcccgaagcttggaaacaatttgaagcgacccgagtgacacctaactgggaggctaacttcaatgtcgactcagtcaaagatccacatgagctttga

SEQ ID NO: 51475 - DNA, 592 bp, Glycine max
  Peptide Sequence Number=SeqID_143160
atgtgtctgttagtattttatatgcatagatctcccacaggcaatttagttcctcagaacttagaaattgaagctacattaagaaggaacaggccgagaggagaaggaaacttctgcaagacagaacagttgcatccattcttgaggaagaaactcatttttctgaatcattatcacctgattcaccattatcaagggaatccactactcaattgcctaaaaccactagcatggcagacgagcagcaccagaggatcacccttgaggagtattcaagcagctcagtaccataattctttactagcattgcacgtcctgaagtgcaagggaatttattccaacgattacctaatgaagacccttatgcatatttggcaacgttcattgaaatatgcaacactgttaagattgccggctaaaaggtggcttcactcatttaagggtaacagtctaaaaacctgggaagaagttgttgaaaagttcctaaagaaatacttcctagagtccaagactgtggaagggaaagctgcaatctcttcatttcatcagttccctgatgaatctctgagtgaagcattggagaggttcagag

SEQ ID NO: 51476 - DNA, 747 bp, Glycine max
  Peptide Sequence Number=SeqID_143161
atggaggaagctgctcaatctgaaagcactgaggccttgattgaccctctatctcccatcagacgacacgtgaagtggaagagggcccgcaccaagaaaattggtcagatgacgtatgaggcaacaaaggaaattcttgagaagattgagtcacaaggttcctttgtcccccatggacgtcaggatgtcctgattgctgccattgggcaaccagaacaccctggtcgtgtgcatgctgctggaaccggtgtgaccatgaagcaatactttgaatcggctccacgaacctcccgcacttcttcctctatggattccaaagaactagagcagctgactcaacaaattagggaccagctggaggagtcgatcatagaaaaaggacttgcactgcctccggagcctgagtttggtccctcagctgctcatgtcagcacaaaggagagttgtattgatccctcagggaacgatccagacatgggtgactcagacaaatacgggttgtacatcgaagaaaatcctccctgcttggttgccttaggaagagtttatgagggatccataaccgttcacaacatccctttgttgcatgatcaagtgaaggtcgatgttgaggaggttaaaaatgcaaatgctcccgttcctgttgttcacactccgggatactacttgtttgtgtggatgcaaaatctactggcaagtgcatcgggtcatcaagcatttgcaaccagaaatcatgattgtgaatga

SEQ ID NO: 51477 - DNA, 576 bp, Glycine max
  Peptide Sequence Number=SeqID_143162
atggcttctagaaaaagaaagagtattggtacaaggcccatagaacagtatgatacaaggagatttcactcctttgaggcctggaatcgatacatggatagcgttttaggaagacacatcttacctgaaaggaaggtggaaatataccatactgagctggacgagtttaaggctaaattggagtggcacccttcaccaaagcaagtcaaggtcagaggccacctggtgaggattgatgcagacagcctcaacacattcttggagacgcctgtgatattagctaaaggcgagactttaccagcatattccagatactgcaggttgcccatagattataaagagattgaggatgccttatgtataccaggccgagggtttgttttgaactctgagggccatcctgggaagattctcaagaaggatttgacgactcttgctcaagtgtggagtgttctctcatattccaacctggctcctacttcacacacctcagacctgacagtagatagagctaggctggtctttggcctagtctctcagatggacatgaatgtgggagcccttatctctggctag

SEQ ID NO: 51478 - DNA, 471 bp, Glycine max
  Peptide Sequence Number=SeqID_143163
atggctactccacccagctctcctcctcctccttctcctcctcctcctactgaagcagcatcacagtttccatctaccttgaagcggacaagaaaagccacacgactaagatcattggcgactagaccagctggggcagacagatcggtggtccacgtcgatcctactatcgggaaagctgacggtccccacaagaagaaattaagaacatatttggggattgtcgctcgtgataaggctgaatttgatatccctgaagcatctgacgttaggacaaaaaagaaaatacttcagactgtggggccgacaaggacaatatggatgacactgtttacgaaaaatacgacattagcaaagagaaatgggcctaattttgtcagagctgcagagacccctcgtgggaggatgtgcagaaaaaggtgttcgcttctagcaagtgcaccggatcgcacaagtagtataaaacggtaa

SEQ ID NO: 51479 - DNA, 345 bp, Glycine max
  Peptide Sequence Number=SeqID_143164
atgatttgtttgcagcccaacctcattacaagcctagtaaaagtccttcggattcaagtttgtgtgttcttgactgtatggcttagcgtgagattgacgctaagctcaaattcacttactcgcgctaagcatgacgtcgagatcaggaagccctttttaagcctgatttgcatagaattgaaaggggaagagaacggttcactactcagaggcctgaagagtgtgaatttcagaggtcatagagtagagcaaggggccaagttttcatcttttagggagattagtgagtttttgagtgattgtgagattcctagaggtggaggagacatccctactcctttgtaa

SEQ ID NO: 51480 - DNA, 141 bp, Glycine max
  Peptide Sequence Number=SeqID_143165
atggcaccttttttaatgggcggagggggtgctgctgaaggtggaggtggagaggaaagaagggagaaaaacaaactgaagcgtcgcagccgaaaatcacctccaacggcggcgaacggtgtcggagaaaagggaggttga

SEQ ID NO: 51481 - DNA, 216 bp, Glycine max
  Peptide Sequence Number=SeqID_143166
atggccactgttcagcacctgttgatggacaacaagatgaagaggctcaatatctacaaaactaagcctaacctcaacaaaaatttcaaggaagctactaaggctataggggtggctcaggtcattctaacaactcttatggaggttcttcaaataaaggttcacaacaacaacaagctcaaccagacagattgtccaagatggaagatactttaa

SEQ ID NO: 51482 - DNA, 393 bp, Glycine max
  Peptide Sequence Number=SeqID_143167
atggtgtaccgtttgaagttggtatgcaccaaccaagtggatatgaccgaaaggcttcttgccaaatcattggcatttgaatgccgcatcatgcactacctaattgtgcatatcctacttcctagatcatctaaccttgcacagccctttgttaaagtcaagagatctttctctatcggtgcgagtgcggtttcctcttttggataccgtaaaaagagggatggttcttgggtgaagaaggacgctctcgcacaggccacagaagaccgctctccatcaccacctcctcagagagatgattcttcacctcttatgcagagcattcttgacagactggatggacctctaataattaattcaaccccccttcttaattattctgaggccacttga

SEQ ID NO: 51483 - DNA, 798 bp, Glycine max
  Peptide Sequence Number=SeqID_143168
atgtccattgcccaagcctcacagttcattgtgatgacaagctgtattttgcaaatgactacaccacccagctctcctcctcctcctcctcctactactactggtgcaacatcacagtctccatctaccttgaagtgcataataaacgccacacggctaagatcattggcgactagaccagttggggcggagagaccactagtccatgtcgatcctgcgaccgggaaggccgacggtccccacagtaagaagttaagaacatatttggggatcgtcactcgtgataaggtcaatgtcacatacgagaattggaagcaagtccatgctgctcagaatgatttgatatgggaggatattcaggctgaatttgatattttcaagaaaaaacatcgcatttttagagatgtagatgctcccattcctatacccactgaagagggagttgtgggactagcaaaacctgcagataggccagatcataaggtcgatgatcccctatatctgatgacattgaccatctcacagctttttctgaagccattgcaggttatgtgggatgctaccgtgttcagggtgtttaatgaagacttccccttgtacataaagcatgaagatttgtctgaaataacacacggtggtcaatgtctcagcaactttgttatacaattgtggattctgcatatgattgagacaagtatgcgagcagggaattccgatgtgtatggattcctcgagccacagtccattcagagatctggacaatcacaatttgaatcagaaagttacatgaagaactag

SEQ ID NO: 51484 - DNA, 279 bp, Glycine max
  Peptide Sequence Number=SeqID_143169
atgcttttctcgccggcactcgacgacgccaagcacggcttctcttggccggagatgtacaaggaaaacctcgccggtaccttggaggcctacgaccgccacgtgttcctttgctacaagagtcacctcgcctggccgccacgcctcgaggccttcgacgctgatgctcttcccctgcgtgtcgccaccgtctggagagctcgcaaaaatgacatcaccgtcaagagcgttgtgtcccgacgtccttcagcacaatattccttaaagcagttcacctag

SEQ ID NO: 51485 - DNA, 677 bp, Glycine max
  Peptide Sequence Number=SeqID_143170
attttaggtggtacagagatactttcctaactagggtttacaccagagaagatagtcaacaaccattctgcaaagagaaatttctagctggtcttcccagatcattaggagacaaggttagggataaaattcgtagtcaatctggaaatggagacattccatatgaaaacttaagctatggtcaattaatttcctatgtccaaaaggtaggcttaaaaatctgccaggatgacaaaattcagaggcaattagccaaagaaaaagctcaaacaaagaaggatttaggttccttctgtgaacaatttggcttaccagcctgcccaaaacaaaagaagaaacaaacctctaggaaagaaatccaggatcataaaccagccaatagaagaagatttccaaaaaggagatactcacacaaaccatcaaccaccaaaccaacaacaatccaggacctccaaacagaaattaacaatctcaaaaaggaagtaaaagaacttcgtcaacaacaagaaattcatcaaatcatcctttctcaacttgaggaagaaagtgattctgaaagtaccaaagatagtgaagaaaaccaagctgaaaatttagaagatgatatgtttatgagaataatcaacaagattaaatccaagtatttacatatgtccgtaaggacatatgttaactaa

SEQ ID NO: 51486 - DNA, 177 bp, Glycine max
  Peptide Sequence Number=SeqID_143171
ggaggcgcagggcgagacaccataatagcctggggatggccagcagcgggcaatagatgcaccaccgccacctccaaagcccctcagctcatctacaaaagctggagtgttgcctacgacctgtggtcgaccaggaggcgaccaagtccaaagccaaaggtagtgaaaataccttag

SEQ ID NO: 51487 - DNA, 834 bp, Glycine max
  Peptide Sequence Number=SeqID_143172
atggggagaattagtgaatggggatatggagtaagtaggaggttggtgaggcctcaaactcactgtctccgatcttggagcccttttccgttcatggtgtcgaaagcgaatgcaaggatggaaacttgcatgaaagctgtcgagaaagcaatcgaagagaaccacagagctcgagaattgggactgacttccataaagttagttagcatgaaaatggtcaagggtaccatgctggaagttgaccaagggtttaatgtggaagtcaaaagggtagaagaagagaagacaagggaagccgtgtatggactagtggcccaggagggcacaaggatacccaatttaaggccttacaaataccccaatcaccagaaggatgaaattgaaaagatgggagtaaaagctgaccctagcaaattggcagtcatgactgagtggcctaaacctaaagatgaggtttgtgaaggattatgggagaattgcacaaccattgaatgcattactcaagaaagatgcatttcattgggagaagaggctacttctgcatttgaagaacttaaggcaacaatgcaaaagctacctattgacgtagctccatgtggagtttgtaggccttggatcttcttcatcaatggagtcctttgtttcttgaagttcaatgacagcggaatggagaaggaagaaagatgtttggagacatcacttcaaggagaagatgagtcaagaacaagctcaccaccatacgaagtcatggataaaagcttgaagataggagaagatgagtggagggagaaagagaaaaggagcacgaaattttatgcctcaaacgaggactga

SEQ ID NO: 51488 - DNA, 159 bp, Glycine max
  Peptide Sequence Number=SeqID_143173
atggctatgcaagattttgggcctgcgaggcgagtgcggactaatgtattaagtttgtgtaagagtgcgagacagagtggtccgtctgctaccattgtgggcttatgtcgggcgagacggcctgcttacccacacctaattttaaccgttgatggttaa

SEQ ID NO: 51489 - DNA, 920 bp, Glycine max
  Peptide Sequence Number=SeqID_143174
ctccgcgaattcttccagcggacaggatggcgccgaactcgcgcaccaagcctggcgtagtcggcgcggatcagggcggaatagcacatgggaactctgcaggcgcggttccgcgacgccgtgcccacggtcgaggactattgccagctgcgtgtgctggcgggcctcagtgccaagagccaggaggcggcggcacgcgcgctgcccaataccctgtatggcgtgtgcgcctaccagggcaacgagctggtggcgatggggcgcatcgtcggcgatgggggctgccacctgcaggtctgcgatatcgccgtgttgccgcgcctgcaggggcagggcctgggcaaggaagtgatgcgtcgcctggagggctggatgcaggcaaacctgccgccgtcggcatacgtcagccttctggcagatggctgaggccagccatgcgcggctcgggccttcccaggaatcacaggcaaagaaaaaccccggccgaagccggggttttaaagaattggcgtccccacggggattcgaaccccggtcgccaccgtgaaagggtgattggtggagccaagcgggatcgaaccgctgacctcctgcgtgccatgcaggcgctctcccagctgagctatggccccgtagtcatctgcaccaagctaatgcatcgtcttcttcaaggaatcaagcaattcgtgtgggagctcatcagcaggctgatgtcttcgattaaggaggtgatccagccgcaggttcccctacggctaccttgttacgacttcaccccagtcatgaatcacaccgtggtaaccgtcctcccgaaggttagactagctacttctggtgcaacccactcccatggtgtgacgggcggtgtgtacaaggcccgggaacgtattcaccgcgacattctgattcgcgattactag

SEQ ID NO: 51490 - DNA, 153 bp, Glycine max
  Peptide Sequence Number=SeqID_143175
atgactaaagcacgtcaaaagggggtatggaaagaaaaggaaggagatgcttgccacccagctcgcccaggcgagctaggttgcttcctccaaaagcaaccgccttctggaggaacatcctggaaggcccaagtgggcctggttgctatttga

SEQ ID NO: 51491 - DNA, 261 bp, Glycine max
  Peptide Sequence Number=SeqID_143176
atgaggaccctgtgcaattccagaagaaggcatcaaagggtaataattgccatttttgtgggaaatttggatacttctaggattgcccaaagtgtaaggcttggttcgaaaacaaagggatcccttacaattcaaaccataaatccaaatgagaagtttgtcttcatggggaacagagtgaaagcttcagtggaagcagttggaacttatcgtttaaaacttgacactgagcattatttagatttattgaaaactctttag

SEQ ID NO: 51492 - DNA, 447 bp, Glycine max
  Peptide Sequence Number=SeqID_143177
tccaacagggccctaggatttccctcgctgatcacaggactctgccagtcattcggagtccccgttgcacctaccaaggctcagggggatgctccacaggccgcaggcgcgccaccaccacctcatcaggctggccaggctggggcatttgacatggagcagtatttacggcatttggttcgccagcaggcggccaaccaccgagcacatgtacagacccatgattgtctgtaccagatgagccttagcatgcagagccagggcttcgcttctttttcatgccctactccagaccagttcagggcagaggtcgcatggcccggagattgtcccgaggcccaagcaggagaggcacccccagaagctcccggcggtggagaagaggcccacgaggacgaggagatggccgatttgcttgacttcttgggagggagtggagatacttga

SEQ ID NO: 51493 - DNA, 591 bp, Glycine max
  Peptide Sequence Number=SeqID_143178
atgaccaccgtcaccgccaacaacgtgctggaaggccaactgattggcgactggttggtgaaaaccgttgatggcaagccgtgtaacgtcgtggagctccagggcaccgtgggcgccagcgtcgctatcgatcgtaagaaaggcttcgccgaggcgattgccaaagcgtccaacatcaagattatccgctcgcagtccggcgacttcacccgcagtaaggggaaagaggtgatggagagctttatcaaagcggagaataacggcaagaacatctgcatggtctacgcccataacgatgacatggtcatcggcgcgattcaggccatcaaagaggccgggctgaagccgggcaaagatatcctcaccggttctatcgacggcgtgccggatatttataaagcgatgattgccggcgaggcgaatgccagcgtcgagctgacgccgaatatggccggtccggcgtttgatgcgctggaaaaatacaaaaaagacggcaccctgcctgagaagctgaccatcaccaaatcgaccctctacctgccggatacggcaaaagaagagttagagaagaagaaaaatatgggctactaa

SEQ ID NO: 51494 - DNA, 210 bp, Glycine max
  Peptide Sequence Number=SeqID_143179
atggaagttgctgatcccactcgcataactgctcgtacctgctcaggaagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 51495 - DNA, 150 bp, Glycine max
  Peptide Sequence Number=SeqID_143180
atgccttcgcttgttcgtttggcacggtcagcgcatgatataatgtttgttcatgcaaagcaatgggcaattccatatattagtagaatgcaggaatacacaagcttgatgtcattcaaaacacactatgtagacctaaatgaagactaa

SEQ ID NO: 51496 - DNA, 424 bp, Glycine max
  Peptide Sequence Number=SeqID_143181
gtcgactctagaggattccccccagcaaaaggccaggaaccgtaaaaaggccgcgttgctggcgactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 51497 - DNA, 1051 bp, Glycine max
  Peptide Sequence Number=SeqID_143182
atggattgggaccagctcttggctgggataggaggtagaacaatcagttggttcccccgatggaaggaaggaaaggagggagtccttttctcatgtggagggtacccaaacattctgttgataggaacgaggggttgtattaactacaatcccgcgctcgctataagacaactagggtaccccatgaggggagcaccgatggaagaaagcatgtctcctttcattgtgagagatttcagcacgcaaaatttcaaggctatacaaaggatccataaagcgtgggaaaccccgttaagaaaagataaagaaattaggggcattcgtaatggcattattggtggttatcatgaatggctgaaagttcatacacgaggtttagattggctcgccaagttaaaggttgtcagcgaagagagtttcgaagcaccggaagaggacgaagaagtccaagctctcaaaaacgagttaggaaaggtgagacttgccaaggagaagttcaagttagccgctacagacatccggaaagagtgtgccgggttacgtgaagagaatgcaactaccgcaagagcccttggacaagagaccaagaaggctcgcaaggaagagtatggtcgtaacaaatttcgcagagctttatggggtagcaacagtgaactcaagctgcgaagggaagaaagagaccagtcacgagcacatggcatggtcttgaaagaggagttagtggcctgttcaaggtccaaaagaaacttgtctcagcgtttgtgcgagacggagacctacatgctagctatcatcgccaagtaccaagaagagctaagtctagccatggcccatgagcatagggtcgcagacgagtatgcccaagtatacgcggagaaagaggctagaggaagggtgatcgactctttacaccaagaggcaaccatgtggatggaccggtttgctcttaccttgaacgggagtcaagaacttccccgattgctagccaaggccaaggcaatggcggacacctactccgcccccgaagaaatccacgggcttctcggctatt

SEQ ID NO: 51498 - DNA, 623 bp, Glycine max
  Peptide Sequence Number=SeqID_143183
atgctttacggcgtccttcaccgaactcgtgctagagctagagtaatgggtgaagcagaggaggtgcaagagaagatgaaggccgacatggaggccattaaagagaagatggccacaatgatggaggccatgatgagcgccaatgcggttgcaattgccgctaccagcgttgttgctaaggtgaacccgatgtccccatccggcatcaaccaaatgaatcatccaacctcagatatggtaggcaaagatttgggaagtacgggcggcccccatgatgtgcaaattcaaaacgagcatgccttcccgccatatggcttgcctctcaactatacgccacccaatgtggcgtacactcccaataagaatacacatgaaattccccatcacaatctagccgacttcgagccttggctcggacatgccactgaagggcaagaagttggtggtataccccttgaaaacactttggaaggccctcaggccattgaaggaggtgaagattattcctttgctaacctagaagagttgttcccaatacccaatatcatcacccctcccaagttcaaggtgctggactttgacaagtacaaggggactacttgccccaagaaccatctaaagat

SEQ ID NO: 51499 - DNA, 142 bp, Glycine max
  Peptide Sequence Number=SeqID_143184
atgaaggaaagcataggtcacatcttagacctcactcacataggagagaatagggaaagaaagcctcaagaggctaacattaaccttccatacttccatgggaaggacaacatagaggcttacttagattggaaaataaggg

SEQ ID NO: 51500 - DNA, 420 bp, Glycine max
  Peptide Sequence Number=SeqID_143185
atggtggcagctttcatggatgagattgatggggttcagattcactcctctagaatggatcacctcacttggagggctgaacctagtggatcctattccacaaagtcagcatacatatttctcatggaagatggcagttcagaatatgaagataatgcttccaggtttatgtggaatctaaaaattcctccaagagcagctgcattctcttggagaatttttaaagatagattgcctactaaggctaacttaagaaggaggcagaatttctctaatcaaacttttgatggtaacaagttaatggaggatgctatttttacactatggacatggctgaagaactttgacaaggactttgccttcacctacagctattggtcgtctaacatagcatcgggatttgtcttttcaggggggtag

SEQ ID NO: 51501 - DNA, 348 bp, Glycine max
  Peptide Sequence Number=SeqID_143186
atgtccaaccaaaagagcacagagtctgccataaagaatctggaggtccaagtgggacagcttgcaaagcaattggcggatagatcatcaagcaattttatagctaatgtagagaaaaattccaaggaggactgtaaagttgtgacgactagaagcagaatggcaatccatgtggatgagagtgaagctgagaagaagatggaggaacataaacaacagctggcacctaagccagcacttgaacctgtttctgattttgtagaacttgatgagattaatgaggaggctgaagatgataaggaagaagagacaccaataaaagagaaagaaaaagaaagaataaaataa

SEQ ID NO: 51502 - DNA, 249 bp, Glycine max
  Peptide Sequence Number=SeqID_143187
atggccctgaggaaacttgcctcaaagagatccaggaaagataaaacggccgaaggaactagttccgctcccgagtatgacagtcaccgctttaggagcgttgaacaccagcagcgcttcgaggccatcaagggatggtcatgggtgaggtccagacatagtcctcgaattttatgccaatgcttggcctacagaggagggcgtgcgagatatgaggtcttgcgtgaggtgtcagtggatcccgtttga

SEQ ID NO: 51503 - DNA, 162 bp, Glycine max
  Peptide Sequence Number=SeqID_143188
atggaatacttacttgttggtgatgaacaaaagcgcaaaacggaatcaaaaaatgcgaaaaaggatgaccctagggctgcaaattcgtcaatcccgtgggtatggcttttgaaagggggggaaaagaggtttttgaatgggtggctcgcccaggcgagctaa

SEQ ID NO: 51504 - DNA, 809 bp, Glycine max
  Peptide Sequence Number=SeqID_143189
gttctggtttacgttatgttcctgaaaatttggggaatttatgccacttgaagtatttaagcttccggtatacatggatagaaagtctaccaaaatccgttggtaagctccagaatttggagaccttggatataagagacacatatgtgtttgagattccagaggagattatgaagcttaaaaagctacgtcatcttctgagtaactatatatcttcaattcaatggaaggatattggaggcatggcatccctacaagagatacctccagtgattatagatgatgatggagtggtcattggagaggttggaaagctaaagcagttaagggaactgacagtgagagattttgagggaaaacacaaagagactctgtgttccttgataaatgagatgccactcttggagaaactacttattgatgcagctgattggtatgaagaaattgacttgtacattacgtcacctatgtctacacttaggaagcttgtcctatgggggacgtcaacaagagacaatgcttatgaaggtgaaactttgcattttcaatgtggagggtttcagaaactaaagcaactgaacctcggaagtttggatcaattgaagtgcatccttatcgacagaggagcactgtgttctgtggaagaaattgttttagaaggcctctcccaactcaaaacagttccctctggaattcaacacctggagaaacttaaagatctctatatcaactgcatgccaactgaatttgagcagcgcattgctcctgatggaggagaagaccactggatcatccaagatgtgccccgt

SEQ ID NO: 51505 - DNA, 432 bp, Glycine max
  Peptide Sequence Number=SeqID_143190
atggccctctctgtcatgtctgtgcatgaacaccaccttctccaagtcatcacccagatcttcatccagaagggcgttgatgttgaagtccttcctccatcagagagtgtttggagctcctgcgctctaacaaacttgaggagaatcacgtcagtcctgtcatccttcaagagagggacgccccagatggaaacgtcctctaattcctctttcaggagcttcttcagctcatcaatggaatttttctcggaatcaaaaaccctattgctatttggatctgcagttggtgtcaaagacaaggtctatcctgaaggaactcacttcttaattccgtggtttaagaggccggttatctatgatatccgtgcacgaccccatctagttgagagtacatctgggagtcgtgatctacagatggactttttgcattag

SEQ ID NO: 51506 - DNA, 117 bp, Glycine max
  Peptide Sequence Number=SeqID_143191
atgtgttttcgtgaagaaaatccaagccaaggtgcttccgtaatcgattctgtagaaattcttcatcgttcttcaccgttcttcgttcgttcttcttcgttcttcggtcttcaaccg

SEQ ID NO: 51507 - DNA, 360 bp, Glycine max
  Peptide Sequence Number=SeqID_143192
atgggtgaagtagaggaggtgcaagagcagatgaaagctgataaggaggccacgaaagagcaaatggccacaatgatggaggccatgatgagcatgaagaatataatggaagccaatgcggttacagttgccgttaccaacactgttgctaaggtgaacctgatgcccccatctgacctcaaccaaatgaatcatccaacctcagatacggtaggcaaagatttgggaaactttgacaagtacaaggggactgcttgccccaagaaccatctaaagatgtattgtcggaagatgggggcatacacaaaagatgagggaactgctaatacattttcttccaagaaaagtccactggggtag

SEQ ID NO: 51508 - DNA, 295 bp, Glycine max
  Peptide Sequence Number=SeqID_143193
atggcttcttctgcaatatacctttcaacaatagatgcttccggacaatgtagattcttggtatacccttttaagatattcatgtatctctcaaccgggtcatcaaacttgactggatcaaggactttgctacatatggcattgaagaaaaagcacaggcgagttatggctaacctgactttgttaggcaaaatgtctcgtatggccatggctaacaattgttgcatcaacactgcaaacactgacaaaaacttatcttctcctttctggacaaagtatgacaagctggaggcaa

SEQ ID NO: 51509 - DNA, 203 bp, Glycine max
  Peptide Sequence Number=SeqID_143194
gtgtagctaatttagatgatggggggtctacagatttgaggataaatcctcttcaagagggaggggatgatgcaatcctcccaaggaggggatccatcaccagagccatggctaggagactccaaaaagattggtacagggatgcaggagaaggccatagcattctcatgagccttagggtagattttgggcccatgggctaa

SEQ ID NO: 51510 - DNA, 431 bp, Glycine max
  Peptide Sequence Number=SeqID_143195
gggcaaggaaggacatagaaagtgcttattgggaattggttgtgaaggacatacaggatacttgcaaacttctggagccaatttacaatgaaacagatggggaagatggacatgtatctcttgcagtttccccaaagctagcaaatgacaccaaggggacaattgaggcagcaaaatggcttcataatatggttggaagtcccaataggctcatagtttgcgtatttgaacaactcatattctacctccctaaatatgaagcagtgattgatgcttacttggatggccttgagtcttgtggcatgactgatctctctaaggtttcaagtgcagcagcattctacatcagtagaatggatgttacacttgacaagaaacttgagcaaattggtactactgaggctcttgatctcaaaggaaaggtaatgtga

SEQ ID NO: 51511 - DNA, 189 bp, Glycine max
  Peptide Sequence Number=SeqID_143196
atgatggcacatcagagatgcttgccacccagctcgcccagacaaaggatcaagctgaaagttttgatgatgccaaaggattacatgatgatgatgccaaaggattacatgaatcatatgcttctcaaagatttactcaagacaaaacaattagagttaatcaagatggatgatcaagacagtctatag

SEQ ID NO: 51512 - DNA, 63 bp, Glycine max
  Peptide Sequence Number=SeqID_143197
aggattcctgaacacaagggaagggttgtccctgtgtgcatcattaatccgaaaagagagtga

SEQ ID NO: 51513 - DNA, 261 bp, Glycine max
  Peptide Sequence Number=SeqID_143198
atgttatatgttgaagaacggtcgagacttctagcagtaattacctcactccttggaaacgttccatggaaaccggcctggaggactcgcaaaaatgtccccagcagagtcgcccagactgacgcaacggttgctccttcgcgggcgagcgaaggcgaggctcacgggtgcgctttccaaaggaggaaagatgcggagtcgccaagccaacgtttatttgtggaaaacgtcgggaaaaccgaaggaaaccggtcaaaatga

SEQ ID NO: 51514 - DNA, 519 bp, Glycine max
  Peptide Sequence Number=SeqID_143199
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccttccaagtccaaacctaaacattcattcatcaagatcgacatcaccatccaagggtgtttccctcgctcctacgtatcctcaattgcaatga

SEQ ID NO: 51515 - DNA, 279 bp, Glycine max
  Peptide Sequence Number=SeqID_143200
atgtgcatcaccctgcgcctgcctaggcgtgcagtacttcttgatgaaggcccgggtgatcggcggtcggattactttactgggggtgacgggaactccaaaggactagcagaggcccatgatcagcgtcggaaaccccagggccctgttggacttatctgggtccagagggtgcctggtaggcgccatacttgcaaacaaataaatggcgttggcaatcacctgggccaacgtggacgctcatctgtgtcaggatggcatacaccaactggcacttag

SEQ ID NO: 51516 - DNA, 303 bp, Glycine max
  Peptide Sequence Number=SeqID_143201
atgcacacacaaagtttcacaattccacaatttgctaaaataggcctaactcacaaaaacagtctgcagtggagtcgccaactgtcgcaacctgcccttttgcgggcgagcgaggtggggctcacgggtgcgtgtcccaagaaaggaatacgcgcggagtcaccaccaacgtttatttgtggaaaacgtcgaaaaaaccgaaggaaaccggtcatgaagaatattccagattcgggagttgtatttacgtttgaggaatgtattagcacctctcacgtttgtcccaaaggacaacaaccttaa

SEQ ID NO: 51517 - DNA, 453 bp, Glycine max
  Peptide Sequence Number=SeqID_143202
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtgtttctgaatgcttgggaactggaaaatacttggagctgccctccatggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 51518 - DNA, 534 bp, Glycine max
  Peptide Sequence Number=SeqID_143203
atgccactcttggagaaactagctattggtgcagctgatgagagtgaagtaattgacttgtaccttatgtcacctatgtctacacttaggaagcttgtcctacgctccaagttgactaatgacgcattgaaatcactaaaagatatgccaaggttaatgttcctctgtttcgctcacaatgcttatgaaggtcaaactttgcattttgaacgtggatggtttcaaaaagtaaagacactgcacgtcatatgtttggataagttgaagtccatccttatcgacagaggagcactgtgttctttggaagaaattgttttacgagacctctcccaactcaaaacagtaccctctggaattcaacacttggagaagcttaaagatctctatattgtggacatgccaactggatttgagcagcgcattgctcctgatggaggacaagactactggatcatccaagatgtgccccatgtaggtatttggagcagggatgctgaagaacctttgcatatattcggcagaagtcatcactaa

SEQ ID NO: 51519 - DNA, 225 bp, Glycine max
  Peptide Sequence Number=SeqID_143204
atggcatatccgaggtgtctcccccatgggttgagagacatgtgcatgactagactggggttgttagatctcaataagtatgggagcagagtggtcgacattctcattgggcacatgtacaacattgggtggtgcattgttgggaggcaagccatatggtgggaaagggatgcttgctctggacctgcacaaaatgggggctgcccgtacttcccaatgctttaa

SEQ ID NO: 51520 - DNA, 252 bp, Glycine max
  Peptide Sequence Number=SeqID_143205
atggaggttgaggaaccctggcaggggttatggctactattgcattatcaagtagatatgggagcaagtaagcatatgacaccagaatttggggtgaatcctacaggctttttgctgcaaaattcctttttggattgcactataggtggtgtttgggcattgggcgtgtggaatgacagtcatagcaagggtttctccctcattttcatcctcttcattgccccagtttttgcattcatcaaagcaggatga

SEQ ID NO: 51521 - DNA, 438 bp, Glycine max
  Peptide Sequence Number=SeqID_143206
atgtcaagggctagaacaaagaagaccaaggaagctcttcaacaagtgttaaccatgctatctgaatttaggcccaacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 51522 - DNA, 540 bp, Glycine max
  Peptide Sequence Number=SeqID_143207
atggtggcacgtgttatgctcaggaacggatttgagcccggaatgggtctaggcaaggactgcctcaggaatgccgacgtggtcgatatcaagggaaatccatacaaatatggattagggtacgaacccaggatgccggggaagaggaacgtgccgtcaagatttcaggcggatagggtatggcccggccgaattagccagtgtttcaccagcgctggaatggtgtccgaggaggaggtggccgcgatagaagaggagttccctcaagacccaccaagttttgtgcaaccatgccaccccgattcccaagtggggaactggtgcatgataagccagtcagaagtctataccgccgattcaatatgtgagggtcgattctttaaggaacctaacaacgagggtttgacaatcaatttcgatcgagatataagccaaacgataaatgaggaagaggaagaggacgtcctgtcaccagagttggagaggctggtcgctcaggaagaacgtgaaatgaagcctcaccaagaagaaaccgaattg

SEQ ID NO: 51523 - DNA, 594 bp, Glycine max
  misc_feature (121)..(121): n is a, c, g, or t
  Peptide Sequence Number=SeqID_143208
atgcttattccccggataccgtcattgcttcttctccgggaaaagaagttcatgacccgtaggccttctaccttcacgcggcattgctccgagtctgggccgtgtctcagtcccagtgtgnctgatcatcctctcggaccagctactgatcatcgccttggtaagctattgcctcaccaactagctaatcagacgcgagcccctcctcgggcggattcctccttttgctcctcagcatacggggtattagcagccgtttccagctgttgttcccctcccaagggtaggttcttacgcgttactcacccgtccgccactggaaacaccacttcccgtccgacttgcatgtacaaagctgattcggaattctcttccattccaaggcataacttgtatccaggcgcttcatattcgactggagttcgctcccagaaatatagcccccccacccctcgtgtaatcccacgagcctcttatccattctcaattattattcgatcacggcatacaaatagaaaaacttacattgggtttagggataatcaggctcgaactgataacttccaccacgtcaaggtgacactctaccgctga

SEQ ID NO: 51524 - DNA, 609 bp, Glycine max
  Peptide Sequence Number=SeqID_143209
ccttggacggaatttaccgcccgattgggactgcattcccaaacaacccgacttcgccgacagcgcctcgtggtgcgacagggtccgggcacgacggggctctcagagtctctggcgcccccttccaggggacttgggcccggtccgccactgaggacgcttctccagactactattcggacgccgaggccgaccgattttcatggtgggcttttcccggtctcgttgggagcgtgcgtgcacgcaaaggctcgtcgatgggtccagaactgaccggctcgcacgtgattggtcttcgagcgtggctcatccaccattttatcacggcgaagtcgcccatgaacccagatttcaaccaaccacgaggcgggtgctcgccgggaggtcagcatacacccccgcccagcaacattgttacatgtttgcgtttggggaaacgatgtgtgacacccagtcaggcgtgccctcggcctaatggcttcgggcgcaacttgcgttcaaagactcgatggttcacgggattctgcaattcacaccaagtatcgcatttcgctacgttcttcatcgatgcaagagccgacgatactccgttgccgagagtcattgtat

SEQ ID NO: 51525 - DNA, 255 bp, Glycine max
  Peptide Sequence Number=SeqID_143210
atgaagatgctcttgataccacatgatgtaagctccattggagcttgtaagcctaggatcttcttcatcaatggattcctttgcttcttggaagataaatggcagcggaatggagaaggaagagataggagaagatgccacttcaaggagaagatgagtctagaagaagctcatcaccataggaggccatggataagagcttggaggaagaaggagatgaatgaagggagacaaagagaagagcatggaatttag

SEQ ID NO: 51526 - DNA, 918 bp, Glycine max
  Peptide Sequence Number=SeqID_143211
atggccaatcaaggagattgggtcccgtttatggatgtgttagctttgctaatttttggggtcgtcctctttccaaacgtagatggtttggtggacctagcagcaatcggcgctttccttgcgtaccaccatagcaaggaaagtccggtggtagctgtcttgagccatcgctcgtgtactgaaaagagaagaatagattggggccagcttttggctgggataagaggtagaacaatcaattggttcccccgatggaaggaaggaaaggagggagtccttttctcatgtggagggtacccaaacattccgctgataggaacgaggggttgtattaactacaatcccgcgctcgctataagacaactagggtaccccatgaggggagcaccgacggaagaaagcatgtctcctgtccttttaaaagtcgtcagtgaagagagttttgaagcaccggaagaggacgaagaagtccaagctctcaaaagcgagttaggaaaggcgaaacttgccaagaagaagttcaagttggccactacacacatccggaaggagtgtgccggattacgggaagagaatgcaactaccgcaagagcccttgaacaagagaccaagagggctcgcaaggaagagtatggccgtaacaaatttcgcggagctctgtggggtagcaacagtgaactcaagctgcgaagggaagagagggaccagtcgcgagcacatagcatggtcttgaaagaggagttagttgcctattcaaggtccaaaaggagcttgtctcagcatttatgcgagacggaggccaacatgctagctaacatcgccaagtaccaagaagagttaggtctagccacggcccacgagcatagggtcgcggacgagtatgcccaagtatacgtggaaaaagaggctagaggaagg

SEQ ID NO: 51527 - DNA, 618 bp, Glycine max
  Peptide Sequence Number=SeqID_143212
atggatgaaatagagaaggtgcaagagcagatgaaggccgacacggaggccttgaaagagaaaatggccacaatggtagaggccatgatgagcataaaggagatagtggaggtcagtgcagcttaccaaacccgtgctggagctagagtaatgggtgaagtagagaaggtgcaagagcagatgaagaccgacatggaggccacgaaagagcaaatggccacaatgatggaggccataataagcatgaaaaagataagggaagttgatacggttgcagttgccgctaccagcgctgttgctaaggtgaacccgatgcccccatctggcctcaaccaaatgaatcatccaacctcaaatatggtaggcaaagatttggaaagtacggacgaccccatgatgtgcaaattcaaaacaagcatgccttcccgccatatagcttgcctcccaatgtggcgtacactcccaatgaggatgtcaataactccgctcctatactcattgagagccaacaagcccaaaacagatcatgcacatgtctctcaaaccatgggggaggcacatgaaattcccaaacacaatctagccgacttcgagccttgcctcggatatgcccactga

SEQ ID NO: 51528 - DNA, 187 bp, Glycine max
  Peptide Sequence Number=SeqID_143213
atgactcatactcatgatgccctattatattacaacgagaggtggaacatgccatgccaaggtgactttgtgggttactcgttcatggaaaaaaatccaaaaatatttgacattccttcaggatgtagcatcgacggacacaaggatgtgatcaagcaagttgcacctcaagggatcccccctaatg

SEQ ID NO: 51529 - DNA, 515 bp, Glycine max
  Peptide Sequence Number=SeqID_143214
gaaacgatcctaagacgggtgactcagataggtacatcttgtacatcaaagcaaatcttgaccgcctggttgccctggggagagtttatgagggatccactgttgttcataacactcctttgttgcctggccaagtaaaggtgggtgtggaggaggttaaagatgcagatgctctagttcctgtacccactgatgaggtttccttagtggggcagacaattcacaccttccttgcgtggccgacacatctggtcaagtctttatcacaacaggcagttgtgtctctggcaaaaccacctcaaaagtcggattcggaggtcgatgatccgctttatctgatgacattgaccatcctagagcttttcttgaggccttacccagttacatgggatgccaccgtgttcagggtctttaatccagatttcccgctttacataaagcacgaagaccacttcgaaatcgcacacggtggtcaatgtctcagcatatcagtgttacagttatggattctgtaa

SEQ ID NO: 51530 - DNA, 267 bp, Glycine max
  Peptide Sequence Number=SeqID_143215
ctgtagctatgagtgcgacagaaggtctaatgagaggaatggaagtgattgacacaggagctgccctaagtgttccagtaggtggagcaactctaggacgaattttcaacgtgcttggagagcccattgataatttaggaataaaagtagtagatcttttagctccttatcgtcgtggaggaaaaataggacttttcggtggagctggagtgggtaaaacggtactgattatggaattgatcaataacattgccaaagctcatggag

SEQ ID NO: 51531 - DNA, 393 bp, Glycine max
  Peptide Sequence Number=SeqID_143216
gtttgtcacagcttagagggcaatgctggtgcactcacaaattttgaggtccttgatttctgtcgagctaaaggagcttcaaaggatccaacaagagttattgccaaagtagcgcagtctgaatacaaggttagatttgatttttctaataaatgggaatactttagaagttatgtagcttatcatgaaagagagtgtgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggtccaaatggaggaggactaa

SEQ ID NO: 51532 - DNA, 318 bp, Glycine max
  Peptide Sequence Number=SeqID_143217
atgggcattgaggaagatgaagagattcccttgatcctagggcgaccattcatgatgactaccaaatgcatggtggacatcgggaacggaaacttagagctgagcgtggatgatcagaaggaagatgttgaagatttaaagaaggacagtcctccagaaaatccaaagttggagttgaagaccctacccacgcacctgaagtatgcctttctagaggagaaggaagtcaagccgattgtgaacagcagtgacatatcatcaaaagaggaagctcagttgatggaaattctcaggaagcacaaggaggctattgggtga

SEQ ID NO: 51533 - DNA, 531 bp, Glycine max
  Peptide Sequence Number=SeqID_143218
atgttgtatcttgtattcttgaatcattgtcttgactttagagggctacacgtcctcgccttaagagggttgcacatcctcaccttcagaagattacaggtcctctcctttaaaaggctgcacaccctcgcctttagaggactggatgtcctcaccttcagaggagtacatgtcctcgactttagagggctacacgtcctcgccttaagcaggctgcacgttctccccttaagagggctgcacgtcctcgccttaaaagggttgcacgtcctcgccttcagaggactacacatcctcggcttcagagggctgcatgcccttgccttcagaggactgcacgtcctcgccttcagagggcttcacgtcctcgcctttaaaggactgcacatccttccctatagagggctgcatgtcctcgcattcagagggttgcatgcccatgccttcagaggactgcatgtccacgcctttagagggcttcacgtcctcgccattagaggattgcacgtccttccctttagaggactgcac

SEQ ID NO: 51534 - DNA, 369 bp, Glycine max
  Peptide Sequence Number=SeqID_143219
atggttcttatcttgaggagcctacactcagattttgatcatgtgcgtgatcaaattcttgttggagaccaagttccgtcaatggactctctcatcactagacttctttgtgtgcctcatgcattgaaagatgaaaatgtagctgacattgtggaaacatcagccatgattgcacctcgtggaagaggaggccgtaacaatagaggaggccgcagtggaagaggtggacgtcctcaatgcatctattgcaagaggatgggccacactcaagaaaattgttattctttgcatggtttccctgacaaagtaacacaagtgtctaagtcagacaaatcagagtctagattctctgatgagaagtaccaatag

SEQ ID NO: 51535 - DNA, 177 bp, Glycine max
  Peptide Sequence Number=SeqID_143220
tcaggcgccttcgcttataaagaggttctatcaagtcaaggtcaagagcctaggaaccaccagtctgaaaaagttagggcagttgatgggtcagctccagtctccacagaggccattgcctccctcgcccagtattatgaccagccgttgaggtgcttcacctttgaggacttctag

SEQ ID NO: 51536 - DNA, 279 bp, Glycine max
  Peptide Sequence Number=SeqID_143221
atggcggcacagctaatccatgatcgagtggagatggagtgcctagaggaagcttgggagaccctcgaaggcaacacgaggtgccgatttcggggcaccattcgattcacggctacttctttggtgcatccagatgaacctgcacggacgcttcagcgcacggtggagtggacagctccttggattagttttgtatattttttagggtgggtgtatctaggactgactgttaggagcagaatcgtcttaggtagtggtcaaatgtcgggacgggtctaa

SEQ ID NO: 51537 - DNA, 921 bp, Glycine max
  Peptide Sequence Number=SeqID_143222
atgctatgctatgcgaattcatcaatactcattgtatgtaagcgtttctctgaagaactcgctaaacgcccttaccgcgctaagcgagttcatcttttgaggatgaacactcatcctcttgctgaactacctatggcctctaagaaacgtatgagtattgattctaggccacaggatcagaattataacaggagatttcaatcagaggaagcctggaaccgatatatcgataatattttagaccgaaggatccttccagaaaggaatgtgaaactttatcattctgagttcgacgagtttaaagtaaaattggagaggcgaaaccttcacaaacacctcgccaaccttcaggaaggaagcatagatgtggcagtggttaaagaattctatgccaatttctatagtccagcaaatcaagctcctaaatgtgctagaatacgaggccatttaatcaggatagatgcagacagcttaaatgagttcctccagactccagtgttattagaggaggggaaatctttacccacttattctagattttgcagattaaggtctgatcccaaagagatggaggctagtctgtgcattccgggaaagggctttattctaaatacagagggccaaccatggaaactcctcagaaatgatcttaccaccctggctcagacatggagtgtcttctcgtactcaaacctagcttctacctctcgcacttcatatttgaacacagacagagctaggttggtctatggcttaatcacaaggatggacatgaacattggcggtttgatctctggacaaatgaccatgatggctcagtctaactcttctcgcttaggcttcccaactttaatcacaaccttgtgtagatcgatgtgggttggatcagatgctcttacctcctatgaaaacctaaggccg

SEQ ID NO: 51538 - DNA, 1249 bp, Glycine max
  Peptide Sequence Number=SeqID_143223
cagcgcatgctggagatcctgcagttcaagctggacattctgtggagcatgctggacgccatgagcatggcctataccctgaaccgcccgccttaccacagcgtgaccaccgcgcgggtatggcacaaccagaggctggtgtaatgacgctgaaccctgaacacacccccgtcttccgtcgcggctaccgcctgcaatgggagcaagtgcaaaacagccacgtgatcctctacccggaaggcatggccaagctgaacgacagcgccgccgccatcttgcagctggtcgacggccacaccacgctgaacggcatcatcgcccagttgaacgcccgcttccccggcgccgaagggctggcggaagacgtgctggagtttttccagcgcgcctacgaacaaaaatggtgtccgtattgctccaacccgctcgatttcgccgcgcaggaaaaagagctgaccaccgcgcagtggatcgaggtgtttcgccaggcgcgggcgatgggcagtgtgcagctcggtttttccggcggcgagccgctggtgcgtaaagacctgcccgagctgatcgccgccgcgcgcgcgctcggcttttacaccaacctgatcacctccggcatcggcctgaccgagaagaagctgcagaccttcgccgacgccgggctggatcatatccagatcagttttcaggccagcgatgaaacgctgaacgccgcgctggcgggctccgccaaggcgtttcagcagaagctggccatggctaaggcggtcaaggcgctcggctatccgatggtgctcaacttcgtgctgcatcgccataatatcggccagatcgaccgcattatcgaactggcgatccagctggacgccgacgacgtcgagctggcgacctgccagttctacggctgggcgcacctcaaccgcgagggcctgctgccgacccgcgagcagatcgccgacgcggaagcggtggtgaaacgctaccgcgaacgcatggtcaccgacggcaagctggccaacctgctgttcgtcacgccggactactacgaggagcgccccaaaggctgcatgggcggctggggcgccatcttcatgagcgtgacgccggaaggcatggcgttaccctgtcacagcgcccgtcagttaccgatcgccttcccgtcggtgctggagcacgatctgcagcatatctggtaccactcgttcggctttaaccgctatcgcggctatgactggatgccgggagccgtgcc

SEQ ID NO: 51539 - DNA, 148 bp, Glycine max
  Peptide Sequence Number=SeqID_143224
gagcataatcgtcttaggcaatggtcaaatgccaggcctgatccaaaggcggagaccggtcaaggtaaatggtaacatggccacagttagccgcgcaatgtcgttccctgctttcaggtgcttagggacggatgcaagtagaagctag

SEQ ID NO: 51540 - DNA, 492 bp, Glycine max
  Peptide Sequence Number=SeqID_143225
atgtggaccaccacagctttcgaagaagttacggaaactcacggattgcgcaaaaacacctcttttcgatttccgccacattacggaatttcacggatcgcgcaaacctgcttctttttgatttctgacacgtctcgggacttcatttattatgcaacatcgaattcctgcagcccgggggatccactagttctagagcggccgccaccgcgggggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtgggtggttacgcgcagcgtgaccgctacacttgccagcgctga

SEQ ID NO: 51541 - DNA, 126 bp, Glycine max
  Peptide Sequence Number=SeqID_143226
atggcacagaattccacagcacaccacaacgcctattttgggaaaaaaactctggaagcagtaagaggagcagcttttgcagagatgcctaggtttttgcttaaattttgtatgctcttggtctaa

SEQ ID NO: 51542 - DNA, 420 bp, Glycine max
  Peptide Sequence Number=SeqID_143227
atgcaatcctacataggattggcactgcaaactgggtacccaccaatcatacttccactgttgccacagagagaatctgctctgtccctgcattacaaactgtttgaggggacacatgtcccagacattgtctcgacatcagggaaagctgctgcttcaggtgctgtgtccaaggatgctttgattgctgaactcaaggacacatgcaaggtgctagaagcaaccatcaaagccaccacagagaagaaaatggagctggaacgcttgatcaaaagactctcagacagtggcattgatgatggtgaagcagctgaggaagaagaaaaagcagctgaggaagaagaagatgcagctgaggaagaggaagatgcagcagaagatactgaatcagatgatgatgattctgaagccaccccatga

SEQ ID NO: 51543 - DNA, 204 bp, Glycine max
  Peptide Sequence Number=SeqID_143228
atgcggaaattgattaaggaaaggatggaaaataaggtggataatttcgtgggtcttaataaggtggtttctggcataaaatggatgaatgagatgggtaaaacaacaagggtgaagatgaaaggaaggaaagaatcactctttccagcgagggcaacacacaaaggttgtgaaagtcctttgatacagccaaggtgttcttga

SEQ ID NO: 51544 - DNA, 207 bp, Glycine max
  Peptide Sequence Number=SeqID_143229
atgggggtgcaaatagcaaccagacccgcttgggccctccagaagattcctccagaaggcggttgcttctggaggaagccaccttgctcgcctggggggagaagtgaagtagaaaagggttcagcactcctggtaattcagaatcacttaaaattagtgagaaaaattggttccgtgaagaaaatccaagcagaggcgcttccgtaa

SEQ ID NO: 51545 - DNA, 819 bp, Glycine max
  Peptide Sequence Number=SeqID_143230
cagaagctcctggctgagaagaccaagaagaagctgcaggaatctgcacagtcaggaagcgttgatggcatcatcgaccctccatccccgggatcgttcgtcccccatggacgtcaggatgttttggccgctgctattggacgtccagagcaccctggacgtgtccgtgctactggagccggtgtcactatcatgcaatactttggatcggctccacggacgtcccgcaacgcttcctccctgcctcctgacgaattacagcagctgacccagcagatcagggaccagctagaggagtccatcatagagaaagtgacgaagcaggcacttgcagtgcctcctgagcctttggttggtcttggtccctccggtcctcgagtgagcacaaaggggagttgtgttgatccctcaggaaacgatcccgagacgagtgactttgacaggtgcggcttgtacatagaagcagatcctgcccgcctggttgccatggggagagtttgtgagggatccactcttgttcataacactcctttgttgtctggccaagtaaaggtgagtgtggacgaggttaaagatgcagatgctccagttcctgtacccactgatgaggtttccttagtggggcagacacttcacaccttccttgcttggtcgacacatctggtcaagtctttatcacagcatgtagctgtgtctccgccaaacccacctctgaagcccgatccggaggtcgatgatctgctttatctgatgacattgaccatcccagagcttttcttgaggctttatcaggttagatgggatgctaccgtgttcggg

SEQ ID NO: 51546 - DNA, 715 bp, Glycine max
  Peptide Sequence Number=SeqID_143231
atgaccggccctctcgatgagtcgatctctttatttctcataagggtggacccttgggtactagtacctatcttcttcaaagggctacatgtcctcgccattagaggactacaagtcctcaccttcagaggattacaagtcctcaccttcagaggactgcacgtcctcgccttcagaggactgcacgtcctcgccatcagaaggctgcacgtcctcgtcatcagagggctgcacgtcctgaccttcagaggactgcacgtcctcaccttcagaggactgcccgtcctcaccttcagagggttgcacgccctcaccttcagagggtcatgtatcttcaccttcagaggactacacgtcctcacctccagaggactacatgtcctcgcctttagaggactacacatcctcgccttcagagggctacacgccttagccttcagaggactacatgtcctcaccttcagaggactacacgtcctcgccatcagaggactacacgttcccaccttcagggggctacacgtcctcgccttcaaagggctggatgccctcaccttcagaggactacctgtcctcgccttcaaagggctacacgctctaatcttcaaaggggctacacgccctcaccttcaaagggctacacgccctcatcttcaaagggctacacgccctcaccttcagaggaccagacgttctcgccttgagaggactacat

SEQ ID NO: 51547 - DNA, 222 bp, Glycine max
  Peptide Sequence Number=SeqID_143232
atggtgattttccaccatggagatgcagcggaagacaaaggagaagaggtagcttccttgagaagctttcttaagaaaacttccttgagaagcttctttgagaaaacttccttgagaagccagagcttagctacacacacccacctaaaaactaagctcacctccttgagaagcttccttgagaagctagagcttagcaacacacacccatctaaaaactaa

SEQ ID NO: 51548 - DNA, 300 bp, Glycine max
  Peptide Sequence Number=SeqID_143233
ggcccatctaactggttggcaccaatacagttttcggccacattccgtgtttccaagaacatcattgaggttccattgtcttaccatagacaatggaggccatattacccgacgcttcgcaaatatggcagccgatacttcttttttgatgggctaaaacaatttagaagaactcatggcattgacgatagcgtcatcatgcgcttttttgctgctgacaaaaatacttccttcgaggtggatgtcattggacctatccttagacagggtcgtccaaggtcggttctggcaactaggtga

SEQ ID NO: 51549 - DNA, 228 bp, Glycine max
  Peptide Sequence Number=SeqID_143234
atgagggttcataccattacgcccacaaagctcatccagcctcccactaacaggtctttcattgagaagtattgcatgccaagacaggcacaacagctgaggcaggaccagcaacagcagtcaatcgcagatgcaccgtcaccacctctacagcagccaccatctctagcatccatctcaactcacatgcagaggatggaactctacatgcaatatttggctgactag

SEQ ID NO: 51550 - DNA, 375 bp, Glycine max
  Peptide Sequence Number=SeqID_143235
atgattagaggcaatccatctgacttacaaccctttgatcctgagatagataggacatttcgtagattagttaggcatcattttgtaccttttgagcatcctgagcattctgttattggtgagtctgagcattctgtggttggtaattttgaacaacctgattttgagcattatagttttgaacattctgagaacatggcacaacctccaccccgtgagaggactctaagggaaatggctgcacctgatttcacctacgaaagcttgtacatccaataccctgatgaggatgtcccatatgttcttaaaactggattgatccatttgcttccaaagtttcatggcctagcaagtgagacccacacaaacatctga

SEQ ID NO: 51551 - DNA, 652 bp, Glycine max
  misc_feature (443)..(443): n is a, c, g, or t
  misc_feature (536)..(536): n is a, c, g, or t
  Peptide Sequence Number=SeqID_143236
atggcatccttcagccagatgcagtcccagcttcagtcgcagatgcaatctcagggacttgcagtgcctcctgaccctttggttggtcccttcggtcctcgagtgagcacaaaggggagttgtgttgatccctcaggaaacgatcccgagacgggtgactctgacaggtgcggcttgtacatagaagcagatcctgcccgcctggttgccatggggagagtttatgagggatccactgttgttcataacacttatttgttgtctggccaagtaaaggtgagtgtggaggaggttacaaatgcagatgctctagttcctgtacccactgatgaggtttccttagtggggcagacacttcacaccttccttgcttggccgacacatctggtagctgtgtctacaccaaaaccacctttgaagcccgatccggaggcccttatcanggttagatgggatgccaccgtgttcggggtcgttaatccagatttccccttgtatataaagcacgaagacatctctgaaatcgcacacggtgncaatgtctcagcatatcagtgtacagttgtggattctgtaagcatctcactgaaacatgtatgcgagcggggaattctgatatctatggattcctcgaagcctcagtccatcagag

SEQ ID NO: 51552 - DNA, 564 bp, Glycine max
  Peptide Sequence Number=SeqID_143237
atgcggttgcaattgccgctaccagcacctgttgctaaggcaaagatttgggaagcacgggccggcccccattatgcgcaaagtcaaaacaggcaggccttcccaccatatggcttgcctcccaactatacaccacccaatgtagcgtacactcccagtgagaatgtcaacaactccactcccatactcattgagagcgggcaaccccaaactgatcatgcacatgtctctcaacccatgggtgagacacatgaaatgccccaccacaatctagtcgacttcgagccttgcctcgaatatgccactgaagggcaggcaattggtggtatacccctacaaaaccctttggagggccctcagtatcacccccagctacacctcttgcattacacaacaagtaaaaaccctcatgctatggcagaaatgggaaagttggatcatctagaggaaaggcttagggccattgaaggaggtgaagattatgcctttgctaacctaggagagttgttcctagtacccaatatcatcacccctcccaagttcaaggtgctggactttgaccaa

SEQ ID NO: 51553 - DNA, 127 bp, Glycine max
  Peptide Sequence Number=SeqID_143238
atggcagatgcgcttgccactttagcgtccatgttccagctaacaccgcacggggacctaccgtacattgagttctggtgtcgtggcaaaccctcacattgttgtagggtggaagaggaacaggacg

SEQ ID NO: 51554 - DNA, 207 bp, Glycine max
  Peptide Sequence Number=SeqID_143239
atgatgctctcctacaacctaagacaaggtagatggagattacaatttataggctcagggttcaagtcaatcaatcaaactttcagctcaacatgggtgcaagggataattcattcatgcacaagaaaaataaatgaaaatcctgtcaacaatcatcttgagcagcagtgggctcgtcatgagctggtgcaggcttgccatgggtga

SEQ ID NO: 51555 - DNA, 393 bp, Glycine max
  Peptide Sequence Number=SeqID_143240
atgaaggccgacacaaaggccttgaaagagcaaatggccacattgatggaggccatgatgagcataaaggagataatggaggtcaatgtggctgcaatagccgctaccagcaccattgctgagcacgccttcccgtcatatggcttgcctcccaactatacaccacccaatgtggcgtacactcttgctgaggatacacatgaaattccccaccacaatctagctgacttcgagccttgcctcagatatgccactgaagggcaagcagttggtggtatacccctgcaaaacactttggagggccctcaattctgcccccaaccacaacccttgcattccacagcaggcttagggtcgttgaaggaggcagagattatgcctttattgaagtag

SEQ ID NO: 51556 - DNA, 210 bp, Glycine max
  Peptide Sequence Number=SeqID_143241
atgggggtacaaatagcaattaggcccacttgggccttccagattcttcctccagaaggttgttgcttctggaggaagcaacctggctcgcctggaaaatccaagccgaggcgcttccgtaacgtttccgtgagtaattacgcgaagattctcgaccgttcttcaacattcatcgttcgttcttcgttttcttcaatcttcaacgggtaa

SEQ ID NO: 51557 - DNA, 444 bp, Glycine max
  Peptide Sequence Number=SeqID_143242
atggacatgaacattggcggtttgatctctggacagataaccatgatggctcagtccaactcttctcgcctaggcttcccagctttaatcacaaccttgtgtaggtcgaggggagttggatctgatgctcttacttcttacgagagtttgaggccgatcattaacttggcctatattacaaggaactgttggaatgtgaatgaccaatcaattaattttctaggggcaaggaagaccaagcttagagcagctgatgttccctcttcctctgcaccaatagtttgcatcccttcatcttctactccagctccacctccaggatcagtcgacccatctgcccagagctcccagactttagatgctaggttgcagagcttgtttaaaggacaaattctcattatgcgtagcttgcaagaattggcccagcaaaggccaatcatgagt

SEQ ID NO: 51558 - DNA, 294 bp, Glycine max
  Peptide Sequence Number=SeqID_143243
atgactaaagcacgtcaaaagggggtacggaaagaaaatgggggagaagcttgccacccagctcgcccaggcgagctaggttgcttcctccagaagcaaccgccttctggaggaattttttggaaggccaaagtgggcctgggcatgtcacggaacttcacggattgtgctacaatgccttgttttgacttctggcatgtcacgaaacttcacgaatcgcctaacgatgggtgccaagtacctcgaagaggtcaaacgagggtcgcatcccaacaacggatgatccccggatga

SEQ ID NO: 51559 - DNA, 489 bp, Glycine max
  Peptide Sequence Number=SeqID_143244
atgtggcttctgccttctgtccattctgttctgcactttgttgaactgctttccaaggagcacaactgcattagtcagaccttcatcagtatccaggtcatactcatcttcttctccttcatcattggacacgaaacagattcttgctcttcttttcagccctatccgagagtcctagctcaaagtgactttcatgtcaaatctcttaggcaaggatctgaggatctttctcaccagcttttcatctgttatcctctctcccaaggcagtgcaagcattggcaatttcaagaatgttcatgtggaagtcatgaatacactcttcctccttcatcttcagattttcgaattttgtagccaagagttgcaatctggaaatcttcactttggaggttccttcatgagtgattttcaggatctcccatgcatctttggccactgtgcaagtgttgatcagtctgaagatgttcttgtcaactccattgaatag

SEQ ID NO: 51560 - DNA, 201 bp, Glycine max
  Peptide Sequence Number=SeqID_143245
atggacgaagatcaatggatgtatgacagtataatgtctgaagaagttgatatagattatcaaaatgaagaagaatgtggtgtgaatgaaccacatgttgattgttcggatgcgttcaataattctcaggtgtttgactgccgagatgatgttttgcagtgggctcgatctgttgctcatgaaacggatttgtggcaatga

SEQ ID NO: 51561 - DNA, 249 bp, Glycine max
  Peptide Sequence Number=SeqID_143246
atgaactcactaagtgagcatgttgcactaagagagttcatccatactcattgtatgcaagcagtatctgaagaactcgctaagtgcatttactgcattaaacgagttcaacttttgaggatgaacactcatcctcttcctgaactacttgtggctaagcaagagttggtgccgctaagcgtagcctttaaggagcttagtgcaaatccttgcggcacatgttcaactcagtgggcgctttcctgctaa

SEQ ID NO: 51562 - DNA, 486 bp, Glycine max
  Peptide Sequence Number=SeqID_143247
atgtcagttctggaattgtacatagaaaaggatgtggctggtggttttatgtttcattctgcaaattttgttgcatcatttggaaataatttatctaataatgagcgagaagcgccaagaaatgtaagcaatttacatggtgatgaagaagatgatgatgatgatgatgactatcttgtgtctaactcatacattgaagagtctttagacgaagatgatagtgttgacggtatatctgatacagacaatgaagtcatcgacatgattcaaccagtaagaattgttcaccccacagaaggtgtagaaggaattcaaaatccattttggaatgatgctttgcattataataatatcaatcctgatggggaggacatttgcggtttggagatgccatcaaattttaatgttgggcaagaattatatgttggcatgaattttgatagtaaagacgcggtcaaaaatgcactgaaacaatatgttatgaag

SEQ ID NO: 51563 - DNA, 180 bp, Glycine max
  Peptide Sequence Number=SeqID_143248
atggctgaaaagggaaagttggatcatatagaggaaatgctcaaggacattgaaggaggtgaagattatgcctttgctaacctagaagagttgttcctagtacctgaacgtggtcattcccaactgttacctggtacactaacttggaaccttcccgagtccattcttggaaggacctaa

SEQ ID NO: 51564 - DNA, 303 bp, Glycine max
  Peptide Sequence Number=SeqID_143249
atgtggtaccatatcaatgaaaaacctcgtcgggcacctagggggagactagtcaaggtcacagtgttttgcgagaatgctccaaccatatgggatcaacataggcttaaaggagcactcaaatcgtgtaacccccaaggcctacactccgaagagtctgtcagggcctctccctccttattcagggacttaacattaactcgtcgcccaaaaagggacttagcatcaactcgtcgccctaaaatggacttagcatcaactcgtcgccgtaaaagggacttagcattaactcgtcgcccttga

SEQ ID NO: 51565 - DNA, 228 bp, Glycine max
  Peptide Sequence Number=SeqID_143250
atgagaattgttgaaattggaaatgcaaggttcattgaaaatggtgaaataaatgggagtatagtaccacggaatgtggaaagtaaaaaagttagagtgaaagttcctttaacttgtgcctctgatagtaaagtgagtgttcctctagatgttgttccaaacaacaacaaagaagagaaacacgataatgagcccatgattcaaaatgaacctattgtagaagaatga

SEQ ID NO: 51566 - DNA, 687 bp, Glycine max
  Peptide Sequence Number=SeqID_143251
atgtttgccttcacatctcccggtatcaaatttgacaaatcctataacactggaaaaggacctccaactttccgtatacatgtacaaacacatcatcttattggaagcctcatccctatgcctaataacccacctaagtttgcacaactatatatttatgatacagacaatgagatcatcaacataatttcacaaaacccattagtattcatacttatgtcacacatgatgcatgatatgcttgatgaacaaattatcattgcaatcaaagacatgcttgatcatcacaatcactatgctcaaaggtttcgaatggcaagggacaaattacattctactgcagttccagacctaaagatgaaactcattagtcaaagacaaacagacggaaggttgtataacttaccaactaccactaaagttgttgccttgattgttggtgatgaacactcagctgataaaagagatattataatagaaaaacaatccggacttctgaagagaatacatgaacttcatcctgcatatttgcctttgcaacatccacttttatacccaaaaggagaagatggttacagactaaatacacctcaagaacgagtcacattgcacgaatatttttgttaccgcctacagtcaagaacgaatgaagcacaaactatacttcattccagaagattattttag

SEQ ID NO: 51567 - DNA, 280 bp, Glycine max
  Peptide Sequence Number=SeqID_143252
gaagcggaagagcgcccaatacgcaaaccgcctctccccgcgcgttggccgattcattaatgcagctggcacgacagcggataacaatttcacacaggaaacagctatgaccatgattacgaattcgagctcggtaccgagtagggggggtcatccagtttggttcctcatcttctccgaccaaaatttcctcagcatctatggtgggggtttggagcgtctcccagatgatggtcttgaggtgctcgacctttttggtgctggccagcttggagagtag

SEQ ID NO: 51568 - DNA, 255 bp, Glycine max
  Peptide Sequence Number=SeqID_143253
atgaagtttccgaaaaaacctgatagtggaggaagacctctaaggataagagacatagggctaaagagagagccaaataaggatctttcgtgtataatcctgcataatctcgaatgttatcagttccgctactttcgaagtaacagaaagaaaagcaacgactggagtgggagagtcagagtcgaaaagaggattcctcacttctttctctcattcaaaaccgtgcatgagactttcatctcgcacggctcctaa

SEQ ID NO: 51569 - DNA, 351 bp, Glycine max
  Peptide Sequence Number=SeqID_143254
atggcatcgttcagccagatgcagtcccaatttcagtcccagatgcaatctcagggacttgcactgcctccggagcctctggttggtccctcaggtcctaaagtaagcacaaatgggagttgtgttgatccctcaggaaacgatcctgagacgggtgacttagattggtgcggcttgtacatcgaagaaaatcctgccctctcggttgccctggggagagtttatgtgggatccactgttgttcataacactcctttgttgcctggccaagtaaaggtgggtgtggaggaggttaaaaatccagatgctctagttcctatacccactaatgaggtttccttagtggggtag

SEQ ID NO: 51570 - DNA, 517 bp, Glycine max
  Peptide Sequence Number=SeqID_143255
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatgattgtgaaggaatggagaccaatgtttaggatgttaatccacccactgaacggccagtggaaccgtgatccatggtttaaggatgatgattgtgacagtgatgcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 51571 - DNA, 741 bp, Glycine max
  Peptide Sequence Number=SeqID_143256
atggactccacatcctcgcctttagatggatacatgtcctcgccttcagaggactgcacgtcattgcctttagaggactgcatgtcctcaccttcagagggatgcacgccctcaccttcaaaggactacacgtcctcgccttcagagggctacacgtcctctgtatcggagggatccacatttgcgccttcagaggacttaaggatcacgcccacaagacacccagtggacccagagaagtccaacagggccctggggtttccagctccgattatgggcctctgtcagtcctaccgggtgcccgtccccccagcaaggtcactccatcatgacataaggatcgcgcccacaagacacccagtggacccagagaagtccaacagggtcctggggtttctagctctgattacgggcctttttcagttctacagagtgcacgccgcccctatcaaggtcatcaggccctctattaaccgggctttcatcaagaagtattgcgccccccaggcaagcacagggggagacaccacagcagcctggggatggccggcaacggacaatagacgcaccaccgccacctccagagcccctcagctcatctacaaaggctggagcgttgcctacgacccatggccgaccagcaggcaaccaagtccaaagccaaaggtaagcaaaagtactaggtccgtgaccgacaagtcatcacgcgtccagctcaagacgttaaagaagcgctactag

SEQ ID NO: 51572 - DNA, 171 bp, Glycine max
  Peptide Sequence Number=SeqID_143257
atgggggtgcaaatagcacccaggcccacttgggccctccagaagattcctccaaaagccgaggcgcttccgaaacgtttccgtaacgttttccgtgaagaattttgcaaaggtttcaaccgttcttcgacgttcttcattcgttcttcatcgttcttcgatcttcaacgg

SEQ ID NO: 51573 - DNA, 540 bp, Glycine max
  Peptide Sequence Number=SeqID_143258
atgcacagagaaaagaggtgcaaattgggaccaactcttagcaaaacagaaggagtgtctatcaactggttccctcgatggaaagaagggaaagtcggagttcttatttcgtgcggaggatttccgaatgttcccttgacggggacgaggggttgcatcagttacaatctcgttcttgctataagacaacttggctaccctatgagaggggcaccactagaggaagagctcgcgcctgtcatttcacgaggtttcaataagaccaacatggagacacttcagaaggtccgcaaggcatgggaggtagtgcgagagaaggacaaagaacttaggggcggtaacaacgggcccatcggtggctaccgtaagtggttgagagcccacgtgcaaggtttggattggctcccaagtttgagaaacgctaaaagggaggaagttgaggcaccggaggaagacgaagaggtgcaggcccttaggacaaaactcgagcaagcccaaacagtcaaagaaaggttcaaatcgacagctcttaaaatctga

SEQ ID NO: 51574 - DNA, 781 bp, Glycine max
  Peptide Sequence Number=SeqID_143259
gggaaggaagacccagttaaggagatttttccagaggtgtcgcaatgggtatcgggtgcatcagattacactataggaaatgcatctgcatctgattatgtggaccttgaatcaactgaaacatggcttgcggattactttaatgatgctgtgatggatttcagtcctgaggaattgaatttttcagtggcagacggtgttcaaattgatgatggtacagaggttagtgccatcacaccatcacatgaacaaaatgtggttcaacaaacgcatgtccctcgaaccacttgtaatattatcttcaaaggccaatgtgggttggcacaagtggtcaaggatccagagttaattctcatcctttccatggacgtgcatttgatttcctctaatgccactgaaatcctgttgggttggataaccatcatcacccttagcacccaagggctagcggagtcattgggacttgataaaactatttatggtttagacttatctaataatcatttgggtaggaaatcttttatacatatgccgacgaagttggcttcttctgtggcctatccatttgccttcattaaaccaagtggtgctcatggagatgtaactctgaaggaaataaatcagcgcattcaaacaccatctccttcgaaatcaaaccaaagcattgatgatgatccatctgcttaccccaagtcagccttctctgggaagcctgtggttggtaaaacaaaaattcgcactgaaggtggaaaaggtagcataacaattaccagaactaaag

SEQ ID NO: 51575 - DNA, 600 bp, Glycine max
  Peptide Sequence Number=SeqID_143260
atgggcagaaacattctcgactctttgttcttaaacattcactttcatggccttgacatgaaagaagggtcaattccagcggctttaatctataggatccagtacaaggtcatgaacacttgtgcctctagagtcctgttacagccacaaaagggggaaacaaccttgtttattaccgatatgacaaaagccaacgtctccttaaaaagaataataaaatgggatgaagtaactctccccgaaaaatgggtcatggagaaggccacaccgtctgatccccgacccgctccaattatcgaagacattaaacaagataactccgaaaaggtagaaataaccttcaataggagaaattccttctcatcaaggatagaagcctctaggtttgaatacgagtcagccagaaggtctttttcggttagaacccgttcaatcccagtaggactagccagatctgagttacataaccagttccctactataaacctccaaggaatagataccacttctagcataccaagaacaacttacaaccaagatcaggaggacgaccaaaagtcgatccaatccccaacatactcttctatggaaccttatgat

SEQ ID NO: 51576 - DNA, 390 bp, Glycine max
  Peptide Sequence Number=SeqID_143261
gatattgcttttgaaaaggatcactatgaagctcaaccctctagctcaagtgacagattgagtgtcattcacacccctcaagtacaaacaagtgttagacaaccaatgattgaaaatccacaaattattggaaacaattatacagatcaagttattgatgaggaatatcaagataatgttgaacaaccagttgagcaacaagttcctcaagaaagtgatgaggtaactttaagaagatctactaaagtcaaaaggttagcaattcctagtgattatgtagtgtatctgcaagaatcagactacaacattggagctacaaatgatcctaaaatgttttcacaggccatgagttctaaagaatcaaacttgtggcacaatgccataaaatga

SEQ ID NO: 51577 - DNA, 618 bp, Glycine max
  Peptide Sequence Number=SeqID_143262
atgtatgtgatagtgtcactagggacgctccttaacattaaagacaagacgaaagatggtttgaatacttatcaagatatagctgagatgggtatacgagcgtcgttacatccaaggtatgatgcatctgatataaggacaaaaaagaaaatacttcacactgtgagggaggggtggagacagtttaagtttgatttgacgtcaaaatggacacttgcagttgaaaaggatagtgtcaatgacactggtgtgcgaaaaaaggcacaaatcttccagaaaccagacactgcccctcgcatgatgtctcgtggaggttatgaatatttagaaaagaagttgatagatgaaaagagaaagaaaaaactggaggaagctgctcaatccagaagcattgacaccgccattgatcctccatcttccatcaaacaacacgtgaaatggaagctagcccgcactaagaaaactggtcacatgacatctgaggcagcaaaagaaattgctgacaagattgatgcatttgaggagcaagcctcacagggttcttttgtcacccaactggaggattcgttcacagaaaaagttactcgacagctaatgttatgctttagccagatgtag

SEQ ID NO: 51578 - DNA, 456 bp, Glycine max
  Peptide Sequence Number=SeqID_143263
ttggcccagggcttcccggtatcaacagggacaccaggatttatttattctgcgaagtgatcttcctcacagtggcttctgtttcttcagctgtccctcctgttcagctactgacggggtggtgcgtaacggcaaaagcaccgccggactatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccggaattgcggaatttcgatgccttcgactttggagccatgcgtagtgattgcttagtgcaattctccattctcaagctttttcggagccccatgaattgcattttcgattcat

SEQ ID NO: 51579 - DNA, 372 bp, Glycine max
  Peptide Sequence Number=SeqID_143264
atggcgctgaaggacggcccccgaaggaagattcatgggcaatcaatttggctgggtcagggggcagcacatgatagattggtttcctcagttgaaggaatcgttgaaggaaggagttcttttctcgtgtggggataccctaatgttccactgatagggactaggggttgtattaattataatcccgcactcgccataagacaactagggtatcccatgaggggagcgccaaccgaagaaagtctctcgcctttccttgtgagggatctaggcgcgcaaggtctcaaggttatacaaagaatccacatggcatggaggagtccgttgaggaaagacaagagcttagaggcatccgaaatggcgtcatcggag

SEQ ID NO: 51580 - DNA, 240 bp, Glycine max
  Peptide Sequence Number=SeqID_143265
atggtggaaaaagagagtgacaagctgtggatatggtgcttggcacccatcattaggcaatttgtgaaattccaggacaagccggaaaaccaaaaaatattgatgcacaatccaaaagtcaagtcgaagtacttccgtaacgcttccgtaagcgattctgtggaaattcttcatcgttcttcgtcgttcttcaccgttcttcatccgttcttcgttcgttcttcgttcttcaacgggtaa

SEQ ID NO: 51581 - DNA, 297 bp, Glycine max
  Peptide Sequence Number=SeqID_143266
atgggcctctgtcagttctacggagtgcctgtcgcccccagcaagatcatcaggtcccctactaatcaagctttcatcaagaagtactgcgtccccaagcaggcgcagggcgaaacaccacagcagcctagggatggccggcagcgggcgacaaacgtaccgccatcacctctagagttcacctcagctcatcctcaaaaggtgaccaagtccaaagctaaaggtaagcaaagtactaggtctgtgatcgacaagccatcatgcgtccagctcaagacgttaaagaagcgctactaa

SEQ ID NO: 51582 - DNA, 126 bp, Glycine max
  Peptide Sequence Number=SeqID_143267
atggctggaagaaaaattaggggcgagggttttcgagagagagatgcagggacgcgttgtaatcgattacgcaaatatggtaatcgattaccagagagcaacattgccagaaataactacttgtaa

SEQ ID NO: 51583 - DNA, 315 bp, Glycine max
  Peptide Sequence Number=SeqID_143268
gcccgctttggcttctggaatgttacgaaactttacggattgcacaataatgcttcctttcgactcctggcatgtcgcggaacttcacggattgcctaacgatgggtgtcaagttcctcaaagcggtcatgcgaaggtcgcatcccaccaaacagatggtccccggacgaaattaggacagcaaaagcgtgcggatgaccatgatttgtctccgcgtgctatcaggcctgattgtctttggatagtgcaaaaagggcgtgggaccataaggttcccccgcatgtcatcggacccgccgtctctggatgacaaaag

SEQ ID NO: 51584 - DNA, 378 bp, Glycine max
  Peptide Sequence Number=SeqID_143269
atggagaggagtatgattgatgctgccagtggtggagctcttggtgatatgactcctgctgaggctaggaatctgattgagaagatggcttccaactcccaacaattcagtacaagaaatgatgctattgtccttagaggagtccatgaggtggccacggattcatcttcatctgctgaaaataagaagcttgagggaaaacttgatgccttggtcaacctaaataattatgatctttcaagcagtagatacaatccaagttggatgaatcatccaaatctgagatgggcaagtcctctacaacaacaacagcctgcccctcctttccagaatgctgctggtccaagcaagccatatgttcctcctccaatgcagtag

SEQ ID NO: 51585 - DNA, 456 bp, Glycine max
  Peptide Sequence Number=SeqID_143270
aggactacacctccttcaccttcagaggactacgtcctcctccccttcagagggctacacgccctcgccatcagagaactacacatcctcgcctttagaggactacatgtcctcaccttagaggacaacacgtcctcaccttcagaggccacacacccacctttagaggactacacgtcctcccctttagaggaccacacagtcctccctaaagggttgcacaccctcaccttcagaggactacacgttctcgtcttcagaggactacacgtccctctcttcagagaactacacgccctccccttcagagggctacacgccctccccattcgtagaggatacccgccctcacctttcagaaggactacatcgtcctccctttcagagggctacaccctcccctttagaggaatacacgtcctcaccatcagaggactacacgtcctttccctttag

SEQ ID NO: 51586 - DNA, 872 bp, Glycine max
  Peptide Sequence Number=SeqID_143271
gaattgcacttcggtcgcgcggccctgcggctggggatcgccactcccacgctgagcgtgcagatccaggacatcgagcgtcgcctcagcacgcgcctgttcgaccgcagccggcgcgaagtgctgttgacctccgcaggcgaggtgttcctggcggaagcccgcgatgtgctgcgccgattcgaacaggccgaaccctgggccggcgcgccgggcggggtgagatcggcaagatcgagatcggctacgtcggctcggcgctgtatgccggtgagcgaatggccgatgggcgagctcccgcagctgctgcaggaaggccgggtggatgtggtgttctgccggcctccgatggatgtacccgacagtttcggcgaacacaccctggtcgaagaccagttctgcgtggccctgccggaaacccatccgctggcgcaggcccgcgcgccggtacagccggcgtcattggcccgggaaagcttcgtcatgccggagcagccggtgggcgcaatggaagtcgggcgccgcggcgggttcattccacgtatccgttcccagcccgggcatctggcggcggtgttggccgaggtgtcggtcggcgttggttcggtggcgatcgtgccatcggtactgcaacgcacgctggtgctgcccggaatgatctatctgccactggccggccccaccatcgtctcgaccatcgctgtgcagtaccggcgggcggagacctcgcctgtggtgcgacggctgatcgagcaggtgaaggagacgccgtgcaggcgcatcgacatgttgcccctggcctgagcgccgcgcggcaggtggacgattgctacacttgcgccacctgcatacgcattcgatggacatcatga

SEQ ID NO: 51587 - DNA, 201 bp, Glycine max
  Peptide Sequence Number=SeqID_143272
atgggaagagatctcaagaaggttccccaacacttaaatgctataagtgtaatcgacccgaaaagccatgaagaaagaaggaccaagaaggcttacatcgcttgggatgacaatgattcatccgaaggatttgaaaaggaggaaataaaccttctaacaaaagactacgagagtgaagaggacatcactcaaagggactaa

SEQ ID NO: 51588 - DNA, 351 bp, Glycine max
  Peptide Sequence Number=SeqID_143273
atggaggaagctgttcaatctagaagcactgaggtcgtgattgaccctctatctccaatcagacgacatgtgaagtggaagatggcccgcaccaagaaaactaggcagatgatgtttgagtcaacaaaggaaattgctatgaagattgatctcttgactgctgccattggacgaccagaacaccttggttgtgtgcgtgctgctggagccggtgtgaccatcaaacaatactttggatcggctccacgaacctcccacacttcttcctctatgactcccgaagaactagaacagctgactcaacaaatcagggaccaactggaggagtcgatcacagaaaaagtgacttag

SEQ ID NO: 51589 - DNA, 213 bp, Glycine max
  Peptide Sequence Number=SeqID_143274
atgggggtgcaaatagcacccaggcccactaaggccctccagaatactcctccagaaggctgttgcttctggaggaagcaacctagctcgcctgggcgagccgaggcgcttccgaaacgtttccgtaacgttttccgtgaagaatttcgcaaaggtttcaaccgttcttcgacgttcttcattcgttcttcatcgttcttcgatcttcaacgg

SEQ ID NO: 51590 - DNA, 492 bp, Glycine max
  Peptide Sequence Number=SeqID_143275
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtccgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgttgcgccttatccg

SEQ ID NO: 51591 - DNA, 294 bp, Glycine max
  Peptide Sequence Number=SeqID_143276
atgaccacaatgatggaaaccatgatgagtatgagacaattgatggaggtcaacatggctacagtcgttgccgcaagtactaccaccgaggtggacccgactcacccatctggcctcaatcaagtaaatcgtccagtctcagatatgagtaagcattccttcccaccatatagcttgcctcccaaccatacaccatccaatgttgcacatgttcccgatgtgaatgtcgataacttcactaccatacccattgagagccaacaaccccaatctagtcatgcacaggtcccttaa

SEQ ID NO: 51592 - DNA, 174 bp, Glycine max
  Peptide Sequence Number=SeqID_143277
atggttttatcaagtcaaggtcaagggtctagatgccaccagcctcaaggaattgggacgattgatgggacctctctaaaggcaagaattaatgaaacattgggcttaatccggattttggttgtggacttgaagagggcaaataaagcagcgcttaccgtagttcatttctaa

SEQ ID NO: 51593 - DNA, 189 bp, Glycine max
  Peptide Sequence Number=SeqID_143278
atgtccgccagggtccagcctatagctttcttatgcttcttgagaacagacaacaacttctcctcttgctcatcagcaagggagacaaatataatcactggaaaacttttgctatcatccaagcttcaattctggtgtggtcggctggatagtggtggaaggagatggttctcagcttgtacctcgtaa

SEQ ID NO: 51594 - DNA, 189 bp, Glycine max
  Peptide Sequence Number=SeqID_143279
atggctacttctttggtgcatccagatgaacctgcacggacgcttcagcgcacggtggagtggacagctccttggattagttttgaatttgatgattgtacacttgtggctgaagccaccactatggacacctttgctctggatgacactatgtattttgtaaaactcccatattttggacagctttaa

SEQ ID NO: 51595 - DNA, 573 bp, Glycine max
  Peptide Sequence Number=SeqID_143280
atgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccctaccgtcgtaaaataagagcacctggctctgcccattcacaaggactcgattctatgtccaaacatcacatgccagcagatgtggtcaccatcatagtggatgagatcggtcgagtggtctccgttggagatgggattgcacgtgtttatggattgaacgagattcaagctggggaaatggttgaatttgccagcggtgtgaaaggaatagcgttgaatcttgagaatgagaatgtcggaattgttgtctttggtagtgataccgctataaaagaaggagatcttgtcaaacgaactggatctattgtggatgttcctgcgggaaaggctatgctagggcgtgtggtcgacgcgttgggagtacctattgatggaagaggggctctaagcgatcacgagcgaagactgtcgaagtga

SEQ ID NO: 51596 - DNA, 276 bp, Glycine max
  Peptide Sequence Number=SeqID_143281
atgagcaaagaaacaaatgaagaggaagcaattcatagtgtgagttttgacttagagggatcaagtttcgccacaagaaaaaacatccgcccaagtaagagtggagagaaagaatggatgatttcctcaatgaaagaagtagtcgagtcattgaaagaatttgttgaagtgactaagaagaagatggagaacaaaaaaaaagatggagataaaagaagctcaagaaatgaaaagatgtgcttatgcaaaaaagatgtgaaggaatttttgtgctaa

SEQ ID NO: 51597 - DNA, 1337 bp, Glycine max
  Peptide Sequence Number=SeqID_143282
caggcgcggttctgcgggcgccgttcggcagcgcatctattctgcccatcagctggatgtacattcgcatgatgggtgccgaagggctgaagcaggccagctcggtggcgattctcaacgccaactacatcgccagccggctgcagtcggcgtacccgattctgtacgccggccgcgacggccgcgtggcgcatgagtgcattctcgacattcgtccgctgaaagagcagaccggcatcagcgagctggatatcgcgaaacgcctgatcgactatggtttccatgcgccgaccatgtcgttcccggtcgccggcacgctgatggtcgagccgaccgaatccgagagcaaaatcgagctggaccgctttattgacgcgatgctggcgatccgcatggaaatcgatcgcgtagccgacggtgaatggccggctgacgacaacccgctggtgaatgcaccacatacccagatggaaatcgtcggcgactggactcatccgtacagccgcgagctggcggtcttcccggccggcagcgccaacaaatactggccgaccgttaagcgtctggacgatgtgtttggcgatcgcaatcatatgaatctggcactggtcaccggcggtagccgcggaattggacgggcaacatcgctgctgctggcacaggcgggttatcgcgtggcaatcaatttccggcagcgcgaagcagaagcgttgcaggtggtagcagatatcgaagcgcagggcggcaatgcgtttgccttacaggcggatattgccgatgaagcgcaggtggtgcgcatgttccgccagctggatcagcagccgggcgcgctgcgcgtgctggtgaataacgccggtattctcttctcccagtgccgggttgaggatctggatgctgcgcgcattcagcgcgtgctggcaaccaacgtcaccggcacgtttatctgctgccgcgaagcggtaaaacgcatgagcaccgcacacggcggccagggcggcgccattgttaacgtctcgtcagcggccgcgcgtaccggctcgcccaatgagtatgtcgattacgcggcgtcgaaaggcgcgatggatacgctgaccagaggattgtcactggaagtggcagcgcaggggattcgcgtcaatagcgttcggccagggctgatctacaccgatatgcatgccgacggcggtgagccggggcgcgttgatcgtctcgcggcatcgctgccgatgcagcgcggcggccaggcggaagagatcgctgccgccatcgtctggctggccagtgacgccgcttcctacgtcaccggcagctttattgatgcgtcaggcggccgttaa

SEQ ID NO: 51598 - DNA, 1080 bp, Glycine max
  Peptide Sequence Number=SeqID_143283
atgtctaaaatttttgatttcgtaaaacccggcgttgtcactggtgatgacgttcagaaaattttccaagtagcgaaagaaaacaaattcgctctgccagccgttaactgcgtcggcacggattccatcaacgcggtactggaagctgcggctaaagttaaagcgccggtcatcgttcagttctccaacggtggtgctgccttcatcgccggtaaaggtttcaaaaccgacaaaccacagggcgctgcgattttcggcgcaatcgctggtgctcaccatgtgcatctgatggctgaacagtacggcgtgccagtaatcctgcacaccgaccactgtgcgaagaaactgctgccgtggatcgacggcctgctggatgctggcgaagagcacttcaagaaaaccggtaaacctctgttctcttcacacatgatcgacctgtctgaagagtcactggaagagaacatcgagatttcctctaaatatctggcgcgcatggcgaaactggatatgacgctggaaatcgaactgggctgcaccggtggtgaagaagatggtgtggacaacagccacatggacgcttctgcactgtacactcagccagaagacgtagattacgcttacaccgagctgagcaaaatcagcccgcgtttcaccatcgctgcgtccttcggtaacgtgcacggcgtgtacaagccaggcaacgtgaaactgactccaaccattctgcgtgattcgcagaaatacgtttcagagaaacacggcctgccgcacaacgcgctggacttcgtgttccacggcggttccggttcttctgctgcagaaatcgaagagtctatcagctacggcgtgatcaagatgaacatcgataccgatacccagtgggcaacctgggacggcatcctgcagtactacaaaaccaacgaagcgtacctgcagggtcagcttggtaacccgaacggtgctgacagcccgaacaaaaaatactacgacccacgcgtctggctgcgtgcggcacaatcttccatggttgtgcgcttagagcaggctttcaaagagctgaacgctgtcgacgtactgtaa

SEQ ID NO: 51599 - DNA, 705 bp, Glycine max
  Peptide Sequence Number=SeqID_143284
atggttgtcgcgctgggaatggtttcgctgctgagcggctgcgaaggaatggataataacgcactgttgcagtctggcgcgcaggcgtttcaggcttactcactgaatgacgcccaggttaaagagctgagcgatcagtcatgtgcccagatggataaagagaaccagctggcgccggccaacagcagctatcagcagcggctgaacaaaatcgccgccgcgctgggcgataacatcaacggcgtaccggccaactacaaggtgtatctgaccaaagacgtcaacgcctgggcgatggcgaatggctgtatccgcgtttatagcggtctgatggatatgatgagcgacaacgaagtggaaggcgtgctcggccatgaaatgggccacgtcgcgctcggccatacgcgcaaagcgatgcaggtggctttcgcgaccacggcggcacgcaacgctgcggcgtcgctgggcgagatgggcgagaagctggttaacgcgcagttctcacagacccaggagtcgcaggcggatgactattcgtacgatctgctgaagaagcgcggcattaatccgcttggtctggcgaccagcttcgagaagctggcgaagctggatcagggccgccagagctcaatgtttgactcgcatccggattctgagtcgcgcgcgcagcatattcgcgaccgcatcgcggcggatggtaagtaa

SEQ ID NO: 51600 - DNA, 2276 bp, Glycine max
  Peptide Sequence Number=SeqID_143285
caccatcgcggatggtcacgatgctgttggcttccgccgtgccgctcaggcgtggcgtgctgtcattggtgacgccacccgccgcaatcgccaccggcgtgctgccgttgttgttcaccgctgccagcccggtgatggccaccggcggcgtggtgtcgatcaccagcgtggcgctggtggtggcactgacgttaccggccgcatcggtgaccgtgacgttgagcgtatggagcgtttcgctcagcgccgtggctggcgtcagcgtccagttaccgtcactgcccaccagcgcggaaccgaccagcgtggtgccatccagtacggtgacgatgctgcccgcctccgcccggccgctcagcaccggcgtggtatcgctggtgacgccgccattcgggatgacgctgccgctgacgtcgctggtgaccaccagcgtggccgcgcccggcgcaacggtatcgacggtgatagtcaccggcgtggtgcgcgggccggtattgcccgccgcatcggtgaccgccacgctcagcgcatgcgcgccgttacccagcgtcggcgagacaaagctccacgcgccgctgccgttcacgagcgccgtgcccagcagcgtattgccgtcataaacgctaaccgtggtattggcctcggcgctgccgctcagcgttggcgtggtatcgttagtcgcgccgccagccggtatgctgacgccggtaacatcgttagtgatggtcaggttggtggccaccagcggtggcgtcgcatcaacgatcagcgtcacgctgagcgcctcgccgtgccgcagaggtgtaactccagttaccactgctgccgaccgtcagcgaggccaccacatcgccatcgaggcgaatgtggtatcgccgtcagcaatcgtcaccggcgtgctgccgttgttgttgctggccgtcagcgtcagatcgtccggcgccagggtatcaacgatcaccgtcgcgctggtgctggtgctgacgttgcccgccgcatcagtcaccgaaacgctcagggtgtgcgatccttcactcagcgctgtcgctggcgtgtagctccagttgccgccggacggcacggtcagcgtggtcagcacatcaccattgttgaggatggtgaccgtgctgcccgcttccgctacgccgctcagggttggcgtggcatcgctgctgtagccgccgttgagcaccggttgtgcggtatcatcgttggtgatgaccagcgtcgaagcgttcggtgcgatgctgtccacagtgaagctaagcgccggggtgcggtcgctgctgttacctgctgcatcgctgacgcccacgctcagcgcgtgcgccccttcgctcaatgcaggcgtggtcagcgtccagcttccccctgcgcccaccaccaccgacgcgatagcggtgttgccatcgtacaccgtgaccaggctgcccgcatcggctctgccgctgagtaccggcgtgttgtcattgatgacgctgccgtcgctaatcggcaccgccgtgccgctgcgatcgttgctgatcaccacatcagcggccaccgccggcgcggtggtatccacggtgaagccgagggtagccgatggcgtcccctcatcaccgccagggttttgcgcggtgatgtagtaggcgtagctgccttcagccagcgtcggcgtatagctccactggccgttagcatccgccgtaacgctggcagagccgctaagcgttggcgtggtgtcacgggttaccgcgccgtctgccagcgtcaccagcgtcgtgcccgtgtcgtcagtgatttgcagcgtcgaggtagctggcggcagatcggcctgcacgttaaggctgaacgccggcgtcgccgtgctgacgttgcccgccgcatcggtgacggtcacggtgaagctgtgaggtccgttgttgagcgccgcggtcgtaaagctccaggccccgcccgagccggccagcgcagtgcccagcagcgtggtgccatcgtagatgctcaccgtgctgccggcttctgccgtgccgctcagagttggcgtgttgtcatcggtcgacgcgccgtcatccagcgggcccgtcgtgccgcccacgttatcggcgaccaccaggtcaggaaccgcgtctggcaccagcgtatcgacggtgacattcaccggcccaaccggctcgctgacgttgccagcggcatccaccacctgcaccgagaaagcgtagctgccatcctgcagcgcgctggtttcaaagcgccatacgccattggcatcggcgaccaccgagccaatcact

SEQ ID NO: 51601 - DNA, 246 bp, Glycine max
  Peptide Sequence Number=SeqID_143286
atgggtgttaagtacctcgaagcggtcaagaaaaggttgcaggccatcaaacaatggtccccggacgaaattaggtggaacctgtcattcagaaagaaaagaaagggcataagaagcgtcaacaaacttcagtgtcttggaagcgacaaagttgaaaaaccacgacacttccctacgccattgcactcgatcatccctgcccaacagagaagaatctcgcgcgtcgctgggcttgaatgtttctag

SEQ ID NO: 51602 - DNA, 678 bp, Glycine max
  Peptide Sequence Number=SeqID_143287
atgaggtcctgggtaaggggtcagtggatcccgtttgatgccgaagctatcggccagctcctgggatatccgttggttttggaagagggccaggagtgcgagtatggccagaggaggaaccggtctgatgggttcgatgaggaggccatcgcccagctgctgtgtataccggggcaagatttttcccgaactgctgcagggaggcgagtgcggatcatgcgcaccaacatgaccaccctgacccagatatggatgacgttgctactcagcaacatcctgcccggcgatcataattccgacctccctctgccgaagtgtcagctggtgtacgccatcctgacacggatgagtgttcatgtggctcagttaatcgctgatgccatctatatttttgcaggtatggcgcctaccaggcaccctttggacccagataagtccaacagggccctgggatttcccgcactgatcacaggactctgccagtcatttggagtccctgttgcacctaccaagagacaggctcagggtgatgctccacaggccgcaggcgcgcccccaccacctcatcaggctggccaggctggggcatttgacatggagcagtatttacggcatttggttcgccagcaggcggccaaccaccgagcacatgaaataatttgcaaagtcaagtcatga

SEQ ID NO: 51603 - DNA, 176 bp, Glycine max
  Peptide Sequence Number=SeqID_143288
atgtgtacagttaagaaggtgatatggaccttccagcctcccgtgacaaaagatgtgaccaacatacaacgtatgcgtgacgacatgatgcagatgcgcaaaagcgcaacagggggatgtacacaacatggaaatatcctcaataatcatacagcaaaggcgtacatgacatttag

SEQ ID NO: 51604 - DNA, 251 bp, Glycine max
  misc_feature (36)..(36): n is a, c, g, or t
  Peptide Sequence Number=SeqID_143289
gcccacttgggccctccggaatattcctccagaagncggttgcttctggaggaagcaaccctgctcgcctgggcgagctgggcggcaacctcctcccctattttgctataaataggggaggaaggcaagaaggaagggccgaggcgcttccgaaacgtttccgtaacgttttccgtgaggaatttcacaaagatttcaaccgttcttcgacgttcttcattcgttcttcatcgttcttcgatcttcaacgg

SEQ ID NO: 51605 - DNA, 363 bp, Glycine max
  Peptide Sequence Number=SeqID_143290
atggtgtatccagcagatggtctttcatcagtaagcgatgtgctagtcgttgttggtgaatacctatctggtgttcaagtctcctgtccttgtccttctattagtggtgcgtccgctcactggccctttgaatctggagatgtagttgcgtgtactgattctcatcgagattgggttggtcttcagtgtaccgcttgtgtagcctatgcgaagcgaacaagcaagggattgaggcgaaagccgcgttcgcgcattcgtttgtttgggtacaagatcgaaaagaatgcattggatggatgcccgggcattgagaaggaaggacgctttcagaggcgaaaggccatggggagataccgtctgtga

SEQ ID NO: 51606 - DNA, 1497 bp, Glycine max
  Peptide Sequence Number=SeqID_143291
atgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaagtaaaacaatctattccttgataagaaaaataaaaaacgtgaatggtgattggattgatgataaaatagaatcctgggtcttgaacagtaattcgattgatgataaagaaagagaattcttggttcagttttctaccttaacgacagaaaaaaggattgatcaaattctattgagtctgactcatagtcatcatttatcaaagaataactctggttatcaaatgattgaacaaccgggagcaatttacttacgatatttagttgacattcataaaaagtatctaatgatttatgaattcaatacatcctgtttagcagaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaagtagatccggctctaatagctccgaataaattaaatacatgcattaagatacgaaggcttcttatttcacaacaacgaaaacactttttcactctttcatatactaggggatttcacttggaaaagaaaatgtcccatactaatggattcgggtccacaacgatgggttcaaatgtacgagatcttgtagcacttaccaacgaggccctatcgattagtattatacaaaaaaaatccatcatagacactaatataattagatctgttcttcatagacaaacttgggatttccgatctcag

SEQ ID NO: 51607 - DNA, 469 bp, Glycine max
  Peptide Sequence Number=SeqID_143292
gatcatggcttctccacctgcctcgcctcctcctcctcctcctcctccttcagacgcatcagcttcaccatctgccatgaagcggacatgcaaagcctcacatctacaatccttgtctaccagaccacctggtgctgacacaccagtggtccacgttgatcctactaccggcaaggccgacggtccccacaggaagaaattaagaacatatttggggattgtggcgcgtgataaggtggacatcacgtacgagaactggaaggaggtccctactgctcagaaggacttgatttgggaggatattcagactgttggcaagagatggaagcagtttaaatcagacctcaagaggaaatgggcccttgcagtcgatcgggatggtgtggacgacactatctgtgagaaatatggcataagcaaggaaaaatgggctcagttttgccagactcgcagagacccttcttgggaa

SEQ ID NO: 51608 - DNA, 291 bp, Glycine max
  Peptide Sequence Number=SeqID_143293
atggatccattgttcacaatgacagtggtgtttcctttcaagcttccactccagtttccattcgagtacctaacggctattatgacccctactcatgatgccttgctatattacaatgggaggtggaacatgtcacgccaaaatgagtttgttggttactcgttcacaggaaaaaatcccaaaaagtttgacattctcaccggatgtaccatggatgaactgaaggatttgatcaagcaagttgcgcctcgtgggattccccttatggtattgatgaaacacaaatggtaa

SEQ ID NO: 51609 - DNA, 477 bp, Glycine max
  Peptide Sequence Number=SeqID_143294
gggcaggatcaccttgggctaccttttggagtgaagacgaaacatgaacggcagaaaccagtcaaggtacttaaggatgaacgcaagcggggatggggtcacgaccgaccgatcgttacccttctctgtgcgaaacaagcagggaatgaggccatgatgagcgtgaagaagataatggaagccaatgcggttgcaattgccgctaccagcgttgttgctaaggtgaacttgatgttcccatccggcatcaaccaaatgaatcatccaacctcagatatggtaggcaaagatttgggaagtacgggcagcccccataatgtacaaattcaaaacgagcacgccttcccgccatatggcttgcctctcaactatacgccacccaatgtggcgtacactcccaataagaatgtcaataactccactcctatacccattgagagccagcaacgccaaactgatcatgcacatgtctcttaa

SEQ ID NO: 51610 - DNA, 258 bp, Glycine max
  Peptide Sequence Number=SeqID_143295
atggctgcttccaagcccacctcctggttgtcatcgttcgatcacttccttttccatttccctggggttggtaaggcgaaatggggccaccctagcccattgagtgctttacctcgggccattgacatcatgcgttctactgaaatagatttcgcagaaaaccagctatatccgatcttggttggcctttcacccctagccacaagtcatccccgtattttgccacatacgtgggttcggtcctccaaggtctgttag

SEQ ID NO: 51611 - DNA, 231 bp, Glycine max
  Peptide Sequence Number=SeqID_143296
atgtacgctccacttgaactaatccacaagagatgtacccttgaatctttgttaaggaaagggaagaaacaaaagatatatcaagcggttagtcctttgaaatcttttgtcaagagggagaaaggagaatcaaaagaattctcaggcgaatttccacttgcagaaaaacaaagttttgaaacaaagtttagaaagcttttaggcaaagaaaaaacaatgggcaatggttag

SEQ ID NO: 51612 - DNA, 504 bp, Glycine max
  Peptide Sequence Number=SeqID_143297
atgtcagcgttgcctccaatttgtttgattggtagtgtagcatggtgcacggtggtgccactcatttgtttccatattgttgagtggcaccaacccgatagagtgttgcgacaatttggaatgcaacaacctattcccgagtgtccttcgcaaccactgaatatccatgggctaacgttaaaaggcaaacacgatgaaaattggttccaactattggcctcaatgatcagtcaatggaacaatcgagctgagtttagggtcgacgtttatcctcgacaggagggtctattgagttttaacttcgactacatggtctggaggaacacatggacagttgatgatctcgtgccttatgtggagaagttaacgattttatccgaaaagcaagagagaatcactgagcctgtggcacatggtccagcatcagagcatcaatctccacgacaagagtttcacatgcttcagtcaagtgttgaaactcggggttttgacaaacgacgatag

SEQ ID NO: 51613 - DNA, 358 bp, Glycine max
  Peptide Sequence Number=SeqID_143298
cccgcatcaattagaccttgcaccttacgcttcagagccctacaatgctcaatggaatgccccggggcttctccgtgacaagcacacgttgcgttcgagtcgtattctcagagaaatggaggttgatgaaccttggttggggctttctcgctgcaaaattcatttcttggttgggatggcctttgtggatatctgggcggtgggtaaggagaaggtttgttattggctgagtaatgacattgttgggttggtgggaaacttggctgtattggaatggcagtcacagcatgggcttctacttcatcctcaccctcttcatttgccccagttttctcattcgtccaagcaggatgactaa

SEQ ID NO: 51614 - DNA, 384 bp, Glycine max
  Peptide Sequence Number=SeqID_143299
atggccagaacacgaggtttaggtcgtgccataggtagagttgtaggcagagatagagctgctgacgaggatgctggcgatgttcccgagaggcgtaggcctactgcctcagcccgtaggctacgcgttcatcagatgactacggagggacgtgatatggctgaggacgtcgctgacatgactgatgatgtccctgagcagcctacggaggcacctgagatgcgtgcggacgcacagggtgctgatagtggtgaggggtcagatggtgatgatgctgcagagggattccctggtggtccacgtgacccgtcagtgctcacatcatttgccgagcatgttgcacatgccgtgtggagtggacaggaacgtcctgatttgaattag

SEQ ID NO: 51615 - DNA, 48 bp, Glycine max
  Peptide Sequence Number=SeqID_143300
aactacacgaggccatacaaacagattcatgaacgtgggatcctctag

SEQ ID NO: 51616 - DNA, 201 bp, Glycine max
  Peptide Sequence Number=SeqID_143301
atgattattgaagaatctacccatgttgcttttgatgaaactaacctaattttgccaagaaaggatgctctagatgatatttcatattcgttagaaggtatgcatattcatggtgaagagcacgaaggaaaaggaaagggaaataatgaagactttcaaattgatgaaacaaaaataagtgcagatcttccaagagagtga

SEQ ID NO: 51617 - DNA, 402 bp, Glycine max
  Peptide Sequence Number=SeqID_143302
atgagtgaaataaaggaagttaaggagcagatgaaggccgacatagaggccatgaaagagcaaatggccaccatgatggaggccatattgagcatgaagaaaataatggaaagcaatgtggctacagtcattgccgcaagtaccgctactgagggggacccgactcactcatctggcctcaatcaagtaaatcctctagtctcggatatggtaggtcagggagaagaagcattggcaaatacaagcgatccccatgttgtgcagagcaagaattctttcctactatatggcttgcctcccagctatacaccacccgatgttgcacagtctcttgatgagaatgtcaataactccactcctatactcattgagagccaacaaccccaatctgatcatgcacat

SEQ ID NO: 51618 - DNA, 237 bp, Glycine max
  Peptide Sequence Number=SeqID_143303
atggagaacgagcaatttccgattgaacagacttggagatcaactcaggagcacaggtcacttgagcaaacaaccgatgaattatattcacattccagtgaaaccagcccgcatcaatcagactttgcaccttatgtttcagggtcatacaatgctcaatggaatgccctagaaatcccccatgataagcacatgttgcattcgagttgtatcctcgggaaaatggaggttgagtaa

SEQ ID NO: 51619 - DNA, 468 bp, Glycine max
  Peptide Sequence Number=SeqID_143304
atgatgagagagattagatttatggaagatgatgaaacaaaacagagaggaggaattatagtgaaacctgaatggaggatgaaggttaggtggagagggaaattgattttggagcttaacagttccagtgaaacccttctcttcttcatcttcttcatctccactaaagaaaaattgaagcattttcccacggaatactttccatcggtattttccgtcgataaaagagatgtaagaccatctaattcttctcatggagaagatgatcggtatgaagaggatgagggaggatggaggaatgagaggtatagggagagaagaaatcatagaagatatggaggtggacaaagagaggaagggattgagggagtgaaggtgaagatccctacttttaaagggacttgtgattcggaagtgtatcttgagtgggagatgaaggttgagaaagtcttcttctacactatctag

SEQ ID NO: 51620 - DNA, 266 bp, Glycine max
  Peptide Sequence Number=SeqID_143305
accttgcaccctacacttcagagccctacaatgctcaatgggacaccccgaggcttctccgtgacaagcacacgttgcgttcgagtcgtattctcggagaaatgaaggttgatgaaccttggttggggttttctcgttgcaaaattcatttcttggttggtgctcttgggatggcctttgtggataactgggtggtgggtaaggaggaggtttgttattggctgagtaatgacattgttgggttggtgggaaacttggctgtatag

SEQ ID NO: 51621 - DNA, 339 bp, Glycine max
  Peptide Sequence Number=SeqID_143306
atgattcttgatgcctcaactggaagcactatgaggtccaagagtctggaggaagctattgtaatcattgactccatagcagccagtgattatcaaagtcatcgtgatagagctccgactcaaagaaaaggaagataccaaggctatagaggtggttcaggttcaaatcagccttatggttggaggccacacaataatgcatattctggtccaaataacatttcttttgcaagtccttctaacaactcgtatggaggttcttcaaataagggtccacaacaacaagctcagccagatagaatgtccaaaatggaagatactttaacacattttatgtag

SEQ ID NO: 51622 - DNA, 717 bp, Glycine max
  misc_feature (693)..(693): n is a, c, g, or t
  Peptide Sequence Number=SeqID_143307
atgtgggcacgctggtggacggctattcttcggatggcgcgcggactttttcatgggggccggtttcgcctttggcgggcgatatcttcaaggctcttgaggcggccttcgccctggcgggcggatcgctgtactttccgcccgaggcctttcgttatcggttggtgcgcctgccgatgctggacctgtggggcaaagcgggttccggtgcaattgcgctggtgcctgccgatgccggggcagggctggccgccgtcgtcagtgatcatgccgcgccgatcatcacggagggcggcacctgatatcgatctcgctgcctcgcatctggatcgatttgcgctcgaaggcggtgaaatcccaacgcgagtcaaaagcaggccaagccgccgccagcggggttggcgacatggagcccgtccgaggggcgttggtcaactctctgctggaatggcgcgcagcttgccgcgaccggttttcttgaaacggaacgataccaccatcagttcggcgcccggcttcggaaagcagcggtgcgttctacgccatgtgggcgaacagtggggaaggttcggaagctgctgcatatctttctcctcagtcaatgcggttcaggcggcaatctcagcgcggtgcgcgcaacatcgcgcggtatcgcatctggctgcttttcaggtggttgcgcatggcgcttcngcgccgcctcctcgtcgccgtcct

SEQ ID NO: 51623 - DNA, 231 bp, Glycine max
  Peptide Sequence Number=SeqID_143308
atgtcaggatttacacgcaattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgaaccattgaattatcaagtggtcttcgtcattggaagtgcggtagacagactttgtggttga

SEQ ID NO: 51624 - DNA, 369 bp, Glycine max
  Peptide Sequence Number=SeqID_143309
atgtaccctcccttgttctctttgaacaacctagtggatgtaccctccactagaactgatccacaagagatgtaccctctcttgttctcagtcacaacaacccaagtagatgtaccctttacttgtaccacaaaggatgtaccctccaatgtgttaagacaaagttctcaggcggaagaatcaaaagaattctcagactgtgtcgttttgaattctttgacaagagagaagggagacacaaaagaattcaggcggttagtccttcgttcttttggaaaagggagaagagagacacaaaaagaactcaggcggttagtccttggcaaattctttttggcaaagggagaagggaatgaaaaagatgaatag

SEQ ID NO: 51625 - DNA, 324 bp, Glycine max
  Peptide Sequence Number=SeqID_143310
atgagtaagcatactaatgaagaccgagttgatttggcctgtctattcgatctaggtgaagctaaggggcatgagcgtgataagagggattgctttcctcttcgtctgtatctacgcaatttcccgcttcttttcctcgcgtcctcctttccttctttcattctttgttggctcgcagggatatcgattactggtccttgtggggtgctctgcttcaagagtctagtctatttatcatttaacggattgccgagcggagaagcgttaactactgggatatcggggagttcctctccagctactggaacttccctcgctacatga

SEQ ID NO: 51626 - DNA, 216 bp, Glycine max
  Peptide Sequence Number=SeqID_143311
atgattttcactctcttcttctccaaaaacgtctcccaaaccctaaaacctcattttccatcacccaagatcaccgatggccaccgtaggccgccgttgcttgctattggacccccacaccaagaggaacactttaatcggagcgaaatcctcaaaatcctcctcaaagattcggtggagaaaatccttcaatcctccatttcaaagtttctctga

SEQ ID NO: 51627 - DNA, 183 bp, Glycine max
  Peptide Sequence Number=SeqID_143312
atggaaaaatccgacaagatgaatttcaaagggaagaaagaaaagaaaggatacatcacttgggaagataatttggaagttggaagtagttattggaagttgaaagttaaaaatggaagttggaagttggaagtggaagttactggaagttggaagttggaaatgaaagttattggaagttga

SEQ ID NO: 51628 - DNA, 525 bp, Glycine max
  Peptide Sequence Number=SeqID_143313
atgccggaagcttctggtaatcgattaccagcctgtgtaattgattacacagaggaatgggtcactggtaatcgattaccagggcatatcgtgatggcggcgcaactaatccgtgatcgagtagagatggagtgcctagagggagcttgggagaccctcgaaggcaacacgaggtgccgatttcggggcaccattcgattcacggctacttctttggtgcatccagatgaacctgcacagacgcttcagcgcactgtggagtggatactacccacgcctacaccatatcgtctagtggagcccgttcaagtgatcgaggtaacatcatccgaggaagaccctgaggaggacctggaggagctacctcctgagcctgctgtggatgcccttgactttctagagggtgatgaggatccacttcttgaggtggattctcccgaggaagtcatgtcggcatctgaggcagactctacggaggatagtggcccgagggagatggcgatcagcggaggctcttcatcctag

SEQ ID NO: 51629 - DNA, 556 bp, Glycine max
  Peptide Sequence Number=SeqID_143314
gtgcacggggtcttaccgtctagccgatggtactccgcatcctcacggagaattcaatttcaccgggacagctagagttactgccgccgtttaccggggcttccattcaaagcttataacacttctcgttccgaccttccagcaccgggcagttcaccgggaggatcgccctcccaattcgaagttttttcctggaagtttcaaccttgttgactatgacaacagtcgcgactataaacagactcgcgactatggcagggcgggcgaccgggccaggccgagtcagaaaggctttgatgactcaagcaaggttcatcttagggaaaggagagtgaggggaagagggggcagccctcggcccgatcatccaattcactccaacagacaggcatggttctgtagtcaaagcaacttcgtcactttcgtgtacccatcggacggcagccctttcggggatttatcgttactcatgtcagcattctcacttctgatatctccaggtgttgtcaccaaaaaccttccccgattgacagaacgtcccgctactgacacttga

SEQ ID NO: 51630 - DNA, 228 bp, Glycine max
  Peptide Sequence Number=SeqID_143315
atgaagcttcattgtaagaattgtgatgacgagagtgatgagcaaaatgacggcgacagcgatgaagtctatttcgttgaagcctttgggaagagacggcaccgtgaggcgccatttggtggaggagattccgattgtggtgcgaaggtacaccgtcaagcctctggtgacagtgacattggaaagcacggaccaatggtgacgcggagttgtactctttgtctttga

SEQ ID NO: 51631 - DNA, 357 bp, Glycine max
  Peptide Sequence Number=SeqID_143316
atgggtgccaagcacctcacaaggaccaaagaaaggtcgcatgtcatcaagcaaagaatgaccaaacttggtctctgcttgtcatcgggcccgccgcctctggatgacaaaagggtgcgaataaccataagaatgaccaaacttggtctctgcttgtcatcgggcccgccgcctctggatgacaaaagggtgcgaataaccataagaatgaccaaacttggtctctgcttgtcatcgggcccgccgactctggatgacaaaagggtgcgaataaccgtaaggtatctccgcgtatcatgggtgcagaatgaccaaacttggtctctgcttgtcatcgggaccgacgactctggatga

SEQ ID NO: 51632 - DNA, 773 bp, Glycine max
  Peptide Sequence Number=SeqID_143317
gcgaatcgttaccggaaagcgtgatcgtggcagaagttttgcccttcccgcatcgcttatacgccgtcaggtctgtgttaaactgcagggcattacgtggaagcaggaatgtagaatggcaacaatgctggatgtctcactgcgtgcgggcgtgtcgaaggctaccgtctcgcgcgtgctgaacggcacgggtcaggttaaagagagtacgcgtcagcaggtctttgctgcgatggaagagctgggctaccgccccaactttctcgcgcgctcactggctaaccagaccagcaacagcattggtctggtcgtctccaccttcgacggcttttattttgggcgccttctgcagcaggcgtcgcggcagaccgaaacccacggcaaacagctgatcgtcaccgacggtcacgacgcgccggaacaggaagaacaggcagtgcaaatgctggccgatcgtcagtgtgatgccatcgctccggatcgctgcgtgttcttcgaacagcaggatgccgcatttaaggcggtggattacctgatcaatcagggccatcgggagatcgcctgtattaccgtcccgatccacacgcccacgggtaaagcgcggctgatgggctatcgcaaagcgctggaaaagcacggtattcgcctggacgagcgtcgaattaagtacggtgatgccggaatgacgagaggctatgagctgtgcaaggagctgattgccgacggcgtgccgtttagcgccctgtttgcctgtaacgatgatatggcactgg

SEQ ID NO: 51633 - DNA, 195 bp, Glycine max
  Peptide Sequence Number=SeqID_143318
gattgtcatcataaaaaagggggagattgtggaagcaatgacttccaagattattttgatgatgccaaagaatcaagagttaagcaagttccaaagattcaagaatcaagtttcaagaatcaagattcaagaacaatcaagatcaagattcaagactcaagattcaagaatcaagagaagactcaatcaagataa

SEQ ID NO: 51634 - DNA, 399 bp, Glycine max
  Peptide Sequence Number=SeqID_143319
atggtgaaaggcaattttagtgctgtgattcaatgcattcttccaactaagcacaaagatcctggagttgtcacgataccgtgttccattggtgaggttactgtaggaaaagctctcatagacttgggagctactgattttgtggtgataaacaacgaagaggatgctaatattcctctcattcttggccgcccattcatgtctactgcaagttgtgtagtagatatgggaaagaagatgttgcaaatgggaatagaagatcaaaaaatcagctttgatctatttcatgaagataaagagccacctgactggaatgtctattttaaagttcatgtgatggaggaaagaagacttgagaagaaggtgcttgaagtgggaactttaatggatcctggataa

SEQ ID NO: 51635 - DNA, 393 bp, Glycine max
  Peptide Sequence Number=SeqID_143320
atgaccgaccctctcgatgagtcgatctcttgctttctcataaaggtggacccttgggtactagtacctatcacctttagaggactatatgtcctcgcctgtagacggctgcacgccctcgcctttagagggctacgcgtcctcgttttcagtgtgctccatatccacaccttaagagaatataaggtcgtttgccctgagatgcttcaccgagacttgcactcctgggatcgcgcctacaagacgcccagtggacccgaagaagtccaacagggccctggggtttccagctctggttacgggcctctgtctgtcctacagggtgcccgtcccccagcgaggtcatgccatcgtgacataggtaagtatgcacgtgactcaattgatttctga

SEQ ID NO: 51636 - DNA, 726 bp, Glycine max
  Peptide Sequence Number=SeqID_143321
atggatgagttctcaattatcggcaccaccgacgtcgagtacaacggcgatccaaaagaggtggcgatcgatgataaagagatcaactacctgctgaacgtctacaacgcgcactttaaaaagacgctgtcgcgcgacgatatcgtctggacttactccggcgtgcgtccgctgtgcgacgatgaatccgactcgccgcaggcgattacccgcgactataccctcgatattcacgatgagaacggtcaggcgccgctgctgtcggtattcggcggcaagctcaccacctaccgtaaactggcggaacatgcgctggaaaaactgacgccgtattatcaggggattggcccggcgtggaccaaaaccgccgttctgcccggcggcgatatcggcggcgaccgcgacgactacgcggcgaaactgcgccgtcgcttcgcgtttatcagcgaatcaatggcccgccactacgcccgaacctacggcagcaacagcgagtggatccttggcgaagcgacttcgcttgccgatctgggagaagattttggccacgagttttatgaagccgagctgaagtacctggtcgaacacgagtgggttcgcagcctggatgacgctatcgggcgccgtaccaaacaggggatgtggctgaatgccgagcagcaggcgcgtatcagcgagtggctggcgcaacatacgggaaagtctgaactgtcgttagcgtcctga

SEQ ID NO: 51637 - DNA, 222 bp, Glycine max
  Peptide Sequence Number=SeqID_143322
atgaggtcttcaatggtgatttccaccatggagatgcagcggaagataaaggagaagagctgccagcaccagcgatttgtttctttaagcatggagttcaatattctcttaggatcaacatttcagccagcaattcaatcaccaaaactcaaattcacaatagacacaatcataaggaaacctaaaagttcaagaaaaggttcacaatcaaagactctctaa

SEQ ID NO: 51638 - DNA, 399 bp, Glycine max
  Peptide Sequence Number=SeqID_143323
atgaggcctgatgaggcagtttttcctgagccaattgtgccagttatacatgagactgttgaagtaggtgagttacaattgagacaagaggctgctactcctgagaggacaccacaaaccccagaaaatccaccctcaccagggatagagctatcttttgctcagcaggtagcagatcctcctacaccagtacatgagagaccagctgacccctctactcccattttagagataccagaggaccctaccacaccggccctgactctgaacactactcctctagcacacctgagcttcagttttcagatgaggaggggggacggattactactccttcagggatgccagtgttacatttcgatgatgaggagtaggatcgagatgaatgacaggatttga

SEQ ID NO: 51639 - DNA, 246 bp, Glycine max
  Peptide Sequence Number=SeqID_143324
atggagaagagcaaagttgatacgttgatagcaatttctccaaacacatggcatgcatcaaagtttattcatatttctccccaagataaaggaatatgtgatttatggagacaacaaacgaaggccacatttctccccaagaaaagtgaatatgcgatttatggagacaacaaacaaaggccacttgatcaacaaccccaacaagtaatatcaaatgataccaacaggtcacttgtctttgattga

SEQ ID NO: 51640 - DNA, 382 bp, Glycine max
  Peptide Sequence Number=SeqID_143325
atgtgcggaaaatggcataggccatctagaaggaaaacaccacccccccacgtgttgtctcgtgggggttatgaatgtttaaaacaaaagctgatggttgagaagacaaagaaaaaactggaggaagctgctcaatccgaaagcactgagggtgtcattgaccctccatctcccatcagacgacacgtgaagtggaagatagcccgcaccaagaaaattggacagatgatgtctgagacagcaaaggaaattgctgacaagattgattctttggaggagcaggcgtcacagggttcgtttgtcccccatggacatcaggatctcttgactgatgccattgggcgaccaaaacaccctggttgtgtgcgtgctgctaaagtcg

SEQ ID NO: 51641 - DNA, 321 bp, Glycine max
  Peptide Sequence Number=SeqID_143326
atggcgcgcagagacaaaaattggtcattctgcaccctttgtcatccagaggcggcgggcccgatgacacgcagagacaaaatttggtcattctgcacccttgtgtcatccagaggcggcgggcccgatgacacgcggagataccttacgattatccgcactcttgtgtcatccagaggcggcgggcccgatgacacgtggagataccttacggttatccgcacccttttgtcatccagaggcggcgggcccgatgacacgcagagacggccaatttggtcattctgcacccttgtcatcgcggccggacaagcccgatga

SEQ ID NO: 51642 - DNA, 704 bp, Glycine max
  Peptide Sequence Number=SeqID_143327
atgcccaaaagcacgttggagaaattgccgtttaatgcttcccatctaaagccaagttccatggtggtccgtgccttcgacggcacccgccaagagctgtcttttgggacgcccgtggatccacttgatggagggcatttggttattgtgtcgggggaggaagacatcttggtaagttgcccgacctctatgccatatgtggaagccacggaggagtcattagaaacaaccttccaatcttttgaggtagtaagcattgcctccgtagattccttttctgggcaaccatgcctgttcgatacggcaatgatggtggcctgggtgatgctggggaatggttacgagcccgaaatgggtttaggtaggaacaacggcggcagaaccagcctaataagcacccgaggaaatcatgggaagtttggattaggctataaacccatgcaagcggacataaggaaaagtgtcgcaggaaggaagagcggaagccaaggttcgcaattgggacgagaagtcgaagggggcccgccctgccacatcagtaggagctttataagcatgggtctaggacacgaaggccaagtcgttccgatatgcaagaatgactctccaagtgggtcggttttagtacgaccatgccctcctggtttccgactaggaaattggcgagtggaggagcgcccagacatttacgcgacgagcataat

SEQ ID NO: 51643 - DNA, 345 bp, Glycine max
  Peptide Sequence Number=SeqID_143328
atgcggaggaactcgcctgcctactctagagatacttctttcttgccacaaccatcctttttcttcggaagaccttttactggaacatcctcgttcgaagtggggatcattttgtcatcctacccttccgttatttttgccttccctttaacatttgcgggttgtgtcggcaggtcagggggtgcaaacacgcgaccgctgcgggtcacgccgctcagcctcgtgatattggttaccttggctgacaacgagccgatgtcggtggcctctccttcctttcgcttggaggcgcatacctccacggaactgcgtggctgttttggtacgggaacggaaacaggttaa

SEQ ID NO: 51644 - DNA, 566 bp, Glycine max
  Peptide Sequence Number=SeqID_143329
atgtctagtttccaattccctgtgggagaggtgacgatcacgctggacgacgtctcgtctcttctgcatctgcccgtggttggcgacttgcatgcctttcagcccttgcacatggatgatgcggtacagatgttggtggacttattgatggtttatgcagaggctgccagggctgagatagggcaatgtcgtggatcgtacatatgtctggaatgggtatgtgatatctatgagtgtcgatgtcgggcaggtcattggacagctgcggcttgcgcgtatcttcttcatcttctgtgttgcactctttttgctaacaagagtgcaaccaatgttcatcttgtgtttttggaggcccattgtgacctcagtcagaccgggaggtacgcctggggagtagctgcactggtccatatgtacgaccacctcaacgatgcttctatcagcaccaaccgacagcttggcggttacatcacgctgctgcagtgctggatatacgagcactttccctcggtcgcggagtccactgctgatccggaatacgacgagaattcaccgggtgcttgtag

SEQ ID NO: 51645 - DNA, 776 bp, Glycine max
  Peptide Sequence Number=SeqID_143330
ccgacaaggacaatgtcgatgacactgtatgcaaaaaatacggaattagcaaggagaaatgggtccaattttgtcaaagccgcagagacccctcttgggaggatgtgcggaaaaaggcacaggccatccagaagcaaaacactgccccccacgtgttgtcttgtgggggttatgaatatttagaaaagaagtcgatggttgagaaaacaaaggaaaaactagaggaaactgctcaatccagaagcactgaggtcgtgattgatcctctatctcccatcaaacggcacgtgaagtggaagatggcccgcaccaagaaaactggcaagatgacgtttgaggtagcaaaggaaattgttgagaaggttgtaagattcattggaggagcaggcgtcataggattcctttatcccccatggacgtcaagattcggtgtgaccatcaagcaatactttggaccagctccacggacctcccgcacttcttcctccacggctcccgaagaactagagcagctgactcaacagatcagggaccagctggaggagtcgatcacagaaaaaggacttgcactgcctccagagcctgaggttggtccttcagctgcttgtgtcagcactaaggagagttgtgttgatccctcagggaatgatccagacacgggtgactctgacaaatgcgggttgtacatcgaagaaaatcctccctgcctagttgccctaggaaaagtttatgagggattgacaaccattcacaacatccttttgttgcaagattaa

SEQ ID NO: 51646 - DNA, 390 bp, Glycine max
  Peptide Sequence Number=SeqID_143331
atggtccagcatcagagcatcaatttccagcacaagaggttcacattctccagtcaagtgtctgaaactcaaggcataggcaggcaaagggtggttgttgaagcggaagaatattcccaacaaatggcgcaagcaaacactcgtttggtggtgttgcggaaacacatgcttcattgttcatggccaactatgaccccttcacagcaacatgatgccccgattccaacacctaacgccccattaggtacgcaatggaatgtacccagagcaatacctgatataggtgacttattaggtgttgatttgcgtcaccaattttctgttgaggttgaccaagtagaaacggggagacatcggggcagaagaaatcctgatcgccaagtgcaatga

SEQ ID NO: 51647 - DNA, 381 bp, Glycine max
  Peptide Sequence Number=SeqID_143332
atggataatgaagagggcgtgcaggaacagatgaaggccgatctatcggccttaaaagatcaaatggcttccatctcggaggtcatgttaaaactccagaaaactatagaggataaagccacggaaaccgcctccagtacagttagggaagcggagccggtgctgcagcctgccttaaatctgggccgagacagaaacacgacagtgtttggtcgaaggtatagcccagaagctcacccctatggcttgcctccggacttcgctccccgtgccgccccgaaagatttaagccaagcccctaccttcgaggggcaaatcccaacttatgacgactatcccgagcaagacgatgaggaaggagatacccatttcggtcccctg

SEQ ID NO: 51648 - DNA, 300 bp, Glycine max
  Peptide Sequence Number=SeqID_143333
atgcgagggttagattggctctccaaattgaaagttatcaatgaggagaacttcgaagctccggaggaagatgaagaagtccaagttctaaaattagagctagggaaggcgagactcgccaaggagaagttcaaatcagccgctacacacattcggaaagagtgcaccgaggtacaagaggaaaacgcggccactgcaagagcccttgaacaagaaaccaaaagggcccgcaaggaggaacatggccgaaataaattcagaggaggattgtgtggtagcaacaatgagctcaaactctga

SEQ ID NO: 51649 - DNA, 336 bp, Glycine max
  Peptide Sequence Number=SeqID_143334
atgactaacgaacgaagaacgtcgaagaacggctggagatcttcgcgaaaatccccacggaatcacattactgaagcgcctcggctcggattttcttcacggaaccaatttgtttccctaatttcaattacggaaacttacgaatttcgtaacgatacctgttttctttccgtaatgttacggaaccttgcggattacctaatcatcccttatttgacttacggaatgttacggaacctcacgaattgtgcaacgatgctacctttcgagttccggcatgtcacggaacttttcaaattgcctgacaatgggtgccaagtacctccaaatggttaa

SEQ ID NO: 51650 - DNA, 120 bp, Glycine max
  Peptide Sequence Number=SeqID_143335
atgtatgaacatgaaatggctccgaagaaaccctccatgaagaggtctagaagagacaccactgaagaagggtccagtgccgcccccgagtttgatagtcatcgtttccggagtggctga

SEQ ID NO: 51651 - DNA, 252 bp, Glycine max
  Peptide Sequence Number=SeqID_143336
ggtgactgggtttggcttcatcttaggaaggatagattccctactaaaaggaaatccaagcttagccctagaggggatgaaccttttcaggaggaggaactaacagatttgaggtcaaatcctcttcaagtggaaagggatgatgcaatcctccctaggaaggggccagtcactagagccatgagcaagaggctccaagaggatttagctagagctgctgaagaaggccctggggttctcatgaacctcagg

SEQ ID NO: 51652 - DNA, 846 bp, Glycine max
  Peptide Sequence Number=SeqID_143337
atggaagactgcctgctgctgggagtgggtgacttcaacgtcgactggtcgttcctgtcctactcgctgctgttcccgttccgtgacggcctgcagacaggcttcgaggaggtcaccgcgctcgaggcgggcgaggcagtgacgatccgtgatggccggccgatcggccggcactaccagtgggatgtggtgcggcaggccagtgaagcgcccatcgaagatctggaggaagccgtgcagctggcacgtgcaacgctgctgggctgcattggtgcgctggcgagtcagcatcgatgcatccagcttcagttgtccggcgggctggactcctccatcgtcctcgccggcctgctgcatgcaccctccgcaccggaggtgaaatgcgtccatcactacgatgccggcattggtgccgatgagcgcatgttcgcgcgcatggccgttgccggtgcccgtgaatcctccggaagaagctgcgagttcgtcgagtaccaacggcagccgcactgctcgctggaagagatcatggacttcccgcgaaccgcgcgtcctgcgcattgctcgggttacctgctgcatcggcgcgacgtggatgtcgacgcggacacggtgcagttcaccggtgtcggcggcgatgcggtcttcctccgcttcaagggcaatgccgctgccatcgattatgcgtggcggcgtgggatcgaccgcgagttcttccgtgtcgcgttcgaaactgcgcagtcgggcgattcgctgtacggggtatccaaggatgccttcgtccatggcgtgttcaagaagccaggcagcatcaacggccgctggggcaacccgtgcgaatgggtgacg

SEQ ID NO: 51653 - DNA, 585 bp, Glycine max
  Peptide Sequence Number=SeqID_143338
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggcaaaagatttgggaagtacgggcagcccccataatgtacaaaattcaaaacgagcacgccttcccgccatatggtttgcctcccaaaactatacaccacccaatgtggtgtacattcccaatgaggatgtcaataactccactcccatactcattaagagccaacaacctcaatctgatcatgcacatgtctctcgacccatggaggagacacatgaaattccccaccacgatctagccaacttcgagccttgcctcggatatgctgctgaagggcaagcagttggtggtatacccctgcaaaacactttggagggccctcaatatcatccacaaccacaaccctcacgttccacagcggttaaaaaccctcatgactatggcagaaatgggaaagttggatcatctagaggaaaggctcagggccattga

SEQ ID NO: 51654 - DNA, 687 bp, Glycine max
  Peptide Sequence Number=SeqID_143339
atggctgaaccatcatccgatgctgctactgcaagtgcaacgaggaaaaataaggcagacccaggctggaaatattgccattcactagtggaaggagatacaaacaccattgtttgtaatttttgtggaaaaatcactaagggaggaataacccgagccaaacaacacctgattgggaagtcgggcaacgttgcagcttgcaagaaaactcccccaaatgtaatcgaagagttgaaggaatatatggctacaaaaaaaagtgggaccacttacagtacttctggcagtggtaatatggcaaatataagagattttgaatttggtgaaccgattggatgtgatggaagtgaagaagatgagtttgcggactcttgtaatgctgctgcaagtgcaaagacaaagtgtgggactaaaaaaggaccaatggacaaattctgtaagaatccagaaaatgcaatcaatcggagaaaaatggagatgctgaggcaaatgaacataagagagtcaatggataagaatgaagtaatgaaggtgcatcaacatattgctcgcttttggtaccaagcagccattggtcaatatgggccacatttgcccattcctagctatcatgacatcagagttccactcttgaagaaggaagttgaatatactgaaaatttgatgaaaggccatagggagcaatag

SEQ ID NO: 51655 - DNA, 231 bp, Glycine max
  Peptide Sequence Number=SeqID_143340
atgtccaacaaggcaatgagttttcctgctttagttacatgtctttaccagttctatggagtacagtttagagccactgttgcctggcctggagacaagcctatttttcaggaggaagcaagacctgcagatgctcaaggagctacccacaaagatggaggaagagctaaggaagatgaagacatggcgaatttggttgatgatttcattggaggagactcagcgccttag

SEQ ID NO: 51656 - DNA, 213 bp, Glycine max
  Peptide Sequence Number=SeqID_143341
atggttggtttgaagaatgatgatgagaaaaagaataaagaaggagctaaagaacaaaacaagaaaaatgatgaagtggtgactagtgaaaaagtggaagaaaaagtggcgttagagcagatgccaacatatgctaaattcatgaaggatttgcatatgaagaagaaaagaattatcgatgatgaaatagtgaagcctcagccacaacaatga

SEQ ID NO: 51657 - DNA, 411 bp, Glycine max
  Peptide Sequence Number=SeqID_143342
tcgtgtccttaccggttggactcaagacgatagttaccggataaggcgcagcggtcgggctgaacggggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 51658 - DNA, 669 bp, Glycine max
  Peptide Sequence Number=SeqID_143343
atggggaagaacaagggtcgtcaatcgcactcagctgcaaaccaaattatggtgaagggtactacctcaagttcaggtaaatcccaaacatctgctacttctggtctggttggttgcttggatgttgtccaagcaaatcagaatgcttatactgcttcacaggataatcttgtaggcaaggtgctcgtaaaaaagacagggacaagttctgcaaaaactgatgatgtcgcacaccaagtgtttgataatttgtcagaatgcagtgctgaatctgaatcttccccagaggtttcttgcaccttaggggacaatgattcaaccactgatgatgattcatctcactcctgtggctctaagtcatcaccgcagttagacaataataaggctcccactccttgggttaatctattcaaagataacagaagtcctttcaaaggttttggaatgaagttctcccctccaccctctgatgatgaagtgatgttggaagaaacggatttgcaacccctggaagaggcttggggacatagccttattggctatgtggctggtcgattcccaggaaagaaagctctgctggattgttgccaaaaatggggagtcaagttttcatactcaactcatgaaagtggttggctggtgtttaaatttgagtctgagacgatctga

SEQ ID NO: 51659 - DNA, 324 bp, Glycine max
  Peptide Sequence Number=SeqID_143344
atggatatgaatcttggatccttcatttcaagtcagattacactcatagcacagcatgactcctcgaggcttggctttcctaccctaatcactgctttatataaagcccggggagtccactttgattccttgacccatgagagcctgagtcctgccattaatttggcctacattaagaagaactattggaatcttgatgatccaacagtcacattcagaggtcccaggaaggccaaagggaagagatttgaggccacttccacaacaccatcagaggaaccaccaccttcttcttctacacttcctccacagagatcccaatga

SEQ ID NO: 51660 - DNA, 543 bp, Glycine max
  Peptide Sequence Number=SeqID_143345
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccgtgtaaccctctgaaggtgagggcgtgtagccctctcaaggcgaggacttatagtcctctggaggtgagggcgcgtagccctctcaaggcgaggacatgtagtcctctggacgtaagggcgtgcagccctctgaaggtgagggcatgtagccctacaaaggtgaaggcacatgaccctttgacggcgaggacgtgtagtcctctgaagttgaaggtacatgaccctttgaaggcgaggacgtgtagtcctctgaaggtgaag

SEQ ID NO: 51661 - DNA, 276 bp, Glycine max
  Peptide Sequence Number=SeqID_143346
atgcagctcccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccttactcggatgtctga

SEQ ID NO: 51662 - DNA, 228 bp, Glycine max
  Peptide Sequence Number=SeqID_143347
atggacagaggcatgacactaactgatgctcctagatctagcatggcattctcaaatttactgttcccaataatgcaaggggtgcaaatagcacccaggcccatttgggccctccagaagattcctccagaaggcggttgcttctggaggaagcaaccctgctcgcctgggcgagctgagctcgcctgggcgagctgggcggcaaccacctcccctattttgctataa

SEQ ID NO: 51663 - DNA, 165 bp, Glycine max
  Peptide Sequence Number=SeqID_143348
atggcgatgctcacgggtgcgctttccaaaggaggaaagatgcgcggagtcgccaccaacgtcgacaaaagcggggcttttgctcctacgtaccctcctttggagaggaaatcatacctacgtagttcttccttaagcgtgaatcaagtgattctctttacttga

SEQ ID NO: 51664 - DNA, 1249 bp, Glycine max
  Peptide Sequence Number=SeqID_143349
caagattgcagctgtggttggtgattcagcaaaagagttggatcgcacgaagcaaactcggaacggcgtagtgggcctgcctcggaaatacttggaaggtaaggcaagggatatggcgagccaagagaagtggggcccgtttgcagatattttagctttgctgatttttggggttgtcctcttcccgaacgtcgacggtttggtagacttagccgccattgatgctttcctcgcatatcaccatagcaaggaaagtccagtggtggctatcttggcagatttgtttgacacctttgaccggaggtacacccgtgtccgcttcaaagctatcgctcatgcgccgaaaaaggaaaagtcgattggggaccaacatttggctgggatagggggcagcgcgatcaattggtttcctcgttggaaggaaggcaaggaaggagttcttttctcgtgtggggactaccctaatattccattgatagggactagggggtgtattaattataatcctgcactcgccataagacaactagggtaccccatgaggggagcgccaaccgaagaaagtctctcgcctttccttgtgaggaatctaggcgcacaaagtctcaaggcgatacaaagagtccacaaggtgtggagaagtccgttgaggaaagacaaggagcttaggggcatccgtaatggcgtcatcggaggttatcatggatggctaagaattcacacgcgggggttagattggctctccaagttgaaagttaccgatgaggaggacttcgaagctccagaggaagatgaagaagtccgagctctaaaattagagttagggaaggcaagactcgttaaggagaagttcaagtcagctgctacacacatccggaaggagtgcaccgagttacaagaggagaacgcggccactgcaaaagcccttgaacaagaaaccaaaagggcccgcaaggaggaatatggtcgagagaaattccaaggagcattgtggggtagcaacaatgagctcaagctccgaagagaggagagagattggccacgggtgcatggcatgatcttaaaagaagagttagttgcttgcgcgaggtccaaaagaagtttggctcaacacttggaagccacggagcaaagcatgctaactatcatagggcaatacaaggaagagttgaacctgtctgtggcccatgaacaaaagctagtggaggattttgcacaagtgtacgccgaaaaagaagcaagagggagg

SEQ ID NO: 51665 - DNA, 135 bp, Glycine max
  Peptide Sequence Number=SeqID_143350
atgactaaagcacgccaaaaggggctacgaaaggaaaagagggagaagcttgccacccaagctcgcccaggtgagctaggttacttcctccagaaggcaccggcttctggaggacatcctggaaggcccaagtag

SEQ ID NO: 51666 - DNA, 494 bp, Glycine max
  Peptide Sequence Number=SeqID_143351
gatcccacccgaatgtggatgggttggtggacctggcagtgatcgacgcttttctcgcctatcataaccacaaggaaagctcggttgtcgctatgctagccgacctatatgacaccttcgaccgaagatgtgaaaagagcaatacaaggattgtttgctgtactccagctctttatgtatggttagtttcacatctttttcgccaagaggtgaggcatgcttgcccgctagaaagccaccattcatgcacggagaaaggaggggcaaattggtaccaactcttagcaagcaaagaaggagcatctgtcaattggttccctcgatggaaggaaggaagaactagggttcttatttcatgcggaggatttccaaatgttcccttaatggggacgaggggttgcatcagctacaatcccgtgcttgctataagacaacttggctaccctatgagaagggcgccactagaggatgagctcgcgcctatcatttcatga

SEQ ID NO: 51667 - DNA, 420 bp, Glycine max
  Peptide Sequence Number=SeqID_143352
aagctcctggctaagaagacgaagaagaagctggaggaagctacacagtcaggaagcgttgatggcatgaccgaccctccatcccccgtcagacgccacgtgaagtggaagatggcccacatgaagaaaacagaggagatgaagactaaggccgcaaaggaaaccgttgagaagatctgcccttttgcgggcgagcgaggcgaggctcacgggtgcgctttccaaaggaggaaagatgcgcggagtcgccaccaacgtttatttgtggaaaacatcggaaaaaccgaaggaaaccggtcaaaaagaatattccaagttcgggagttgtatttacgtttgaggaaggtcgacaaaagcggggctcttgctcctacgtaccctccatcgaagaggaaatcagacctacgtagttctttttaa

SEQ ID NO: 51668 - DNA, 324 bp, Glycine max
  Peptide Sequence Number=SeqID_143353
atggatctcattgaaaatatggttgcaagtgacattgctattctgagagatagagcccacattcctaataagataagcttattggagctaacctcacaagatgcattgttggcacagaacaagttgctatctaagcaactggaggcattgactgagacactaagatgtacaatttgtggaggagctcatgaatctagatgttgtatccctaatgaagaacaagtcacacatgaagtcaattatatggggaaacagcccagaaacaattttaatgcgggtggatttttcggattccagcatggacaacaatacaacttacaatag

SEQ ID NO: 51669 - DNA, 1215 bp, Glycine max
  Peptide Sequence Number=SeqID_143354
atggctacctcaccaaaagaaacttccgcttctggttcacccgctgtaccatcatctccgcaccaggaacaaccggaattcaacattcaacccatacaaataattcctggtcaagcttcagtccctgagaaactgattcccagaagacaacagggggtgaagattgctgaaaaccctagccctgcaacaagtcctagggaagtagacacggagatggacaagaaaatccgcggtattgtgagtagcattctgaaggatgcttctgtgcctgatgctgagaaagatgttccaacatcttccaccccagatgtttctgtgcctgatgtcaataaagatgttccaacatcctccgctccaaatgctgaagccctcccttcacccagtgaagaggaatcaacagaagaagaggatcaagcctcagaggagacccctgcaccaagggcaccagaacctgctccaggtaacctcattgacttggaagaagtcgaatctgatgaagaacccattgccaacaggttggcacctggcattgcaaaaaggttacaaagccgaaagggaaaaactcccattaagaggtctggaagaatcaagactatggcccagaagaagagcactccaatcactcctgccacatccagaagaagcaaggttgctatcccctccaagaaaaggaaagaaatttcctcatccgagtctgatgatgatgtcgaactagatgtctcgacatctaagagggccaagaaatctggaagaaaggtgcctggaaatgttcctgatgcaccattggacaacatctctttccactccattggcaatgttgaaaagtggaaatatgtatatcaacgtagacttgccttggaaagagaactgggaagagctgccatggattgcaaggagatcgtggatctcatcaaggctgctggactgctgaagactgtcagcaagttgggagagtgctatgaaggcttagtcagggaattcattgtcaacattccctctgacatatcaaacagaaaaagtgatgattatcaaagagtgtttgtcagaggaaagtgtattagattctcccctgctgtgatcaacaaatatctgggcagacccactgatggagtaatagatattgatgtttctgagcatcaaattgccaaggaaatcactgcaaaacgagtccagcactggccgaagaaagggaagctttcagcagggaagctaagt

SEQ ID NO: 51670 - DNA, 360 bp, Glycine max
  Peptide Sequence Number=SeqID_143355
atgggatcgagtcaggcgccttcgctaaaaaaaaggttctatcaagtcaaggtcaagagcctaggagtcaccagtctgaaagagttagggcagttgatgggtcaactccagcgacaagcctttcgcaaagcttacggtaaaatatgggacctagccatggcagaggtctccaaagaggtcattgcctccctcgcccaatattatgaccagacgttgagaggggtcctctttccgaatgtggatgggttagtggacctggcagcgatcgacgcttttctcgcctttcatgaccgcaaggaaagcccggttgtctctatcctagctgatctatatgacaccttcgaccgtgggatcctctag

SEQ ID NO: 51671 - DNA, 288 bp, Glycine max
  Peptide Sequence Number=SeqID_143356
atgctctggctccatgagtttgacttagagatccgtgataggagctgtcgcaacgtgcccttcacgggcgagcgagggcgaggctcacgggtgcgctttccaaaggaggaaagatgcgcgaagtcgccaccaacgtttatttgtggaaaacgtcggaaaaaccgaaggaaaccggtcaaaatgaaaattctaagttcgggagttgtatttacgcttgaggaaggtcgacaaaagcggggctcttgctcctacgtaccctccatcaaagaggaaatcagacctatgtag

SEQ ID NO: 51672 - DNA, 348 bp, Glycine max
  Peptide Sequence Number=SeqID_143357
atggcatttgaagaggagaaggtgaagatcaagaagttcgatgacagacatttcaacttttggaagatgcagatagaggattatctgaagatgaaaatagaggattatctatatcagaagaagttattgacattagccaagaatgtcgcgttcaacattgtaaacgagaagagtgcaggcttaatgaaggcgttatcaaatatgtacgagaagtcatcgatagccaacaaagtatatttgatgcgtcggttgttcaacctcaagatgggagaaggtatctctgtaactgatcatattaatgaatttaatactattgttgcccagttggagtcagtgcagattaattaa

SEQ ID NO: 51673 - DNA, 423 bp, Glycine max
  Peptide Sequence Number=SeqID_143358
atgcagatgaatatgaacttgggatccctcatccaaggtcagatttctctcgtcgcacagcatgactcctcgaggctaggttttccagcccttatttctactttatgcaaggcccgaggagtcacatctgattctctgacctttgaatccctgagcccagccattaatttggcttatattaaaaagaattgctggaacctggatgacccttcgttcacttttcgggaaacccgcaaatctagggccagaggatctgaggcaccatctaattcagctcccctacctcagctccttctacatcagttccttctacctctcctctccctccagaatcagcaactccagttcttccggatccttcttctcagagctccgagctattcttttctatgttgcagagcctgcatcagggccagctcctga

SEQ ID NO: 51674 - DNA, 332 bp, Glycine max
  Peptide Sequence Number=SeqID_143359
gactgatagaggcccgtaaccagagctggaaaccccagggccctgttggacttttccgggtccactgggtgtcttgtggggggagattggcgttgcggtcgctgggcagaatgttgctaagtagcaatgtcatctatatctgtgtaagagtggtcatgttggtgcgcatgatccgcactcgtctctttgcaacggcacgggtgaaatcttgccccggtatgcatagtagctgtgtaatagcctccctctctggttgtgctcgcacagttggccctcctccaatatcagggcgtggcccaggaaccgttaaaaggaaactactggccccttaa

SEQ ID NO: 51675 - DNA, 651 bp, Glycine max
  Peptide Sequence Number=SeqID_143360
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggtggatcatcatgtcatacatggcaagacacaagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 51676 - DNA, 183 bp, Glycine max
  Peptide Sequence Number=SeqID_143361
atggcatatcttggaatctgcttgatggcatctagcagagtggatgtaccctccactagaactgatccacaagagatgtaccctctcttgttctcagtcaacaacccaagtagatgtaccctctacttgtaccacaaaggatgtaccctccaatgtgttaagacaaagatctcaggcagttaa

SEQ ID NO: 51677 - DNA, 147 bp, Glycine max
  Peptide Sequence Number=SeqID_143362
atggtggtgtttgagtttggcagtggtgttgggtggaggttgagtgtggtggtaatggagatttgggacagaggacccaatatgaaatcagcctcttcccccaaacaaacaaacacacaaattagcatacacctcggccttgagtaa

SEQ ID NO: 51678 - DNA, 1986 bp, Glycine max
  Peptide Sequence Number=SeqID_143363
atggatactgccgtggagtcaatgcatcaacttggatttgggaaacaactagttccagaaatgcttaaggagcttctagatgtgtatggaacttcaggatggccctatattgaagaggcctcttacaagctcctaatcgaagccatacttaacaaacaacaaggttctgcagaagataaggaaggtgttatcaatgagacatcatcagctgggatatctgaagttggctcttctggcctagtggctgaggacactctaatattgcatgctagtgatgtcattctgttgtgcaagctgatagaggaggacatgaacaattatagcgcatttgtcaagactccaacgattcaatcttccgaagcatttgatcattttttatgccacaagggtaaaggttactatggattgattggtaatggtagccaagatgatgatgttgaacttatccactttccagttgcaccattacatagacaaattgagaagatgcttgggcagtatatgctccttcgtcttttcgcgggaatctcctcgttcccctgtcgcgctgcacctcttgcttggaacttgatctccgtattcagcactccgaagtggaattcgtttcgttttccgtttgttactgatttggcttcaaatgctgatgcggttttgaactggaatggatcgagcaggaggagagtgattgcttgtagtgttactgagccacataatggtagcgacgagaaggagaaagaagcagataaaaatggagaaacactacctttggaagattcctctgagcaaagtatccctccacctgtagatgcagaacaaataaatgagtttagtgatgaaaataaaggtcaaagtgatgtgcagaatatggatgatagcaatgaagttgccagtggatcacctctgccaggtgtgaagcctcagaaactggatgaagcaataaaaattcccaaggaaacaattgaaattcttaagaaccaagtttttgggtttgacacttttttcgtaactagccaagatccttacgagggtggagtgctgttcaaaggaaacttgcgagggcaagctgctaaaagttatgataaaatatcgaagagattgaaagataaatttggagatgaatacaagcttttccttttagtaaatccagaggataatatgccagtggctgttgtggttccaagaacaaccttacaaccagagacaactgctgtacctgagtggtttgctgctggatcttttggactggatggcctacccggagcccttgttactgcacttattctgggggtacatgaacttggtcacttcttagctgccaaagacactggagttaaacttggggtcccgtactttgttcctagctggcagataggctcttttggtgccattacaaggataagaaatatagtacccaatcgcgaagatctgctcaaggttgcagctgctggaccaatagctggctatgccttgggtcttttgcttctgcttctaggttttatcttgcctcccagtgatggtattggtgttgttgttgatgcttctgtgtttcacgagtcgtttcttgctggcggtattgcaaagctgcttcttggtaacgttctcaaggaaggaactgcaatttctatcaaccctcttgtgatttgggcttgggcaggactcctcatcaatgccatcaacagcattcctgcaggagagcttgatggagggagaatttcgtttgccctatggggaagaaaggcttcattacgcttcacaggggtttcaattgcgttgctgggagtctcgtcactgcttaatgatgtagctttctattgggtagttctgatattcttcttgcaaagaggtccaattgctcctctttctgaggaaataactgatcctggtgagaaatatgttgctattggagtaacagttttactcctaggtttgttggtatgcttgccatatcctttcccatttacagaagaaaccctcacaagtttctag

SEQ ID NO: 51679 - DNA, 130 bp, Glycine max
  Peptide Sequence Number=SeqID_143364
atgcggaaaggaccactggaagaaggaggaactaaggccattgacagtgttgaaacactcagaacttgaggcgctaagcgagcaactaactggaggcgctgagcgtggcggaaaccgttacgcgcgctaa

SEQ ID NO: 51680 - DNA, 606 bp, Glycine max
  Peptide Sequence Number=SeqID_143365
atgaatcggagcttcagagcggtggaattgcaaatgcaagacgcgtttaatcagaggcggcaccaattggcggctctcaggtcctcctctccgcgcgtcatggacagggacgacgagctcgctttgttccttgaaatgcggaaccgcgagaaggagcgcaacgatctcctgctccgcgcagcagaggatttcgacgctgcagcaccattaggctctgatccgggaaattctcccttgtttaacgttccgccggctgcgtcggctccggcgaggaagaccggtgctgatgattttctcaattcggaaaatgataagaatgactatgactggtactacgtagcactctttgtcattggcctatatcagcaatacatccatgggacttgggaaagttatgtgatatggacccaggcactaagctattcagaactcgggcttctaaccccacctgggactccccttttcccttctttggagatggaaacatcaaaaactgttatgagccagcttggggctccaactgtccgtcccacaccattaaaagctcgaatgttgtctttggcatctggttttaattcgttaatgaaattgtacatctccttgtaa

SEQ ID NO: 51681 - DNA, 258 bp, Glycine max
  Peptide Sequence Number=SeqID_143366
atgacgtccgtcacaaggtgcagatcatgcaccacctcaccggcgatcggacgacgaagagcgcaagagggacgtgatggcggagatggtgggcactttaagtgtgtgcatgcccttggtcctccctcgcatatctcaaaaaccccctatatcggacgcaccaccttatcttcgcacggtgagagacatggagccctttctcatgctagacgcgcccctagttggcttgcaattgctcttagagcatctttaatgtaa

SEQ ID NO: 51682 - DNA, 900 bp, Glycine max
  Peptide Sequence Number=SeqID_143367
atggctatcaacaacggtgctttagctgaaatggaagttcctgagtcatacttggaaacgcttcctaagaatggaagaagttgcttgggggattttatttaccattacatcacatcagagaaattctctccagagtgcctgcttgattgcctagacctctcctctgaacatgttgcactagagattgcaaaccgtgtggaagcctcaatatacgtgtggcggcgtagaagagctcactctaaacccccacctaatcctaatcgttcaactacaaagtcatcctgggaaattgtcaaggacttcatggctgatggagataagagagagctattagcagaaagagctgaaaatgttctactttcattgaagcaacgattcccgggtctaactcaaactaccttggataccagcaagatccagtgcaacaaggatgttggaaaatccatactagagagctattcaagagttttggagagcatggcatttaacattgtggctcgcatagacgatttgctatatgtggatggcttaactaaacattcagataggtttccactggttccaatgacagtgtctgtctcaggcactcctcacaaagcaattggcggcacaccaaaaagcttttcacctgcaccaccactaattagtcctgcaaggggagagagatctcctttcctccgcaacaaccacaacaacatcaaacctcaatgtcgtggttttggggtcagaagagtattgtcaaattatctcggggcagaatcgaaagaaacaaagattgtaagcaattcaactgtgatgaatggttcaaacccaagcagcaataaagcagaacagccagaacgtcaaaagaagtcacatgccatgaatggcaagacaaaactgactagtgaggttgtatag

SEQ ID NO: 51683 - DNA, 738 bp, Glycine max
  Peptide Sequence Number=SeqID_143368
gaagagcatgatcaaatcagagccaagaagagttgcccagaggcaccactggagtggacagattataagtcaatggcatttactcaatgtgttgtgaatgagactttgagggtggcaaacataataggtgcgatattcaggagagcaatgacagacatcaacataaaaggttacactatcccaaagggatggagggtcgttgcttcatttcgtgcggtacatctaaaccctgaccattacaaagatgcccgcaccttcaatccatggcgatggcagagtaactcagaagcaagtagcccttcgaatgtatataccccttttggaggaggtccacgtctatgccctgggtatgagctagccagagtggtgctctctgtcttccttcaccgcattgtcacccgttatagttggtttccagcagaagaagataagttggtgtttttcccaaccactaggactcagaagaggtatcctatcatagtgaagcgtagagaggagtccagactaaggggttataggaaggaatgtcttattagtagaccttgggaagggattggaaatgaggatgtgaaagatcgaaccccctatcaccctaataaatcagttgagctaaatccacctgtgtatatgatcttaatcaattcctacaaatcctttcacgtatatcataataaatcaatggcgaaagtttgtattaaaataaatgagattggacatgaagcccttgttgacccttga

SEQ ID NO: 51684 - DNA, 1383 bp, Glycine max
  Peptide Sequence Number=SeqID_143369
atgggttacaacattgcaacatacaacaaatacaaaagtttattgttctttatcagaaattgcaagttcaccaagctgcttacacctgtcaccgagctgcttccacctcaggacctcatggaggcatattcaaagttcactggaggagggtcctacatgtccgcgaagcagctccaccgtttcctggaggagcatcagggcgcgaaggaccacaccttaacggatttggaaaaagttgttgagaaggttttgcaagtgagaaagacatgtcaagaaattattaatgttgatcaaaatagagaacaacaaatcacccatgacgagctcttccattttttgcttcatgatgatttcaatggtcccttgatagctaaggacaacaaggactgtagtacgctaaatgaaagtgaatcatctgaagaagaatcaaagggcaaggaatctctaaactctagtaggaaaaaagtggagactgaggacacgctgaatgacagtgatcgtgatgagggaaacggttgtctaaaggataaattgaaaacagacggtgaacttcgacgccaaagttggagtgagacaacccatgaaaaggcttcagaatctcatggaacagatattgttaggtacttgccaagcttaactttcaagtcatcactcaacacttacactaggcctaggtatttattccatgacttatctgattcaagttcttactcttcccaggttcacacagaaaaatatcctcagggtgtatccaagggcaatgcgggtcaaatcctcaaatttgaagccacatattgggtggatgtatggggttcagatggttgcattcaatatgcagacaagcccattaagttcacttgcaacttgcaagggatgttcagggcaaatggaggatgtggttatgtaaagaagccgcaaattctaatgcagaagcatcaatgtggcaatgagtttgatcctacatggatactgacagtgaagaagacattaaaggtaaaagtatacacggggcatgggtggagcttagatttcagtctcagttctacacactttgataactgctctccgccagacttctacactgagaagaaaacaaaggttatgatgaacgactcgtttcctgtttgggatgaagaatttgaattctctttaactgttccagagcttgcattgcttctgatacaagtaaaggacaaagatcctggaaaggatgatttttctggacagacatgtttgccagtgtcagagctaaaacatggatttcgttcagtccttttatataacaaacagggagagaaatttaaatctgtaaagctgttgatgcggtttcagtttgaattaattgtagagaatatagatcatccagtaccttcatatctctaa

SEQ ID NO: 51685 - DNA, 207 bp, Glycine max
  Peptide Sequence Number=SeqID_143370
atgatgagggccaccatgacgcgagcagctcagcagtctagcatggcagcgatgccgacgaccaccatgacgcgagtagctcagcgagagtcattttcaggggtgagtagcttgaataaggcagaactcgcgagtctaccaaaactcgtccgagtctacgcaaaatcggacgagtctacttcgatttcgattttgcttccgatttaa

SEQ ID NO: 51686 - DNA, 1890 bp, Glycine max
  Peptide Sequence Number=SeqID_143371
atgggcaccgtcacctacagctacaaaatgttcaagtacttcaatagaaaattcgccgtctccgagcaggcccctccgccggacgtcaaggaggccttctccgccttctccgacgccgctgccgcatccatgtccgccgaccagctcctccgcttcctgcacgatcaccagcgcgaaacggactgctccgctgaggattccaaccgcatcctcgacagcatcattcaatcgcgcaaacaaaacgacaccaatgccgaatgcgaccaccacaccgacaacaacaacaatggtctcagcctcgacgagttcttccgtttcttgttcctcgtcgatttcaacgatcccctcaaatcccaggtacatcatgatatgaatgctccgttgtcacattatttcatatatacagggcacaattcctacctgactgggaatcagctgagcagcgattgcagtgatgtgccaatcataaaggctttgcaacgaggtgtgcgagtaattgaactagatttatggccaaattcaactaaagatgatatcgacgtagttcatggaaggacacttactgctcctgtctcacttatccaatgtttaaagtccataaaagagtatgcttttgttaaatctgactacccagtcatcataactttagaggaccaccttacaccattccttcaagctaaagttgcagagatgatagctcaagtatttggagacatgctctattttcctcaggcagattctctgacagaattccccacaccagaatcgttgaaaggtcgaattcttatatcaaccaaaccaccaaaagaatatcttgaatccaagcaattcaaggatagtgacagtgagagggaatcaactgaagaaggatcattatccccatgtgttatccctgaattggaggctgttgatgagaagttaaatggaagtgatcttgatgaggaaggcttgaatgctcgtgataaaaaatcagaccaacagagtgcacctgagtacaaacgtttgattacaatccatgctgggaagccaaagggtcatgtaaagcaccacttgaacaatgttgggggcgtgaagcgcttgagcttgagcgaacaggaacttgaaaaggcttctgctacttatggatcagatattgttaggtatcctactcagtacatagtagtgctaactgcaaatattttcaacacttttatagttgacaacctctcaaataagatagatgcattttatgcttccagatttacacagaagaatattatcagggtgtatccaaagggaacacgtgttacctcctcgaattacaggccacatataggatggatgtatggagctcagatggtggcatttaacatgcaggggcatggaaaatcactctggtacatgcaaggcatgtttagagcaaatggcgggtgtggttatgtgaaaaagcctgcatttctaatagaaaaaggtccacataatgaggtttttgatcctaaaagagcattgccagtgaagaaaacattgaaggtgaaagtatatatgggaaatgggtggagctcagatttcagcaaaacacactttgattccttctctccaccggacttttacacaaaggtttgcattgttggagtaccagctgataaagccaataagaagaccaaggtaattcaagacaactggtttcccgtctgggacgaagagtttgaatttcccttgactgttccagaactagctttgctccgaatagaagttcgagaatatgataagcatgaaaaggatgactttggtgggcaaacatgtttgccaatctctgagttaagatctggtttccgtgcagtccctctatttgatcagaagggcgagcaattaaaatctgtaaagcttttaatgcggtttcagttcaaatga

SEQ ID NO: 51687 - DNA, 1047 bp, Glycine max
  Peptide Sequence Number=SeqID_143372
atgggggtgaatagtagtgtcatgggtgagaataacaactccctttttgagctcatgaggcccaactggcaagatgaagcctcaagtgttatcagcagaacaatagctggctgccatgcaaaaagggttggagcaaatcaaaggggtgatgtgtggatgaattttgtggggcctgataggaatgaaatgagaggatgcaatgtgaaattcagagggaagactactcttgattttattgtgggtgagttttgcaagaaacgcttctctgtggtcttccttgaaaatgtagacaaggctgatgtgttggttcaaaatagtttgtcccaagccatcaagaccagaaagcttattcactcacaccgagaagttggtgtaaacaatgcaatatttgtgacttctttctctggtcaccaagcaaaggatccttacaactattctgaggaaagaatagcaaaggtaaaagtgacgcctatcaaaatagcagttgaacatgtgagtggagacatcagaagccaaagagttagtgtggctgatggttcaatagagagaatttccaatctagttttagtaaatgaacacacggctaaaacagcacacacaaaatcaaattggtatttagatttgaatcttccagctgaagacactgaaatggaagatggaaacttggaacatgcctcaactgagaaccaaaacctttggttgcaagatttgtatgaccaggttgatgaaacagtggtttttaaaccttttaattttgatgaacttgcggatagagtggtgaaagttatgacaagtagcttccacaaaactattggatcagagtgtgcattacagatagtgtcagaagtcatggaccaattgcttgcagctgcatatgtctcagacagaggtaaagacaatgaaaattgggtagaagaagttctctgtggaggatttacagaagtacagagaaggcacaaccttactgctagttccattgtgaaactttttacatgttcgcatcaagcatcaagtgaataccttcttccaagtattacaatggaatga

SEQ ID NO: 51688 - DNA, 333 bp, Glycine max
  Peptide Sequence Number=SeqID_143373
atgacaatgacaagggtagcaagtggtggtggtggtagtgatgacgatggtcgggttgaaatagtagcaacaatgatgataacagtaacagtagtagtggtgaaatgcgacgacgacaacagtagcggtggcgatgataataacggaggtgtggtggtgatggtggaggtagcaaaggcgaggtgcggtggtggtggaatgatgggagcgacagtgacgatgacagtggcagcaatgaccaagtgtggtggtggttgtggtgacgatatggatagtgacagtaatggtggtggtggtatggtgatggtggctagaatgtattttttaaaataa

SEQ ID NO: 51689 - DNA, 1020 bp, Glycine max
  Peptide Sequence Number=SeqID_143374
atggcgtcttcagctcaagtgccaaacctcttcggcagtgccacctcagctctgccgccaaccccggcggcgcaccacgacaacatcatgtcctcctccgacgccgccgacgcgctctcctgcctcctccaccgcctcccgcccacgctctcccttcccacgcgcctcccctcgccttcctccgcagccgccacgtctcccccctccctctccctaaacgacgtattctcctgcgtttcaaaactcggttacgcgcaactcaccgatcactcagtcccctccgaactcgccaactcggccgagtcggaagcgcttgccctctttgacctttccaaagaacagaagaactctctctttcccaaaaactggcctctcggatacggcggcgacgacgaagacgaagacgagctcgccgagtcgttccgcttcgactcggcgtgttcgaccgagtcgaacgagttggcactcttttccctgcgcaagtttgcgcgcgaactggagatgctgggtttaaagatcgttgatgggttaacaaaaggacttgggtctctgtccgggaacaaatcgggtgggttttacccgtttgtaatcggattgcagtaccagataaggaatctgaaatactcattgctgtcggattcgggatgggtttctgtgctgccacacgtggactcgattttggtcactgttggtgacattgctcagatgtggagcaatggcaagttaaagaaagtgagaggcagaccaatggccacagtgggagatgaaaatggttcacgctgcataacaatgtcattgctgataactcttccaacagatagcagagtggctccactccttcccaaggcaacctgcaacaaggaacaaaaggaagaagaagttgatgaagaaagcaatgatggtggtgaagaactagagaagagggtgttcaactcttttgattttgaggactatgcttggagagtgtaccatgaacgcatcattttcaaagatccattggataggtaccgtgttgcttag

SEQ ID NO: 51690 - DNA, 819 bp, Glycine max
  Peptide Sequence Number=SeqID_143375
atggaaagttactactattctggctggcctctggctcaattcaactctgcaccaaacagtgatcaattatctcctttttcagtcccaacaacaacacaacaaacactccctcttgttgctacttcaacttctgaccgtgcagcagcagcctctcttcaatttggtgagttcccttcgtggcctgcccccattgcagcagaagatagagctgcaagtgcttccaagagccacagccaagcagagaaaaggcgcagggacaggattaatgcacagcttgcaactctcagaaaactcattcccatgtctgataagacaagaagcaaaaaagtggaattgatggacaaagcaacattactagggagtgtggtagaccatgtgaaagatctaaagcgaaaagccatggatgtcagcaaagccattactgttccaactgaaactgatgaagtaacaattgactaccaccaagctcaagatgaaagctacacaaaaaaagtgaacatattaaaggaaaacatcataatcaaagcttctgtttgctgtgatgatcgaccagaactgttccctgagctcatccaagtcctcaaagggttgagacttacagcagttaaagctgacatagccagtgttggtggcagaatcaaaagcatattggttctttgctcaaaggatagtgaagagaataatagtgtttgccttagcactctcaaacaatcacttaaatctgctgtgaacaaaattgcttcgttatccgtggcaacaaattgtcccactagaagtaagaggcagaggttcttcttgccttctcattacgtacaataa

SEQ ID NO: 51691 - DNA, 150 bp, Glycine max
  Peptide Sequence Number=SeqID_143376
atggagttgatcacagcttcggctagggttcagaaacgaaaaagggttcggtgttctgttcgcgatgagagccaagtggaagaagaagcgtatgaggaggttgaagaggaagcgccgaaagatgagacagagatccaagtagtgcgttaa

SEQ ID NO: 51692 - DNA, 405 bp, Glycine max
  Peptide Sequence Number=SeqID_143377
atgaagggttatgagccacgttcaagctcttcttgtgcagcttgcaagttcttgaagagaaggtgcatacccaattgcatatttgcaccttactttcgctctgacgagtgcaagaaattcgccaaggtgcacaaggtgttcggggcaagcaatgtgagcaagatcctcgttgaggttcctgaggaacagagagaggatacggtgaattcgcttgcttatgaggcggaagcacggcttcgggacccggtttatggatgcattggtgccatagctctgctgcaaaggaagatggtggagcttcaacatgaccttgccattgctaaggaccgtcttgctcgttatactgctgctgctactactgctactgctactaccaccacttctgatgccttgattaatggccat

SEQ ID NO: 51693 - DNA, 1257 bp, Glycine max
  Peptide Sequence Number=SeqID_143378
atggttgctattgcaaaaattatgaaagccactttggttttgcctacattggatcatgattccttttggacagattctagtgattttaagcaaatttttgactggaagaacttcattgaagttttaaaagatgatgttcaaatagtggaatctctaccaccagaatttgcaacaattaagccagttttgaaggctccggcaggttattacgcaggggaggtgctgcaattattgaagaaacacaaagtgatcaaatttacccatactgattctcgcttagtcaacaatggtttagctactccgattcagagtgtacgttgtcgtgccatgtatgaggggcttaaattcacagttccaattgaagagcttggaatgaagttagtaaatagacttagagacaacaacaccccttacattgctctccatttaagatatgaaaaggacatgcttgcttttacaggttgcagccataatctgactaaagaagaagccgtggagctaaagaaaatgagatataaagtgaaacattggaaagtgaaagagattgatagcaaatcaaggcgcttacgtggtggttgccccatgactccaagagaggttgcagtgttccttgaagctcttggctatccttatgacacaaaaatttatgtagctgcaggcatgatttatggtaaagatgaaatgaagtccctccgaagcaagtatcgttacttgctcacacactccactttagccacaaaagaagagcttctaccctttaaggatcaccaaaaccaacttgctgctttggattacatcatagcagtagagagtgatgttttcatttacagctatgatgggcacatggccaaagcagctcgaggtcatcgcgcatttgaagggtttcgaaaaactattagcccggacaagcaaaagttcgtgaggctgattgatcagttggacaatggtttgatttcttgggatgagttttcatcgagggttaagagcatacatgcaaataaaaatggaggtcctcatcatagaaaagttaatcgacaccccaagttggaagagagcttttatgcaaacccttatcctggttgcatttgtgagcgtcgtgagacaatgatgatgatagcattttggcaattggagctgcaaaagccaaataactattttgaattgtatattaaaaagaaatttattgagctaaatctcaatcttagacctcaagatcgctttaagttgaatgttgatggtgctcttatgagaatttag

SEQ ID NO: 51694 - DNA, 501 bp, Glycine max
  Peptide Sequence Number=SeqID_143379
atggctattgaagtgagaaatggtaaatggcaaggttcagttggtggcatagtttgtgtacctattgacaaggtttggaccttggtctctcaaactaaaagactacccgaatggatgccaatggtagaaagatgcagttccttggctggagatgacgatgaaccgggctatgttaggctagtctcgggtttcatgtttcctcaacaagatggagaaaggtcatggatcaaggagaggttggtttcactggactcatcatcacatagctatgtttacagaatggaagcaagcaatgtaggtctagatggatctgtaaactctctaaaactagttgactatggggatgaatcaactcttattcgctggtcatttgagataaaccctttagaagatgtatctgaggacaccatagtggattatctaggatttctctacaaatcttgcatcaataagattgagggtgcaatagaagcagcatcaagaaatgtttcaccaccatag

SEQ ID NO: 51695 - DNA, 1602 bp, Glycine max
  Peptide Sequence Number=SeqID_143380
atggctgcgacaatgcacgcaaagattaaccgaagaaagctagacaagctcaacatcatcaaaatttgcgaagagattctaaacccatcgattcctatggctcttagactttctggaattctgatgggaggagtagtgattgtctatgagagaaaagtgaagctcctttatgaggacgtgacccgttttctggttgagataaacgaagcctggaaagtaaagactgctccagatcctacattgctccccaagtccaaatccaaggccaaaaaagaggctgttactctgccagggaccggtgaaacgaacatggaagatattgaacagtcccttcagttttccaacacaggcaccacaacaggattccaacataacgcctattttactatgcgacttgataatgtggatgaacccttcactaataatggagcaagagaggaccaagatcaatcagaacttctccatcaagttgacgcagagaatattaccttatttgaacgctttgaaacgttccaagctaacacggatacatacaatcgctttgagaggtttgatattgaagaagatgaggaaacacaggtaaatgtaacttcaggagatcaaattctaaccacgcttgtaccctccccacctcatcaagacgaacccaccaaagctgatacgtttcaagaccatcatcctggacacccagacattcagcaacctagtgaaggcatgatacctagacaggaacctagaaggcgaggaccaaataaaaggaaaagaggacaaccatcggctattgaaatggattatgagcaaaccattattcctgctcacatatatcaacactggcttcagaatgcttctgacattgtctcgcgaaggggaagaaggaaaaagcaaaatgatgttatgtcttcaacaaagatagccagcctcatgaagctgccacccgttgtacaaattgatgatttatttactgctgtaaatgacaatatatattatccaaaacctattcttgacttatggattaagagcattcaaccacctcatgattcaccttcagactaccaggcacctccaatggagaaggctcgggaacatatcctcatggatgaactgacagctagccttttgagagggcatgaagctactcctcaggtctcatctgggaaagctggaggcagtgtacattcctttccaagaccgacgtctgaaaatggtcctgcctcacattcagattttgattcgggaagaactgttcacagattcaaaaataaaaggtattcatcatctgcaaacagcagtggaggccttgagccactagctgaagatgtaaatttcaagttagctagactgtatgaagatggtcccacacctgatcaagaactcctcgtggaaacaggacccactcaaacacaagtaaacatcaatcatcctagtgacaagataaccgattccatccaagcgcagatgaaggcacattttgacacgcctggagctcctccagtggaatcccttcatatcctagctgctggaatgacacggacatcagcagcacaacttttctatcaaatttgtgttcttgcttcccgcgatgcgttgaaggttgaccaaaag

SEQ ID NO: 51696 - DNA, 213 bp, Glycine max
  Peptide Sequence Number=SeqID_143381
atgatgacaattgttggaagtaatgggaatgatcatgccataacaatgcgggatgagaatgatgactataacaatggtggtgtcggtggtggcaacgatggtggtgatagtagtggtagtgatgacaacaatgtagtagtgttggagatatcaacaaccgccgggtgtgatgagaatgattatggtgaaatggtggcggtggtgatatggtga

SEQ ID NO: 51697 - DNA, 1962 bp, Glycine max
  Peptide Sequence Number=SeqID_143382
atgtctcactccattaattcagagttcaagtttgatcccaaggaaccctccatgcccatatcgtatccaataaagaccctcaaggagttggagtcacgctcctactttgagtcctttcattatccttttaacaaagcttcagttccaattgaaagtgggtattctgaacctttgccaaatcgtagaagaatactagtgtgccatgatatggctggagggtacttagatgataagtgggtccagggagggactaatgctgaagcttatgccatatggcactggcatttgatagatgtgtttgtctacttctctcataatctcgtcactcttcctcctccttcttggactaatacagctcatcgtcatggtgttaaggtgctggggactttcatcactgaatggaatgagggtaaggctgcttgtgataaactgctttcaacaaaggagtctgctcaaatgtatgcaaaacatttggcagagcttgctgctaatttaggctttgacgggtggctgttgaatatagaggtaacattgaagccggagcagatttctaatttgaaagagtttgtcaaccatttatcattaacaatgcattcttcagtgactggatcgctagtgatatggtatgacagtgtcaccattaacggtgatctatggtggcaaaatgaactaaatgaatataataagtctttctttgatatatgtgatgggatatttacaaattattcatggcaggaagactatccatggcgatctgcttctgttgctggtgatcgaaagtttgatgtgtacatggggattgacgtatttggaaggggcacatatggtggtggacagtggaatacaaatgttgctcttgatgtaataagaaaagctgacgtctctgctgcaatatttgctcctggatgggtctacgagactaagcaagcaccagattttaagactgctcagaatcgttggtggggtctcgtggaaaaatcttggggtatagtgcgaaagtatcatggaacactaccattctacacaaattttgatcagggacacggttatcatatctcagttgatggagaccaagtatcagatgctacttggtgcaatatttcttctcaaagcattcagccactccttgagtttgccgattctactgcaaattctattcaacttattgtagacttgaaggaagcatcatatagtggagggggaaatattacattcaaaggatctcttggagagggtacttacttaaagagaagaatctttcaaggacagtccattttagccaagttgcctatccacttcatttattctgtgaaatctgatagcaattcttcattgggacttgtacttgacttcacttctaccatcaacaaaacaacgcctgtactactcacttcccatggaatggatcatctgtcaagcgaatttagcaaagtagtcctaacaagtgagcacaagggaaatgcccctggatgggttatacatgaaggtacaattgaaatgaatggttacattctcactggaatccatgctttgtgctataggccaaatgctccttccatgaaatccagaccatttggtcctgatcatgctgtgccttcctcaactgattattttgctgttcttggtcacatcactgtcaagacttctaactataagccagattttccagtttctacttcctggctagttaatggtgaatgcatcaattggaaatctggtcctcaagattcaaggatcctaagtgttaaaatttcttggaaactgaaaaatggacagaatcttgcattttcacaccacaatgtgtatgtggagaaaccaccaaagttagcatatggtaatccaagcacaacattggaacctgtgcaggagtatcttggagtagcacatgtaaactgtttctatgtttctgagctcaaagttcctgctagcacttctagtctcaaattcattatacagatttaa

SEQ ID NO: 51698 - DNA, 243 bp, Glycine max
  Peptide Sequence Number=SeqID_143383
atggtggtggtttcccaccacgagctctacgttctcctgcacctcttcctaggtggtgtcattgcgacagatgaagacagagtcatcattgccgctgaaggcaacatcattgtcagggaggatcttgttgacatcccaggtttcacactcccagaggacctttcaggaaactgcattgtgcaccccgatggtggatttgtgatgaagggtttggaatggtgttggggtggttggggatgttga

SEQ ID NO: 51699 - DNA, 86 bp, Glycine max
  Peptide Sequence Number=SeqID_143384
atggatttgaatcctacgggtactcgcaaaagtatttgcaagcgggtagaatatttactgcttattggattggggatgaggacaag

SEQ ID NO: 51700 - DNA, 1764 bp, Glycine max
  Peptide Sequence Number=SeqID_143385
atggaatccctcagtcacggctgctcagggcaggctgatgggcctaggccaagggttcaattgtgggctttctttctggttctggaagaaaaaagtaactgggcgtattctagtatgatctctgaattaagaggaagtaaaggtgtcatctcatctcaacttgtgcacaggggtaacttgacactcgtactactgccaagttctgatcttcgtctctcattcattggggatgatggtagaacagagagattattcacccttaccaacaaatcccaatgctctgctgttgtggttgatgaaatcccaactgatagttctggccgatcgttccttgtaaggactccagatagcagagctttttatttctggtgctctgaaaagtctaagcttttgggaattgaattgcttggaaagatgaaggatttgctcaagaggaaaccatccattgttgagctgagtggcattagcaagtcacgacttgactgctttgcaactcagcttcgggcttttcttgtggggacaacaggaggcagtagtcatgatagttcagtttgtgcttcaacatctgctaattccatgtcttgctctaatgttgcttctgaaagttcgcacccttcatcttcaaaatttccccgatctcgaaacattggaggtcagacagcaaagggagatacaacactttaccagagtattcttagtccaagatcaagttcttttaaagaggttccaccaagaaacttgtcttctcacaggattgcagccagggagaaaattaagcgtcgtggtgacaatcatcagccaacggttgacaccttgacaaatgattcaacacacattttggatttatcttcaacttctgatcatgacaaagcatcagaagttaccaaaactcttgcattttcaccaagttttctgggatcacttggaaagcttggtggtgttccatcaagcctggggctgagtggggaggtccctcccattgtgtcacccattttttctccctattattgttggtgtcccccaggtatttctacctgtccttccattgcagcagttacgcaatccccaaactcatctattgaaacactgcctttcccctcaggtgcctctttattagccaatcctctatcggttaacttgttggatccagtacaacctctcggtacttccatggactttcctccttttttgcctgatccactggtcagaatgtccttgccaacatctcagcagattcccacattcacaccattaatgtgtgatccaattgttcatgtcccagtgattgacgtgtgctcttcaggtcagggctatcttgtgagtgctggccctgcaatgtcacctagcattccaccattgcatccaaaccttgtgaagccattgattcctgaatctgatgctgtggtgaagggtgcaagagagactctaagattgctacttagtggttcaagccagggtaaccaacagatgatgagggacactctgcctgcaattttaactaatccagacgaaaatcaaaacaatatccttgtggctggaagtcgtggtctttacactggaaccagagatattaatgctattgcaaacagcattgctgctatgggattagtatcactgtctggggtatccaaggtagacagtggagtctattcggagctatgtgaaaactatgggaatttggaagcagtgaaaaattccaacgattcaggtggtggtgcctttttggatgatgagggcggatcttctttggattcgaagcagtag

SEQ ID NO: 51701 - DNA, 741 bp, Glycine max
  Peptide Sequence Number=SeqID_143386
atggcggcgacggagcgcacggtgttgcagttctcttcttcgcagagcctctcggcgaaagttcaccctctcgttgtcttcaacatctgcgattgctacgtccgtcgtctcgaccaagcggagcgcgtcatcggaacgctactcggctccattctccccgacggaaccgtcgatgtccgcaattcctacgccgttccgcacagcgagtccgtcgaccaggtcgctttggatattgagtatcaccatagtatgttattatcccaccagaaggtgaacccaaaggaagttatagttgggtggtattcaactggtcttggagtaaccggtggtagtgcattaatccatgaattttattctcgagaagtacccaatcctatccatttgaccattgacactggattcacaaagggagcagttgatactctgaaggcaactgctgtcgacaaaatcccctctgatttagaagggatggaagcattaatgggacatctattggccttgatcgatgacattcacaaatatgttgatgatgttgtggaagggcgtattgatcctgacaacaaaattgggagatttatatcagatgctgtaggctccattcccaaattgccctcatcagcttttgagaagcttgtgaatgacagcttgcaggaccacttgctcttgctatatttatcaagcatcactaggacacagcttagcctggcagaaaagttgaatacggctgctcagattttgtga

SEQ ID NO: 51702 - DNA, 519 bp, Glycine max
  Peptide Sequence Number=SeqID_143387
atggagcattttcttgagcaagtagcccggcctgaagttcaacttctattagtgagacccaataaggctgctctacctgagcccacacctgtgcaagttgatctagagccaactgacccacaatctcgagtggtgaatccaccgtcttttcctgagcgtgaagtagttcccccatctccacctctaattgtcatctccgatgcatcatcagatgaagcggctgcccctcctgattcaccagctggagaaacagctgaccctcttgcttccccaattcaaaaacacattggagcgtacatcttttgtggtagaagtagagtgtacatctacttgggttgtaatattgagaacaagagagggtacatctcttatggatcagttcaagtggagcggacatccacttggttgttcacagagaacaagggagagtacatcccttgtggatcttttgcttgtaaaggattttacaaggttattggaattctcaagaatcggtggttgcttggggactggatgtag

SEQ ID NO: 51703 - DNA, 81 bp, Glycine max
  Peptide Sequence Number=SeqID_143388
atgaagaaagactgcttaaagtttaagagctggatggacaagaaagggtatggaaaacctaaggaggccagtgtgaagtga

SEQ ID NO: 51704 - DNA, 300 bp, Glycine max
  Peptide Sequence Number=SeqID_143389
atgaccacagatcgacctccactccttatggttcacatagacctagttatagggcctaatatctcaatgtgtgtgcggagttctcccctgttgagtcaccaactatcgcaacctacccttcggcgggggtgcaaaaaggccaaaatcgatgggccaaagcgtttgtctccaagggagaaaatgagcggagtcgccaccaacgtttattcgaggaaaatgttagaaaaaccaaaaagacgaaggtcagcggatttggaaaatgagggttcgagagttgtttacgcacggggaaggtattag

SEQ ID NO: 51705 - DNA, 966 bp, Glycine max
  Peptide Sequence Number=SeqID_143390
atgggattaataatcccacaagattatgctgaagaagttgcaaatcgctcgatcgaaggccagagagcaattcgactaacgcccaagaccttggatccaagctcacaaaagctgttcctaaagtatatgagggttttcctgagctttgacaagtttcttccccaacatgctccattcattagtcgagaagttggcccggcctggttcactgactatttccctactgtcgacccggacaatgaagaagaggtgaacgaaatatggtcattttacttgaatccacagatcctgtcttgtcgtacaggtgttcaatcgaactatttaggcctggttggataccagcctaatttggtttcaagacaatttggcctctcgcaaattcgtcctaaaagcttgttcgaagatcctcaagacgtcataagaggggccaatctttcggaaaagaccttcaagaagtttttgaagatttctcttgatgaaaactataacctgcatccttttgagttcaaccattcccacttctgcaccatggggcttgagagtggctttgcgcaaccaacgatcgagaatattcgctcaagccttcaagctcgaggcaaagcacccatgacgaagaggagtgctgaaacgtctcgagctgacgtgagacccaagaaacccactggggtgaaaatccaggaagggaaacaagaagagaaggaagaagaggagagacctctcataagaaaaagaaagttacctacgacttcgaccaaatctgctgaccaaacagaggcaggcaattcccaggctcaaatgcctaagaagaaaaagaaagtgaagcaggtcgagcctgaaccttctgtggctgtcgaggatggtgagccagccaagaagaaaaagaaaaagaccaagtcttcaaaagaacaaggtgacaatcaacctgttgacgtccaaccaccttcgaccgatattggcggcactgag

SEQ ID NO: 51706 - DNA, 319 bp, Glycine max
  Peptide Sequence Number=SeqID_143391
cttgggaggattgaatggggacccggtgttgagaggaacgaggataagggctacgtgggagtacgtgagctcagttggaggtgggcaacaggggatggtgggtttatacgtgatttgtggatatggagaattgttttgcaccatcgcccgaccgccacccagtaccacatgtgatggagtggtacctgcagatatgtcgcggggatcaggagaccttggggacatcaggcgagctcctggcagtcaacagataaaaggaacaaagaccacaaagcaaggaggcttgtgtggtggctggccagctgtgaaacttgattga

SEQ ID NO: 51707 - DNA, 339 bp, Glycine max
  Peptide Sequence Number=SeqID_143392
atgggtgaagtagaggagatacaagagaagatgaagaccgacatggaggccatgaaagagcgaatggccacgatgatggccatgatgagcaagaggaagataatggaagccaatgcggttgcaattgccgctaccaatatggtaggcaaagatttgggaagtacgggcggcccccatgatgtgcaaattcaaaacgagcgcgccttcccgccatatggcttgcctctcaactatacgccacccaatatggcgtacactcccaataagaatgtcaataactccactcctatacccattgagagccaacaaccccaaactgatcatgcacatgtctcttaa

SEQ ID NO: 51708 - DNA, 785 bp, Glycine max
  Peptide Sequence Number=SeqID_143393
aggatttctgaatgttcccttgatggggacaaggggttgcatcagttactatcccgttcttgctataaggcaacttggctacccgatgagcaccgctagaggaagagctcgcgcctgtacttacacgaggggcagtaacaatgggcccatcggtggctaccgtaagtggttgagagcccacgtgcgaggtttggattggctcccaagtttgagaaccgccaaaagggaggaggttgaggcatcggaggaagacaaagaggagaatgccgaactgagagatataaatatagctaccaccaaggccttggaacaagagaccaagagggctcgtagggaagagcacggccggaacaagttccgaggggctctgtggggcagcaatagcgagcttaagctccggagagaggaaagggaccgatcacgagtagacagtttgatcttgaaagatgagttgaaggtttgctcaaggtccaaaagaaacttgtctcagcggttatgcgagatagagaccaatatgctagccatcgtcagcaagtaccaagaagaactaaatctagccacggcccacgagcataaagtggcgaacgagtatacccaagtgtacgcggaaaaggaggctagaggaagggtgatcgacgcgttacatcaagaggcaacaatgtggatggaccggtttgctcttaccttgaatgggagtcaagagcttccccgattgctagccaaggccaaagcaatggcggacacctactccgtccccggggagatccacggacttctcaactatt

SEQ ID NO: 51709 - DNA, 344 bp, Glycine max
  Peptide Sequence Number=SeqID_143394
atgtcaggatttacacgtgattctcctcaaatttcagccagcccgcatcaattagactttgcaccttacgcttcaggcccctacaatgctcaatggaatgccacggggcttctccatgacaagcacacgttgcgtttgagtcgtattcttggagaaatggaggttgatgaacctcggctagggttatggctaccattgcattatcgagtggatatgggagcaagtcagtataggacaccggaatttgggtgggttttgtggtttgatttagggatggcctttatggataactgggtggtgggaaaggagatgggttgttattggttgagtaatgacattgttgg

SEQ ID NO: 51710 - DNA, 114 bp, Glycine max
  Peptide Sequence Number=SeqID_143395
atgaagatgctcttgataccacatgatatgaatggcagcggaatggagaaggaaaagagagaggatacgccacttcaaggagaagatgagtctagaagaagctcaccaccatag

SEQ ID NO: 51711 - DNA, 219 bp, Glycine max
  Peptide Sequence Number=SeqID_143396
atggcttgcacccaattccgatttacacgcgattctcctcaaatttcagccaatgctcaatggaatgccccggggcttctccatgacaagcacatgttgcgttcgagtcgtattctcggagaaatggaggttgatgaaccttggttggggttatggctaccattgaattatcaagtagatatgggagcaagtcagcataggacaccagaattggggtga

SEQ ID NO: 51712 - DNA, 249 bp, Glycine max
  Peptide Sequence Number=SeqID_143397
atgaagagatgcttacgtgatgcacgatatgaatgcatttatggacacgagagctcggaaaatcatctctccttacttgcacatttcaaggcgcagtgcctcatgtgtgttgttgaagtattggcgatcaaaattaccattccccagtggagtcgccaactgtcgcaacgtgcccttttgcgggcgagcgaggcgaggctcacgggtgcgctttccaaaggaggaaagatgcgtggagtcgccaccaac

SEQ ID NO: 51713 - DNA, 930 bp, Glycine max
  Peptide Sequence Number=SeqID_143398
aggattgaacgtcctcaccttcagaggctacacgccctcgtcttcagaggactacacgtcctcccctttagagggctacacatcctcgccttcagaggactacacgtcctcgccttcagagcactgcacgtcctcgccttcggaggactggacgtcctcgcctttagagggctacacatcctcgccttcagaggactgcatgttctcaccttcagaggactccaagtcctcgccatcagaggattgaacgtcctcaccttcagaggactccacgtcctcgccatcagaggattgaacgtccacaccttcagagggctacacgccctcgtcaacagaggactagacgtcctcgcattcaaaggactacacgtccttggattcagagggctacacgtccttgccttcggagggctatacaccctcgccttcagaggactacacgtccttgctttcagaggacaacgcgtcctttccatcagaggactacagtcctcaccttcagaggacttcacgccctcgccttcagaggacaacatgactacacctcctcgccttaggagggttgcagctcctagttttctgaagacttcacgtcctcgccttcagaggactacacgcgtctccttcagaggaatgaacgttctcaccatcagagggatacacgtcctcccctttaaaggactgcacattctcgccttcagaaggcttcacgtcctcgccttcaaaggactgcatgtccccgccttcaatgggcaacacgtccttgccttcagagggctacacgtcgtcgccttcagaggactgcacgtcctcgccatcagaggattgcacgtcctcgccttcaaaggactgcacgtccccgcctttagaggactgcacaacctcgccttcaaaggtctgcacgtcctcccctttagagtgaaattctga

SEQ ID NO: 51714 - DNA, 210 bp, Glycine max
  Peptide Sequence Number=SeqID_143399
atgaatctattgatgaagaagatcctaggcctacaagctctaatggagcttacatcacatcaagttggagaaagagagaacgctccatgtctgagcaatggtcgtcaggttcttcctgaggatcttcaatggcaagccgtcaacattaagctcaaatcctctccctgggatacagagcttggctgccaattcctgagggtcaggccttag

SEQ ID NO: 51715 - DNA, 282 bp, Glycine max
  Peptide Sequence Number=SeqID_143400
atggtagccataaccctagccaaggttcatcaacctccatttctccgagaatacgactcgaacgcaacggtgctcacggagaaggccccggggccattgacaggaggtaaagattatgcctttgctaacctagaagagttgttcctagtacccaatatcatcacccctcccaagttcaaggtgctggactttgacaagtacaaggggactacttgccccaagaaccatccaaagatgtattgtcggaagataagggcatacgcaaagatgaggaactgctaa

SEQ ID NO: 51716 - DNA, 138 bp, Glycine max
  Peptide Sequence Number=SeqID_143401
caccaaaggttgaagctttgtgtggagcttcaatggtgaatgaggaagaagagaatggcaacgatgttacagcttcaactttagtgtgggtggtggctgaacagtgggaggaaccaggggtaggagaagaagaggagg

SEQ ID NO: 51717 - DNA, 289 bp, Glycine max
  Peptide Sequence Number=SeqID_143402
atggcttgcacccacattctagtggaagcaaagatcgattctcctcaaatttcagccaaccagcatcaatttgaccttgcaccttatgctttagggccctacaatgctcaatggaatgccccagggctccaccatgataagcacatgttgtgttcgagtcgtatcctcggagaaatggaggttgatgaaccttggttggggttatggctaccattgaattgcataggacaccagaattggggctttgtggttgatttagggatggcctttctagatgactgggtggtgg

SEQ ID NO: 51718 - DNA, 216 bp, Glycine max
  Peptide Sequence Number=SeqID_143403
atgaggacgcgtagccctctaaaggcgagggcgtgcagccctctgcaggcgaggatgtgcagtcctctgatggcgaggatgtgcagtcctctgatggcgaggacatatagtcctctaaaggtgataggtactagtacccaagggtccacctttaggagaaagcaagagatcgactcatcgagagggccagtcatccaaaaagattggacacgagat

SEQ ID NO: 51719 - DNA, 150 bp, Glycine max
  Peptide Sequence Number=SeqID_143404
atgctgaatgctcctaacaacactccaacaagacacacagacgagcaagagaaggcccaagaggaaaatgagtccttagctggtatgaagggcaataagaaaaatcatcaagtttccttccctctgaatttctggaggttcctagcctga

SEQ ID NO: 51720 - DNA, 228 bp, Glycine max
  Peptide Sequence Number=SeqID_143405
atgtttgcaggaatgaaagttctgatgaccaatatgtcaacaccctatcatagaggaggtatgatgaatgcatcagggcatcttcatgctatgcgtgacaaatgcatttatctatggacacaagagctcggaagaccatctcttcttacctacaatgcattgggtatcatggttcatttgcagtcattaccatggtgcccaatgcttgcaattaagaaggtgatatag

SEQ ID NO: 51721 - DNA, 1203 bp, Glycine max
  Peptide Sequence Number=SeqID_143406
cccgacgagctggcgcgtatctatgcccgcgtgctgaacaaggccctggagggcaaaccggacgatttgaccatcgggctgcacgtctgccgcggtaacttccgctcaacctggatttcagaaggcggctatgagccggtggcggaagtgctgttcgggacggttaacgttgacgcgttcttcctggaatatgataacgaccgcagcggggatttcgcgccgctgcgctttgtccgccccggcaaacagcaggtggtgttggggcttatcaccaccaaaaatggcgagctggagaacccggaaggggtgaaggcgcgtctggaagaagcggcgaaatacgtggcgaaagagcaaatttgcctcagcccgcagtgtggctttgcttctaccgaagagggtaacagcctgagcgaagcccagcagtgggacaaaatccgtctggtgactcagatcgccagtgaagtctgtgcagcgctgtgccattctgagacgttctctttacatcctgcgcttcagcccctgcattcacgctttctccattctggcatcctttttgctcctgcttcgctgagacatttatttccgcgtccacgccgtaacggacgtcttcgcacagcgttctttttcaggagtgaaaatatgcaccgtcgtactttattaaaagcctttgcattgtctgcgtctgtcgttgctatgggaatgagttttggcgtgcaggcggccgataccatcaaagtggggatcatgcattccctctccggcacgatggccatctccgaaaccccgctgaaagatgtcgccctgatgaccatcgatgagatcaacgcgaaaggcggcgtgttgggtaagaaactggagccggtggtggtggatccggcctcaaactggccgctgtttgccgagaaagcgcgccagctgttaagtcaggataaggtggcggtggtgttcggctgctggacgtcggtctcgcgaaaatccgtcctgcctgtctttgaagagctgaacggtctgctgttctacccggtgcaatatgaaggcgaggagatgtcaccgaacgtcttctataccggcgcagcgccgaaccagcaggctatcccggcggtggaatacctgatgagtgaagacggcggcgcggcgcaagcgcttcttcctgctgggcacggactacgtctacccgcgcaccaccaacaagatcctgcgcgc

SEQ ID NO: 51722 - DNA, 90 bp, Glycine max
  Peptide Sequence Number=SeqID_143407
atgggctcaaaaatctaccctaaggattgcatcaccgtgactgacaagtcatcacgagtccagctcaagatgttaaagaagcgctactag

SEQ ID NO: 51723 - DNA, 825 bp, Glycine max
  Peptide Sequence Number=SeqID_143408
atggtatctcagaaaataaagtcccttgcttgttcatcttctcagatcagatatgatagacacaaattttcttccccagaggcatgggatcgttacacaaacaatatcttcggcataaagatcatacatgaaaggaatgtgcaattgtcttttaatgactttgaggaatgtcaaatggagttaaacaggaggaactggcataagaagatcgcaaatttggtagagggaagcatatatgtggcacttgtaaaggagttttatgcaaatgtttacgatcctgaagataagtcaccaaaacaggttaaagttagggggcaatggattccatttgacttagctgccctcaactcttttttggaaacaccagtggttatagaggaaggagaaagtcttctgacatatgaaatatttgttttcataaggccaaatcatcatgagttagtagcctgcttgtgtatcccaggcaagggatttgaattgaattcaaacggactgcgtatgaagattttaaggaaaaacttgactactcttgctcaaacttggagtgtcttttctttttctaacttggcccccacctctcatacttctgacatcaatttagatagggccaagttcgtatatgcactcatacagaagatggatatgaatcttggatccttcatttctagtcagattacactcatggcccagcacgactcctcgaggctcggctttcctgccctaatcattgctttatgtaaagcccagggtgtccgctcttattccttgacccataagagattaagtcctgccattaatttgggcatatattataaaaactactag

SEQ ID NO: 51724 - DNA, 309 bp, Glycine max
  Peptide Sequence Number=SeqID_143409
gcggaatttgaaatcccagaggtttctaacagtaggacgaaaaaagaagttacttcagactgtcggggagagatggaggcagatggtgtggacgacactgtctgtgagaaatacgggataagcaaggaaaaatgggcccagttttgccagactcgcagagacccttcttgggaggatgtgcggaaaaaggcacaggccatccagaaacagaacactggcccccacgttttatctcgtgggggttatgaatatttggagcagaagctcctagctgagaagaccaagaagaagttggatgaagctgcatag

SEQ ID NO: 51725 - DNA, 390 bp, Glycine max
  Peptide Sequence Number=SeqID_143410
atggagaggagtgtgattgatgctaccagtggtggagcccttggtgatatgactcctgctgaggctaggaatttgattgagaagatggcttccaactcccaacaattcagtgcaagaaatgatgctattgtccttagaggagtccataaggtggccatggattcatcttcatctgctaaaaataaaaagcttgagggaaaacttgatgccttggtctacctagtaactcagcttgccatgaatcagaaatctgcacctgttgcaagagtctgtggtctatgttcttttgtagatcaccatacaggtctttgtccttctttgcaacaatctagagtcaatgagcaacctgaagcttatgctgcaaacattcataatagaccccctcagtag

SEQ ID NO: 51726 - DNA, 461 bp, Glycine max
  Peptide Sequence Number=SeqID_143411
atggagcaaccagaatctaagtaccatgatgagtcacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 51727 - DNA, 612 bp, Glycine max
  Peptide Sequence Number=SeqID_143412
atgtttgtcgacccaaacaatgctaacacagctacattggctgaagttgcggagacattacagtatatggtgtcaccgcaaggaaggaacacatggacagtggatgatctcgtgccttatgtggagaagatcacgattttatcagaagagcaagagagaatgactgagccggcggcacatggtccaacatcagagcgtcgattcccaccgcagcagtttcacatgcttcagtcaagtgttgaaactcgcggttttgacagacgaagggaggctgtggaagcgcaagaatatgagaaacaaattgaggagcgtggccatggaatgtattacacgccaccaacatttgcggagtatccttcacagatgtatcagtatccattccaaggtcatcacactgatatgtctgcaagctcacattcgtttggtggtgttgcggaaacacaacctcatttttcatggctgactatgactcctacacagcaacatgatgccccaatggtgacacctgacgccccattagctccgcaatggaatgtacccggagcaatacctgatatgggtgacttattaggtgttgatttgcgtcaggagttctctgctgaggctgaggaa

SEQ ID NO: 51728 - DNA, 241 bp, Glycine max
  Peptide Sequence Number=SeqID_143413
aggtggtggcagtgcgtctgttgcccgctgctggccatccccagactgctatggtgttttgccctacgcctgcctgggggcacagtacttcttgatgaaagctcggttagtaggggggcctgatgaccttgttaggggcggcagacactccgtagaactgaccgagacccgtaatcagagctggaaaccccaagaccctgttggacttctccgagtccactgggtgtcttcgcgggtgtga

SEQ ID NO: 51729 - DNA, 978 bp, Glycine max
  Peptide Sequence Number=SeqID_143414
atggggacaaggggttgcatcagctacaatctcgttcttgctataagacaacttggctatcctatgagaggagcaccactagaggaagagatcgtgcctgtcatttcacaaggtttcaaagagaccaatgtggagacacttcagaaggtccgcaaggcatgggaggtgttgcaaaagaaagacaaggaactcagaggcagtaacaatgggcccatcagtgactaccgtgagtggttgaaagcccacgtgcaaggtttggattggctcccaagtctaagaaccactaaaagggaggaagatgaggcaccggaggaagacgaagaggtgcaggcccttaggacagaactcaagcaagctcaaacagtcaaagaaaggttcaaatctgcagctcttaaaatccgaaaggagaatgtcgaactgagagatgtaaatatggctaccagcaaggctttggaacaagagaccaaaagggcccgtaggaaagaacatggccggaacaagttccgaggggctttgtggggcagtaacagcgaacttaaactccgaaaagaagaaagggaccaatcgcgagtagacggtttgatcttgaaagatgaattgaaggcttgctcgaggtccaagagaagtttgtctcagcggttgtgcgagacagagaccaacatgttagctatcatcaccaagtatcaagaagaactaagcctagccacagcccacgagcatagggtggcggatgagtatgcccaagtgtacgcagagaaggaggctagaggaagggtgatcgactcgttacaccaagaggcaaccatgtggatggaccgatttgctcttaccttgaacgggagtcaagaacttccccgattgctagccaaggccaaagcaatggcggacatctactccgcccccgaggaaatccatggacttctcagctattgtcatcatatgatagacttaatggcccatataattaggaaccgctag

SEQ ID NO: 51730 - DNA, 198 bp, Glycine max
  Peptide Sequence Number=SeqID_143415
atgatgctctcttacaacctaagacaagacaagataataataaaactattcaaaaagcaaggaaataaaaatcttgatcctgtcaatgatcttgatccatggcatgctcattcaggtccagtgctggtgcagatgatgaatcctgatgaaagggcagatccaacactagtgcagatggctcaggctaaggagatatag

SEQ ID NO: 51731 - DNA, 462 bp, Glycine max
  Peptide Sequence Number=SeqID_143416
atgtctgaggtgcatggtacttctatggtcattgatcagtcacttttcttttctttgactcatttacccagtcaaggtgcaccttttgagggcaccattgttgatgactggaaattcgattattcaagtcatgatgctcgtcgcatggtctgcaatgatcaagctgacatgaccgtgacctcctttgggtatcgtaaagatcggaatggacaatggctgaagaaggatgcactccctcctcaagatgaacgtactccttcacctcctcctcaacgtgaagattccgcactcatgaatgaagtcctctccgaattacggggtcttcattcgtatgttggtgaccgctttgactcgttagattcacgctttgccggtatggacattcgtcttacacagcttgaagaggatgtcggatacattcgtcagagtttcgatcttccaccacctcctccgtcttcttag

SEQ ID NO: 51732 - DNA, 567 bp, Glycine max
  Peptide Sequence Number=SeqID_143417
atggaaacctgtcccatggtggaagagttacttcaacggctcatggactggggacagctcgaagtgtccaagggagatagggaagaaccacagatttgcatgcagtcggaagaaaagaaggttcccccaacccccaaagccctagtaatatctttcactaggaatgtgaccggctccaggcccatgtaccccccgacagcgcccaagccaatgtcgtttgcctatcaaatcaataaggtcgttccatggaagtatacccctcccgcatttggagaaagggcggcaaccgaggttgactccttatcagccaaggtgaccaacattaccggtcttagcggcgtaacccgcagtggtcgggtgttcgctccccctcactcagtggaattgtcctccaaggggaaagcacccatgatccaagagcccacaaacgtggccaccccctcaaaagaagtggatcccccaatggtaaaatgggttaaaaagaatgaaggtcttcaaggaaaggcgatgactttggaagaggctcatgagttccttcgtctcatccaacaaagcgagtttaaaatg

SEQ ID NO: 51733 - DNA, 305 bp, Glycine max
  Peptide Sequence Number=SeqID_143418
atgcttccatgttatgtagcgcgccgggatgcattaaacaagaatcttcctcgtgcccaccacggggaacctacccatctcgacggcattaaccgctccccctccatgattggcgagcgggccaggcactgttcggttgagtggcccggggtcttcccatggtatgcgcaggtcgctttagggttgtaccactttgggaaaggaggctggtgcttggcacccatcattaggcaatttgtgaaattcggcgcttggcacccatcattaggggagcatcgatggaagaaagcatgtctcctttcctt

SEQ ID NO: 51734 - DNA, 615 bp, Glycine max
  misc_feature (32)..(32): n is a, c, g, or t
  Peptide Sequence Number=SeqID_143419
atgctgcaggtcgactctagaggatccccttnattggtggaggcagagacacacacctttcatttgacgtgtggggaggccaccatcacactacaagatgtgtctgtgttgctaggtcttcctgtggatggaaatcctttaattggcagcacaaatattgatgggattgatatgtgtgaacaataccttggagttaggccaaatgctaatgcattggctgatggaaacacattgaaattaagctggttggcttcagagtttgcaaatatccaggattatgtggatgacgaagagcacctcaaaatatggttacaaaatagaaatcctcatatggccagtgatagtgtggaacactgtcgttttaaattagacaccatgaaaaggggcgagccagatagagtcatgaggcaatttggactgcaacaacctatacctgaccctccattgcaacctagcaatatacatggcttaatactaaaaggaaaaaatggacataattggaggcgactattgttgccagcgcttaatgaatggaatagtctctatgaaaggcggtttcaagaaacgccaccacaagttgggctcctcagtgtgaattccgagtatatgaagtag

SEQ ID NO: 51735 - DNA, 188 bp, Glycine max
  Peptide Sequence Number=SeqID_143420
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgtgttcacgacccggatgcacggacaatttctaggatctag

SEQ ID NO: 51736 - DNA, 963 bp, Glycine max
  Peptide Sequence Number=SeqID_143421
atgcactacttcagcgacaacgcagccgctgacggcgacaaaacttacatccgtctgggcttcaaagggcagacgcagattaacgacctgatgaccggctacggtcagtgggaatatcagttccagggtaaccgcgcggaaaccaacaccgacgctaacatcggtaacaaaacccgtctgggctttgccggtctgaagtttggtaactacggctctgttgattacggtcgtaactacggcgtggtttacgatgtgctggcatggaccgacgtgctgccagaatttggtggcgacagtgcctacaccgacacctacatgctgggccgtacttctggcgtcgccacttaccgcaacagcaatttcttcggtctggttgatggcctgcgtttcgcggtgcagtatcagggcaagaacgattccaccagcgccaacggccgatcagagattcctaagcagaacggcgacggttacggtgcgtcactgggttacaccctcggcgatagcggtgtcagcctgatgagtgcgatctcctctgctgaccgtaccaactcgcaggacgtggcgacccgtctgggccgtggtgacaaagcggaagcctggggcgcgggcatcaaatatgacgcgaacagcatctacctggcatcgacctactctgaaacccgtaacatgacgccaatcacgggcggcgtggcgaataaaacgcagaactttgaagtggttgcgcagtatcagttcgacttcggtctgcgtccatcgctgggctacgtgcagagcaaaggcaaagacattgaaggcattggcgatgcggacatcgtgaaatatgtcgacgtggcgatgacgtactacttcaacaaaaacatgtcggccatggttgactacaaaatcaaccagctggatgacaacaacccgctgggcatcaacagcgatgacgtagtggcggtcggtctgacctaccagttctaa

SEQ ID NO: 51737 - DNA, 693 bp, Glycine max
  Peptide Sequence Number=SeqID_143422
atggcgcaggcgattcgcgccgatatcctgcgcgaaaccggcctgaccgcgtccgccggcattgcgccgatcaagttcctcgccaaaatcgcctcagacatgaacaagccagacggccagtatgtgatcacgccgcaggcgatgccggactttctgctgacgctgccgctgagcaagattcccggcgttggcaaagtggccaccaaaaagctcgaagagatggggctgcgcacctgcgctgacgtacaacaggccgatctggcgcagctgctgaagcgctttggaaaatttggccgcgtgctgtgggagcgcagcaacggcatcgacgatcgcgacgtggtggtggagcgcgagcgcaaatcgctgggcgtcgagcgtacgctgggcgaggacatccatcactgggagcagtgtctggaaattattgattttctctacgccgaactcgatcgccgtctcagcgcgatccgcccggataagcagattgcacgtcagggcgtaaagctgaagttcaacgatttccagctcaccacccaggagcatgtctggccggtgctgaataaagacgacatgatcgccgtagcgcgtcaggcctgggacgagcgccgcgccggacgcgctggagcgccagctggtgctggggttgtaatggctgagctgccgctggaagagcgctacagcacggttgcctga

SEQ ID NO: 51738 - DNA, 1791 bp, Glycine max
  Peptide Sequence Number=SeqID_143423
atgagcacgcccgaaaataatgataatgcagccgcctcaggaaaatgcccctttcatcatggagcatcggaagagaaaagcgttttagcgcgtggcgccggaagcgggaccactaaccgcgactggtggccaaacatgctgcgcgtcgatctgttaaaccagcattccagccgttctaaccccctcagtgacactttcaactaccgtgaagagttcagcaagctggattacgccgcgctgaaagccgatattcgtgcgctgctgaccgactcgcaatcctggtggcctgccgactggggcagctacatcggcttgtttatccgtatggcatggcacagcgccggcacctaccgcaccatcgacggtcgcggcggttccggacgtggccagcagcgctttgcgccgctcaactcctggccggataacgtcagcctcgacaaagcacgtcgtctgctgtggccggtgaaacagaagtatggccagaaaatctcctgggccgatctctacattcttgccgatgtctgggaaccggacatggacgtggactggggacatgagaccgaatggctggcgcaccgccatccggaaagcctggcaaacgcgccgctgggtgcgacggaaatgggcttgatctacgtgaacccggaaggtccggaagccagcggcgatccgcgctcggcggccccggcgattcgcgctaccttcggcaacatgggcatgaacgatgaagagatcgtcgcgctgattgccggcggtcacacgctgggtaaaacgcacggtgccgctgcggccagccacgtgggcgtcgatccggaagcctcgccgctggaagcgcagggtctgggctggcatagcagctacggcagcggtgccggtgcagatgccatcacttccggtctggaagtggtatggacgcaaaccccaacgcagtggagcaactacttcttcgagaacctgttcaaatatgagtgggtacaaacgcacagcccggcgggcgcgattcagttcgaagcggttgatgccgaagcgattatcccggatccgttcgatccagagaaaaaacgcaagccgaccatgctggtcaccgacctgacgctgcgcttcgatccggaattcgagaagatttcgcgtcgtttcctcaatgatccgcaggcgttcaacgaagccttcgcccgtgcctggtttaaactgacgcaccgcgatatggggccaaaagcgcgttacatcggtccggaagtgccgaaggaagatctgctgtggcaggatccgttaccgcaggccacgcatcagccgacgtcggatgacatcaccgatctgaaagcaaaaattgccgcttcgggtctgagcgtcagccagctggtctctgcggcctgggcgtctgcttccaccttccgtggcggcgataaacgcggcggcgcgaacggtgcccgtctggcgctggcgccacagaacggctgggcggtcaacgccagcgtcacccgtgatgtgctgccggtgctgcaaaagattcagcaggagtcaggtaaagcgtcgctggcggatgtgattgtgctggcgggcagcgtcgggattgagcaggcggcagcagcggcaggtgtcgcggtgcaggtgccgttcacgccgggccgcgtggatgcgcgtcaggaccagacggatgtcgagtcattcaacgtactgcagccgctggccgatggtttccgtaactatcgccgcgtacagggcggttcttccaccgaaaccctgctgctggacaaagcgcaacagctgacgctgagcgcgccagaactgacg

SEQ ID NO: 51739 - DNA, 352 bp, Glycine max
  Peptide Sequence Number=SeqID_143424
ggctccacatctgcgccttcaaagaactcaaggtcctctgcccttaatgcttaatcgaggctttgcgctcccgggtgaggggctagtagtttgcttttatcagttcttgggccacccccctaataatggagggcgaccaactgtgcaagcacaaccagaggaggagactatcgcacaactactatgcataccggggcaagatttcacccagacgctgcaaggagatgagtgtggatcggatcacgcctacaagacactcagtgtgcccagagaagtccaacagggtcctagggtttccaggtttgattacgagcctccgtcagttctacggattgcccgtcgcccccaatag

SEQ ID NO: 51740 - DNA, 429 bp, Glycine max
  Peptide Sequence Number=SeqID_143425
atgggtggtcaagaggagacacaagaacagatgaaagccgacatgtcggctttgaaagagcaaatggcttccatgatggaggccatgttaggaatgagacaactcatggagaataacgtggccaccgctgccgctgttagttcggctgccgaagcagacccaactctcccagctaccacgcaccatcctctcccaaacgcggtaggacgagaaatgagcacactggggcacaccagcaacccccatttgggatacaaccgggtggcttacccttatggattaccacctaattacacgccaccagtcatgcgtgatgatgcgggtcatgtcccttcccccatccttgaaggggagcctcctcgacaggccgacgaggttcacgaggatcatcgagagtatgcccaaggggatgtcgatttctaccccccg

SEQ ID NO: 51741 - DNA, 411 bp, Glycine max
  Peptide Sequence Number=SeqID_143426
atggcttctaggaaaagaaaggcaccctctacacctacccaagtcagatttgacagatctaaattcatctcccaagaggcttgggaaagatacaatgatgctattgtgcctagaaaccttttgcctgagaggaacgtggtggtctattatacagagtttgatgagttcaaggaggaactcgaaagacaccactgggatgaggagttgactgactttggggacaacaacattgatgttgccattgtgaaagaattctatgccaacctctatgaccccaaggacaaatcacctaagcaggtccatatcgctaagtgcaccactttggtcaatccgttgagcgagaaaagccgcgctaagtcgaaattcactaatagactagagctggaagaggaagctgtcctgagagcttga

SEQ ID NO: 51742 - DNA, 246 bp, Glycine max
  Peptide Sequence Number=SeqID_143427
atgttgaagaacagtcgagaatcttcgcgtaattactcactgaaacgttacggaagcgcctcggcttggattttcttcacagaaataattttcctcggcaatttcgagagagggagaagtgccaagaaggggaggagcttgccacccagctcgctcaggcgagcaaggttgcttcctccagaaggctggaaggatctggaaggcccaagtgggccagattgctatttgtaccctcttttttactaa

SEQ ID NO: 51743 - DNA, 189 bp, Glycine max
  Peptide Sequence Number=SeqID_143428
atggcatcgaaagattggactccaccactctgtatgaaatctgacaagggaggaagccaactaatctgtggtgaagcaaatggaaagcaagtcaagatggatcccaccagaagcttcaacatcaaccacttcctgggactactctcacatggacttgatggggcctatgcaatagtatttcgaacctga

SEQ ID NO: 51744 - DNA, 514 bp, Glycine max
  Peptide Sequence Number=SeqID_143429
atgagtcatcattcatctactgttaatggcgagggtactagtcatgaggaccctctatctagaatcttagatgagttgagttccctcatgttatggaaagaaaaactagaaagaaaagaaaaaggaaaagagagggtaaaaataaatcaagatgagaaggaaaaaataagggaagaagaaagaaggaaaatactaaacgaattaagaaaagaaaaacatacctcctatagtagtcatgacctcttagacttcactcccatagaagagaaaaggaatgaaagcctcaagaggctaacattaacctcccatacttccatgggaatagacaatgtggaggcttacttagattgggaaataagggtagagcaacaacttaaaaggatggctacttcaaaatctttttgccctcactcttatctaaagaaagaccaaggtcaaggcatctttggggcggtaccttctaagcccaaagatgatatggggaagacaatagaaaagcaaccccctaaggcta

SEQ ID NO: 51745 - DNA, 118 bp, Glycine max
  Peptide Sequence Number=SeqID_143430
atgccttgtggcgcgtttagttatggtgtttttcctaaaaaaccaaacgtgaggggtgggtgtccgccattgccttggccttggctaacaatcggggaagttcttgactcccgtcaag

SEQ ID NO: 51746 - DNA, 420 bp, Glycine max
  Peptide Sequence Number=SeqID_143431
atgttattgcctagcgctgttcatgtgtcctccaccttcgagtttggagctatgtttcatgattgcctaagtgcggaccctcaaggaaatcctccatcctcccccttttttcggagccaattactgaggcggactacaattgaatgcccgtcttttcccccttttttgactgggaaaaccctgggtttacccaacttaatcgccttgcatcacctccccctttcgccggctggcttattagcgaataggcccgcgccgatcgcccttcccaaccttgttctcccgaatggcgaatgggacgcgccctgtatcggcgcattaagcgcggcgggtgtggtggttacgcgcagcgtgaccgctacacttgccagcgctgatgtccggcggtgcttttgccgttacgcaccaccccgtcagtag

SEQ ID NO: 51747 - DNA, 315 bp, Glycine max
  Peptide Sequence Number=SeqID_143432
atgaaactaacagatgtcaaggaggatcacatatttctgaaaggcttttcctcattctttagagagagtggcaaaggactggctatattaccttgctccaaggcattaggcaactcagtggagagagcctatatgaatactaggagagatttaaaaaactatgtgccagttaccctcaccaccagatattctgagcagcttcttctccaatatttgtatgaaggactcagtaacatggagagaagtatgatagatgctgccagtggtggaacccttggagacatgacccctgctgaagccagaaatttaatttag

SEQ ID NO: 51748 - DNA, 1029 bp, Glycine max
  Peptide Sequence Number=SeqID_143433
gttttaccaagtcaaggagaaaggtctagataccaccagcatcaaggaattagggcggttgatggaacctctccaaatgcaagccttacgcaagacttacggaaagatcttagatttgaccatagcagaggtatccatagaggccattgcgtcactcacccaatactacgaccagcctttgagatgcttcacgtttggggacttccaattggtaccaaccattgaagaatttgaggagattctaggatgtcctctcgggggaagaaaaccatatcttttctccgggtgtctcccctctttgagcagaattgcaactgtggtcaaggattcagcaaggggtttggaccgcgtaaaacagactcgaaacggcatagcgggcctaccacggaagtacctagaagataaggcgagggatatggcaattcaaggagattgggtcccgtttatggatgtgttagcattgctaatttttggggttgtcctctttccaaacgtagatggtttggtggacctagcagcaatcgacgctttccttgcataccaccatagcaaggaaagtccggtagaacaatcaattggttcccccgatggaaggaaggaaaggagggagtcctttttctcatgtaaagggtacccaaacattccgctaataggaacgaggggttgtattaaatacaaccccgcgctcgctataagacaactagggtaccccatgaggggagcaccgatggaagaaagcatgtctcctttccttgtaagggatttcggcgtgcaaaatttcaaggctatacaaagaatccataaggcatgggaaaccccgttaaggaaagatcaagaacttaggggcattcgtaacgacatcattggtggttatcatgaatggctgaaagttcatatacgaggtttagattggctcgccaagttaaaagtcgttagcgaagacagtttcgaagcatcggaagaagacgaagaagtccaagctctcaaaaacgagttaggaaaggcgaaacttgccaaggagaagttcaa

SEQ ID NO: 51749 - DNA, 195 bp, Glycine max
  Peptide Sequence Number=SeqID_143434
atggcttttcagtgtatcaaatctactgaagcaattgtggaagcaaagctttccaagtttattttgatgatgccaaagactcaagtcaagaatcaagagtcaaacaagtttcaaagaatcaaagagttgttcaatcaagaatcaagattcaagaaaagaatcaagagaagactcaagatatgcaagaaccattaa

SEQ ID NO: 51750 - DNA, 489 bp, Glycine max
  Peptide Sequence Number=SeqID_143435
atgacattgctacttagcaacattctgcccagcgaccgcaatgccaatctccccctgcggaagtatcagttggtctgtgccgtcccgacatggggatcgcacccacaaagacacccggtgaacctgaagaagtccaatagggccctggggtttccagctctggttacgggcctctatcagtcctacggggtgcccgtaccccctcggcaaggtcacgtcatcatagggatcgcgactgcaagacacctagtggacccgaagaagtccaacagggtcttggaattgtcaagctctaattacgggtctctacaggcgcagggcgaaacaccacagcagcattgggatggtcggcagcgggaaacagacgcaccgccatcacctctagagttcacctctgctcatccacaaaaaggttttgcctacacaacatggccgaccaataggcgaccaagtccaaagccaaatgtaagaaaagtactaggtcagtga

SEQ ID NO: 51751 - DNA, 492 bp, Glycine max
  Peptide Sequence Number=SeqID_143436
agaccaagtttggtcattctgcacccatgatacgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaaagaccaagtttggtcattctgcacccatgatacgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaaagaccaagtttggtcattctgaacccttgtatcatccagaggcggcgggcccgatgatacgcggaaaatacccgagtg

SEQ ID NO: 51752 - DNA, 298 bp, Glycine max
  Peptide Sequence Number=SeqID_143437
actccaagtgacagctcagatcagggaggagattctcaaatcatgtttcctctcacaaaagagccaagtactgcaaagaggcacttgtcacagagagtttgggatcggaatgccagtcatagaagaatggacacctgcacctactcacttgaagctgtcaaaaggaatgaagtctgggcagctagttgataggcccgagggaactaatgtgattggctaccaagtggatcttcatgagaccacaaaacctaatgcagtagaagagtttgtcataaccagaatacaaggccagacctaa

SEQ ID NO: 51753 - DNA, 225 bp, Glycine max
  Peptide Sequence Number=SeqID_143438
atgaccgaccctctcgatgagtcgatctcttgttttctcataagggtgaacccttgggtactagtaccttcaccttcagaggactacacgtcctcgccttcaaagggtcatgtaccttcaccttcagaggactacacgtcctcgccttcaaagggtcatgtaccttcaccttcagaggactacacgtcctcgccgtcaaagggtcatgtaccttcacctttgtag

SEQ ID NO: 51754 - DNA, 396 bp, Glycine max
  Peptide Sequence Number=SeqID_143439
atgttgctaagtagcaatgtcatctatatctgtgtaagagtggtcatgtttgtgcgcatgatccgcactcgtctctttgcagcggcacgggtgaaatcttgccccggtatgcatagtagccgtgtgatagcctccctctctggttgtgctcgcacagttggccctcctccaatatcagggggtggcccaggaaccgttaaaaggaaactactggtgtggatgtggagcacactgaaaatgaggacacgtagccctctaaaggtgagggcgtggagccctctcaaggcgaggatgtgtagtcctttggaggtgagggcgtgcagccctctgttggcgaggacgtgtagtcctcttcagggtgaaggcgtgcagccctctgttggcgaggacgtgtag

SEQ ID NO: 51755 - DNA, 669 bp, Glycine max
  Peptide Sequence Number=SeqID_143440
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcccccgaacacagctcacaactttcatcgtactgtgctctccaaagagcaactcttctcaaaatctcaaaaggatccagctacaggagaaccgggaacggagagcttcccccgccccccttttttttccgcccgactctttgctcttaagaatactgggttctatggtcggtccgcgacccctggatgccgaaggcgtccttggggtgatctcgtagttcctacgggggagatagtgcatcaagctgttcgcaagggccagcttgatcctcttccccaggatcccaaatga

SEQ ID NO: 51756 - DNA, 701 bp, Glycine max
  Peptide Sequence Number=SeqID_143441
atgaagcatggctccaaactcgtgggtggaggatgcatgaacgaaaacgcaattcatggggctccgaaaaagggtagagaatggagaattgcactaagcaattactacgcatggctccaaactcgatgcatgaacgaaaacgcaattcatggggctccgagaaagggtagagaatggagaattgcactaagcaatcactacacatggctccaaactcgatgcatgaacgaaaacgcaattcatggggctccgaaaaagggtagagaatggagaattgcactaagcaatcactacgcatggctccaaactcgtgggtgcaggatgcatgaacgaaaacgcaattcatggggctccgaaaaaggcgaggcaggaccaaatggtccaccggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 51757 - DNA, 429 bp, Glycine max
  Peptide Sequence Number=SeqID_143442
atgtgggctttccttaccggtcgtcagatcgactgggcccacttggttgggtaccgaatgcataaggcattacgggccaatgcacctctcccttacccacaattgataactttgtttctgcgtcattttcaaattccgcttgatgatgaaccatttgttcaagtcaagcgttcctttgcaattggtgctggtgcagtgatttcctttggatatcgtaaggatcagaatggtcaatggctgaagaaagacgcactccctcctcaagatgagcgtactccttcacctcctcctcagcgagatgattcagcactcatgaatgaagtcctttccgaattacgaggtcttcgttcttatgttggtgaacgtttcgactcattggatacacgttttgttggcatggatatttgcctcacacaacttgaagaggat

SEQ ID NO: 51758 - DNA, 195 bp, Glycine max
  Peptide Sequence Number=SeqID_143443
atgtctcccgaacaatttcagtacatatggcgcaagacgattccacatatcgaggtcggaatgggatcgggtgttttcacgtctcaccgtagtgcccgaaggaacgaagtgctcgaccggaagggaaaatggaacgatttttttgactcgcccccggtgtcctttggacccaaagcccgcattccagcaagctag

SEQ ID NO: 51759 - DNA, 303 bp, Glycine max
  Peptide Sequence Number=SeqID_143444
atgggtgttaagtaccttgaggcggtcaagagaaggttgcatgccaccaaacaatggtcctcggatgaaattaagggattaagagaccgagggtctcttgttgtaaagcaatctgaacacaaaggaagggttgtccttgtgtggttcaaaacttgtaaagggcttttgcaagatagtggaactctcaagcgagttgcttggggactgaacataggcacaagggtgtggccgaaccagtataaatctgagtttgcaatcgttcttcccttaaactcttttattgtttattgcataattatttag

SEQ ID NO: 51760 - DNA, 324 bp, Glycine max
  Peptide Sequence Number=SeqID_143445
atggtgggttacacaccttcaagcttcgctgatttagttttcactgacgaaaggatcaaagcaggtatgaaaggaggcaaatttaattattctgcttggacgaatgaaaaaactggggcaagtgaagagggtgaggatgaaggagaagcccgtgctatgactgccattccaatacagccaagtttcccaccaacccaacaatgtcattactcagccaataacaaaccttctccttacccacagcccagttatccacaaaggccatccctaaaatcaaccacaaagcctacctaccgcacttccaatgacaaacaccacctttag

SEQ ID NO: 51761 - DNA, 201 bp, Glycine max
  Peptide Sequence Number=SeqID_143446
atgttaaaagatcttgaggcgaggctcacgggtgcgctttccaaaggaggaaagatgcgcggagtcgccaccaacgaaggtattaacacctctcacgtcgacaaaagcggggctcttgctcctacgtaccctccatcgaagaggaaatcagacctacgtagttcttttttaaggatgaatcaagcgattctttttacttga

SEQ ID NO: 51762 - DNA, 647 bp, Glycine max
  Peptide Sequence Number=SeqID_143447
atggctacctcaccaaaagaaacttcagctcctggttcaccctctgtaccatcatctccatcacctaccaaagcaccatcaaaccaggaacagcctgaattccatatccaacccatacaaatgatccctggtcaagcccctgctcctgagaaactggcccccaaaagacaacagggagtgaagatttctgaaaaccctagcattgcaacaagtcctagggaagtagacccggagatggataagaagatccgcagtattgtgagcagcattttgaaaaatgcttctgtccctgatgctgatgaagatgttccaacatcttccacccctaatgtttctgtcgctgatgctgataaagatgttccaacatcttccacccctaatgtttctgtcgctgatgctgataaagatgttccaacatcttccaccccaaatgctgaaatcctctcttcacccagcaaagaggactcaacagaggaagaggatcaagccacagaggagacccctgcaccaagggcaccagaacctgctccaggtgacctcattgacctagaagaagtagaatctgatgaggaacccattgccaacaagttggcacctggcattgcagaaagattacaaagccaaaaaggaaaaacccccattaagag

SEQ ID NO: 51763 - DNA, 111 bp, Glycine max
  Peptide Sequence Number=SeqID_143448
atggaggccttgaaagaacagatggccacaatgatggaggccatgatgagcatgaagaagataatggaggtcaatgcgactgcagttgccgctattagccctgtttttggg

SEQ ID NO: 51764 - DNA, 498 bp, Glycine max
  Peptide Sequence Number=SeqID_143449
ggcgaattggagctccaccgcggtggcggccgctctagaactagtggatcccccgggctgcaggaattcgatcaaacctcaagctagctacagagcgctgattgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 51765 - DNA, 639 bp, Glycine max
  Peptide Sequence Number=SeqID_143450
tgctggatctatgagcacttccctagtgtgcatcagtgcttgactgacgatacataccaggagacgtccccacgtgcttcccggtggttgacgtcgaaggcgcacatgaagggcatcacaggagcaccctacagggcacgctgtgatggtttgaccgtcacagatgtgtcctggttgccgtacacggagcatcgaggtttcgattacatccagagcatccctccgtcgcctgttagtgcacgattgtcacacgatcagatagatgacaggtggatggagtttgcggatcacttactacctgcgggtcagccttgtctagtgcctgggcaggtatctgcggattacattgagtggtttttccgcatatctcatcctttcatgacaccgacccaggcagctgaccagcagagggatgcaccagctgcagaccttgaggactacatacagacgcccagcccccaggttccagtggcatttgacccccctccatatgtggatgattacgagggatatgaggcgattgcacagaggttggagcatgtgctcaaccttaggatagtcactgcagggacagagttatatgacattatgcaggactgtctgacgatcgcgagagggggacccagtgttgatgggacg

SEQ ID NO: 51766 - DNA, 267 bp, Glycine max
  Peptide Sequence Number=SeqID_143451
atggagctacatcaagtagcgcccccaatgatggagagggagatgataacaatgatagtagacacgttaccggtgttctactatgagaagatggtgtgttacatgccttcaagctttgccgatttagttttcgtcggtgaaaggatcgaagtgggtctaagaagaggcaaatttgattatcctgctttgatgaataggaagcctggggaaaatggagaaaataagaaggagggaggaacccatgttgtgactgtcgttcctacatga

SEQ ID NO: 51767 - DNA, 45 bp, Glycine max
  Peptide Sequence Number=SeqID_143452
atggggggtgcaaatagtaattttcgaatctgggcccttctagag

SEQ ID NO: 51768 - DNA, 882 bp, Glycine max
  Peptide Sequence Number=SeqID_143453
atgttccaacatcttccaccccaaatgctgaagtcctctcttcatccagtaaagaggaatcaacagaggaagaggatcaagccacagaggagacccctgcaccaagggcaccagaacctgctccaggtgacctcattgacctagaagaagtagaatctgatgaggaacccattgccaacaagttggcacccggcatcgcagaaagattacaaagcagaaagggaaaaacccccattactaggtctggacgaatcaaaactatggcacagaagaaaagcacaccaatcactcctaccacatccagatggagcaaagttgcaatcccttccaagaagaggaaagaaatttcctcatctgattctgatgatgatgtcgaactagatgttctcgacatcaagagggccaagaaatcagggaaaaaggtgcctggaaatgtccctgatgcaccattggacaacatttcattccactccattggcaatgttgaaaggtggaaatttgtatatcaacgcagacttgctgttgaaagagaactgggaagagatgccttggattgcaaggagatcatggacctcatcaaggctgctgggactgctgaaaaactaaagagtgatgagtatccgaaagtgtttgtcagaggaaaatgtgttagattctcccctgctgtgatcaacaaatacttgggcagaccaactgaaggagtggtggatcttgctgtttctgagcatcaaattgccaaggaaatcactgccaaacaagtccaacattggccaaagaaagggaagctttctgcagggaagctgagtgtgaagtatgcaattctgcataggattggcgctgcaaactgggtacccaccaatcatacttccactgttgccacag

SEQ ID NO: 51769 - DNA, 342 bp, Glycine max
  Peptide Sequence Number=SeqID_143454
atggaggagttgattagcaaaacacaactctctcccaaaataatctcaatgttatcacatcggcttggcggctccacaaaagaatctcacttcttgtactctgctgctatcattctgctcccacaaacaaaggttcacgatcatcacaggtaccaaccacacgatacaaaaattgcgagggcggaatggagaaggaagagggagaggagacgccacttcaaggagaagatgagtctagaagaagctcaccaccataggaggccatggataagagcttggaggaagaaggagatgaatgaagggagaggaagagaagagcacgaaattttatgctctaaatga

SEQ ID NO: 51770 - DNA, 156 bp, Glycine max
  Peptide Sequence Number=SeqID_143455
atggactggataaggagagagaaagtggcgagtttatggagggctgaatggaagagatttggtttaaagtctgaatgtgtttggatggagaatgatgaaaatgtgcatcccataaataggaatgacatcaagttggttacaaaagtgagaagatga

SEQ ID NO: 51771 - DNA, 416 bp, Glycine max
  Peptide Sequence Number=SeqID_143456
ggaagctaagtgtgaagtatgcaatcctgcacaggattggggcagcaaactgggtacccaccaatcatacttccactgttgccacagaatcttttgctgtcaaattacccattgctttcccaactgtattgtgtggcattatgttgagtcaacatcccaatatcttaaacaacattgactctgtgatgaagagagaatctcctctatccctgcattacaaactgtttgaggggacacatgtcccagacattgtctcgacatcagggaaagctgctgcttcagacagtggcattgatgatggtgaagcagctgaggaagaagaagaagcagctgaggaagaagaagcagttgaggaagaggaagatgcagcagaagatacagaatcagatgatgatgattctgaagccaccccatga

SEQ ID NO: 51772 - DNA, 473 bp, Glycine max
  Peptide Sequence Number=SeqID_143457
tacctttagtagttcctatacctgtcatgttccttggattattcacaagcggtattcaagctctcatttttgctactttagctgcggcttatataggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 51773 - DNA, 84 bp, Glycine max
  Peptide Sequence Number=SeqID_143458
atgttggcgcccatggctcatggtcgtcaagcgcttaccttcaataaggttgagttggtcatagcatgtttgagcccactctga

SEQ ID NO: 51774 - DNA, 474 bp, Glycine max
  Peptide Sequence Number=SeqID_143459
atggattgccgcccaactactcatcacccgtcttgcaagacgatgcgggccatattgcttctcccgtccttgaaagagagcctcctcaacagcccgacgaggtccacaaagaccctcaagactatgctcgaagggatgtcaagttccatcccccgtaccccgaagaggccggctacccaacacgtgcctcacgagcatgaatcgcggacacagtatgctcatagtattcacgcggaaaagaccccggcaactgaagagaaggaggaagctcgactctacctcgaagaggaaaccatgtggatcggatcgtttgctctggtaccttgcgggatgtcaatgttaacttcccccgacttgttcacaagtgccagacttgacaagtataggcagacgactactccgtcccccaaaatcatgggctatctcaagatgctatctgtcgcatatgatagactggccacacttaaggattga

SEQ ID NO: 51775 - DNA, 150 bp, Glycine max
  Peptide Sequence Number=SeqID_143460
atgtttggagatttgatgttcttagaggtgtgcctaaaagcaaaagactcactatggtacttggatagtggctgctctagtcacatgacgggtgacaagtcgagacttactgacatggtgtcaaaggaaggaggatatgtcactttttga

SEQ ID NO: 51776 - DNA, 450 bp, Glycine max
  Peptide Sequence Number=SeqID_143461
atggcaagccaagagaagtggggcccgtttgcggatatattagctttgttgatctttggggttgtcctctttccgaacgttgacggtttggtagacttagccgccattgatgctttcctcgcatatcaccatagcaaggaaagtccagtggtggctatcttggcaaatttgtttgacacctttgaccggaggtgtgagaaaaacaatgcacggattgtctgttgtttacccgctttctgtgtgtggttgatttcacacttattccaacatgacacaagacacccgtgtccgctccaaagttatcgctcatgcgccgaaaaagaaagagtcgattgggaccaacatttggctggaataggaggcaacgcaatcaattggtttcctcgctggaaggaaggcaaggaaggagttctcttctcgtgtggggactaccctaatgttccacgatag

SEQ ID NO: 51777 - DNA, 405 bp, Glycine max
  Peptide Sequence Number=SeqID_143462
atgcagcaacagcagctgcagtcacaacaaagacaacaagcaactgaggctcctcctcaaccttccttagaagagttagtgaggcaaatgaccatccagaatatgcaatttcaacaagagaccagagcctccattcagagcttaactaatcagatgggacaattggctgtacagttaaatcaacaacagtcccaaaattctgacagattaccttctcaatctgtccagaatccaaaaaatgtgagtgccattacattgtggtcaggaaaacagtgtgaatcttccactggtaattctgatttacagaagcaacatatccctcttccattcccttcaagagcaatttccaacaaaaaaatggaagaggcagagaaagagatcttggaaacatttagaaaagtagag

SEQ ID NO: 51778 - DNA, 1060 bp, Glycine max
  Peptide Sequence Number=SeqID_143463
atgtccatcgtccgcatgaccgacctcgacctctccggcaagcgcgtgctgatccgccaggatctgaacgtgccgatcgagaatggccgcatcacctccgaacagcgcatcaccgcttcgctgccgacgctcaagcgcgcgctggagcagggtgcggcggtgatggtcacctcgcacctggggcgcccgaaggaaggcgtgtggagcgaagccgagtcgctggcgccggttgcccagcgcctgtccgagctgctcggccgcgaggttccgctggtgcgtgactgggtcgacggcgtcgacgtgcagccgggccagctggtgctgctggaaaactgccgcatgaacgtcggcgagggcaaggacgatgaagccctgtcgaagaagtacgcggcgctgtgcgatgtgttcgtgatggatgccttcggcaccgcgcaccgcgcgcaggcctccacccacggtgtcatccgcttcgccccggtggcggccggtggcccgctgctgatggccgaactggacgcgctggcgcaggcgctggatgcaccggccaagccgctgctggccatcgtcgccggcagcaaggtcagcaccaagctggaactgctggccaacctggtcggcaaggtcgatcagctgatcgtcggtggtggcatcgccaataccttcattgctgccgccggctacaacgtcggcaagtcgctgtacgagccggacctgctggataccgccaagaagatcgtggccgatgccaaggcgcgtggcgccgacattccgctgccggtggacgtggtcaccgccaagcagttcatgccggacgcggttgccgaagtgaaggcggtcgacgcggttgccgaagacgatctgatcctggacatcggcccgcagaccgctgcgcagtacgcgcagctgatcgaaaaggccggcaccgtggtctggaacggcccggtcggcgtgttcgagttcgaagccttcagcaagggcaccgaagcgctggcccgcgccatcgccagctcgccggcattctccatcgccggtggcggcgacaccctggccgcgtcgacaa

SEQ ID NO: 51779 - DNA, 46 bp, Glycine max
  Peptide Sequence Number=SeqID_143464
catagttgcaagggtccaaatcatatttgatgatgccgttacaggg

SEQ ID NO: 51780 - DNA, 234 bp, Glycine max
  Peptide Sequence Number=SeqID_143465
atgaagagagaagaagggcgggagatagatacatggactgagatgagaagggttatgcaaaagaggtatgttccaactagctacaatagaaccatgcgacagaaactccagaggttatcccagggaagtttgattgttgaggacaaggagatggagatggaactagaatttaaagatatctttcccacggagattcctcatggactgccaccttcaagaagtatagaacattaa

SEQ ID NO: 51781 - DNA, 171 bp, Glycine max
  Peptide Sequence Number=SeqID_143466
atggagacagctgtgtcgtccgcactacttagaaagcaagtggattacatcggttacaggagaaactttgatgaagtagacgaaaaatccataatggcagcccttgaatattccactgtgaacattattggagtgcatatggaccaggttggctggataagagaactttaa

SEQ ID NO: 51782 - DNA, 450 bp, Glycine max
  Peptide Sequence Number=SeqID_143467
atgaaccgccaatcaaattcatgggggctccgaattaggatgggtggagggatgcacgaaacagcgcaagggcaatcaaatttcgtgggggctacgggactcaacggtggaggatgccatgaacgacattcaatttcatgggggcttcgaataagatttgatgatagagattgcatgaacagcgctttggcaatcaattcatggggctccggactcaatggtggaggatgcatgaacaacaatcaattcatggggctccgaataagatggtggaggatgcacgaacagcgcaaggcaatcaattcgtggggctccggactctatgttggaggatgcatgaacgacattcaatttatggggcttcgaataagatttgatgatagagaatgcatgaacagcgcttggcaatcaattcatggggctccggactcaatggtagaggatgcatga

SEQ ID NO: 51783 - DNA, 628 bp, Glycine max
  Peptide Sequence Number=SeqID_143468
cgcccaatacgcaaaccgcctctccccgcgcgttggccgattcattaatgcagctggcacgacaggtttcccgactggaaagcgggcagtgagcgcaacgcaattaatttctgttgtcgcagttttgagtggtgctagtagtttgcttggtaatgaatatcatgaagccttgcagcacaaaactagagagccaaaccttggtgcaaagttgttctttggtggtgttggcgtgcaaaagacggggacagaaattgcaacagctttgaataatatggatgttagcagtgaatatgttctgaagctaaaacatgaaattgaagaacagtgtgctgagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 51784 - DNA, 291 bp, Glycine max
  Peptide Sequence Number=SeqID_143469
atgacactctcacttaggaaaactaggcagcaagtgtcaaggtcaccctgtcatgcacaagtaactcccccccatggtgatcaacctgagtctcaaggaagttccaaaccgagtgacatgcccccaagtacaagtatttttcctcatgaaaaactacgagttcttactgacaaagcttgtactatttccatgcaatatgaagtatggaacatgagcatcatcaatgcactgaaggttcacgttcgttcatccaaacacagagctttatatatcaaatcaaagataatttag

SEQ ID NO: 51785 - DNA, 357 bp, Glycine max
  Peptide Sequence Number=SeqID_143470
atgcaagccttccacaaggcgtatggaaagattttacatttgaccatatcggagatattcacagaggccgttgtatcactcacccaatactatgaccagcctttgagatgcttcacgtttggagacttccaattagtaccaactgttgaagaatttgaggagattctaggatgtcctcttgggggaagaaaaccgtatcttttctccgggtttcttccctctatgagcaagattgcaatagtggtcagggattcggcgagagagttggatcgtgtaaagcaaactcgaaacggcgtagtgggcctaccacggaagaacttggaaggcaaggcaagggatatggcaaatcaagaatag

SEQ ID NO: 51786 - DNA, 513 bp, Glycine max
  Peptide Sequence Number=SeqID_143471
atggtcatggacatggctgacacatttggagaaggattttgtgtcaagattgcagttcttcagcactttaaagaaagattctcagagcagaatccttgcagaccaaccttggaagggatccagttctcttcccttgatcaaaggcagaaggaaagccttgttgatagattcactgagctggaaatcaagtctgcagtttgggcttgcgggggagataaaattttgggaagtaatcccaaggcccagcagagtgacaaatcaaaggagatgatgagaagtaataccaaggcccagcagactgaggaacctttcgtggactccaacccagcttctaaaggtcaccctctgtcttctttatacgaggaccctatacagctgcaatgtgacatcttgaaggaaatgggcttgtcttatgaggaagaagatagcaaggttaaggggctgctgctggatatggagaataaagatgatttggtggcagcagagaagggaattaaatctcagcaattatga

SEQ ID NO: 51787 - DNA, 408 bp, Glycine max
  Peptide Sequence Number=SeqID_143472
atggagcttggacaaaaaaacattaattttggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 51788 - DNA, 154 bp, Glycine max
  Peptide Sequence Number=SeqID_143473
atgtgtgaagtagaggaggtgcaagggcagatgaaggccgacatggagaccatgaaaaagcaaatgaccataatgatggaggtcatgatgagcatgaagaagataatggaagccaatgcggttgtagttgccgctaccagcgttgttgctaaag

SEQ ID NO: 51789 - DNA, 735 bp, Glycine max
  Peptide Sequence Number=SeqID_143474
atgtacaactgtgtgttttatgtgcaagattcctttgaggagcaggtgacacagggatccttcataccccatggacgtcaggatgttctcaccgctactattggacgtccagagcaccctagacgtatctgtgctgctggagccggtatcaccatcaagaaatacttcggatcggctccacggacgtcccgcagctcttcctccctaccttctaaagaattgcaacaactcacccagcaaatcagggaccaactagaggagttgatcacagaaaaagtgacgcggcagctcatggcatcgttcaaccagatgcagtcccagattcagtcccagatgcaatctcagggacttgcactgcctccagagcctctggttggtccctcaggtcctcgagtaagcacaaaggggagttgtgttgatccctcaggaaacgatcttgagacaggtgactcagataggtgctatggtttgtacatcgaagcaaatcctgcccacctggttgccttggggagagtttatgagggatccactgttgttcataacactcctttgttgcctggccaagtaaaggtgggtgtggaggaggttaaagatgcagatgctccagttcctgtacccactgatgaggtagccgtgtctccgacaaaaccacctcaaaagccgaatccagaggtcgatgatccgctttatctgatgagatcgaccatcccagagcttttcttgaggccttaccag

SEQ ID NO: 51790 - DNA, 228 bp, Glycine max
  Peptide Sequence Number=SeqID_143475
atgcatgctttgttagggtcattcaacagtggaaactggtctgattctaaagtccttgatagtacagggctaagttgccgtactatcacgaggaatcaggtcctggttaagtttagtccaacaagaggaatctgcggacgatgcttgatcaggattaggctaaactatcatgaggaatcggggtttagtatctcaggagacaccataggaacacatgagcattgttag

SEQ ID NO: 51791 - DNA, 204 bp, Glycine max
  Peptide Sequence Number=SeqID_143476
atgtgtctatcggggaagggagagtatgctgatgaaattttctccataaccataaatgagattttcgatgtttgcacttcgtttctaaacgaccatttagaggaaacactggatccaacaaagataggaaaaaaatcactcaaagtgtatcaatctccccacagggcaaggattgacattctcaccctgggtcaaggtttatga

SEQ ID NO: 51792 - DNA, 1142 bp, Glycine max
  Peptide Sequence Number=SeqID_143477
ggtaggttgcgacactctccaaatgcaagccttccgcaagatttacggaaagatcttagagttgaccatagcagagatatccatagaagccattgcatcactcacccaatactacgaccagcctttgagatgcttcacgttcggagacttccaattggtaccaaccattgaagaatttgaggaaattctaggatgtcctctcgggggaagaaaaccatacctttcctccgggtgtctcccctctttgagcagaattgcaactgtggtcaaggattcagcaagaggagattgggtcccgtttatggatgtgttagctttgctaatttttggggttgtcctctttccaaacatagatggtttggtggacctagcagcaatcgacgctttccttgcataccaccatagcaaggaaagtgcaaaaagagtagcgcacggatcatctgttgcttgcccgccctctgtgtttggttggtttcacacttattccagcaagacacaaggcatccatgtccgctccagagccatcgctcgtgaggtagaacaatcaattggttcccccgatggaagggaaggaaaggagggagtccttttctcatgtggagggtacccaaacattccgctgataggaatgaggggttgtattaactacaatcccgcgctcgctataagacaactagggtaccccatgaggggagcaccgatggaagaaagcatgtctcctttccttgtgagggatttcggcgcacaaaatttcaaggctatacaaagaatccataaggcatgggaaaccccgttaaggaaagatcaagaacttaggggcattcgtaatggcatcattggtggttaccatgaatggctgaaagttcatatacgaggtttagattggctcgccaagttaaaagttgtcagcgaagagagttttgaagcaccggaagaggacgaagaattccaagctctcaaaagcgagttaggaaaggcgaaacttgccaaggagaagttcaagttggccgctacacacatccggaaggagtgtgccggattacgggaagagaatgcaactaccgcaagagcccttgaacaagaggccaagagggctcgcaaggaagagtatggccggaacaaatttcgtggagctctgtggg

SEQ ID NO: 51793 - DNA, 155 bp, Glycine max
  Peptide Sequence Number=SeqID_143478
atggtaacggtaagcacaatgttagccgtagcaaccacaagagcttgggaattacatcagatgaatgtgcacaatgcatttttacccgaggaccttgaggaagttgtgtacatgaagccacctcttgggctttctttcctcaacaatatggcatg

SEQ ID NO: 51794 - DNA, 326 bp, Glycine max
  Peptide Sequence Number=SeqID_143479
ccagcccgcatcaattagaccttgcaccttacgcttcaagcccctacgatgctcaatggaatgccccggggattctccatgacaagcacatgttgcattcgagtcgtattctcggagaaatggaggttgatgaaccttggttggggttatggctaccattgaattatcaagtagatatgggagcaaggatggcctttgtggataactgggcggtgggtaaggagaagacccacatcgatcctttcactggcaaagaccaaatccgcaaagctttgaaggtgccacttgagctgccaggtctctccacctttgggcgtattctttga

SEQ ID NO: 51795 - DNA, 270 bp, Glycine max
  Peptide Sequence Number=SeqID_143480
atggaacatcaaagaatactgggaaaggtaactgagtcagaggaagtgaagagaaggttaggaggtgaaagtgtggtgacagagaaaaagtaccaagagatgtatgtgaatagtccggggaaaggtgtggttgataagcttaaaggtatggttgggacatggtttaccaacccagcagagaatcaatcttcacaagtttttcgattttcttatcttggaagaagtgttttgagaaacaaaggaaattatgattatgtatgtttctgttag

SEQ ID NO: 51796 - DNA, 222 bp, Glycine max
  Peptide Sequence Number=SeqID_143481
atggctaagttccatccggagatagtcatgaagttgtatgctaacacttggcctatagaagaaggagttagagacaagcgctcctgggtgaggggccaatggattcccttcgatgaggatgccatcaatcacattctggggcatccactggttttggaggaaggtcagcgctgtgacggaatggagaaggagaaagatgaatggagatgccacttcaagtag

SEQ ID NO: 51797 - DNA, 270 bp, Glycine max
  Peptide Sequence Number=SeqID_143482
atggagggttgcactagaaggtccccagcggagtcgccaactgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaaggttcgggagttgtatttacgcacggggaaggtattagcaccccacacgtccgccccaagggacggcagcctttaa

SEQ ID NO: 51798 - DNA, 1130 bp, Glycine max
  Peptide Sequence Number=SeqID_143483
atggctccaaaaaagctttccgcgaaaagatctaggagggacgccgcggcggaagggaccagtgccacccccgagtttgatagccaccgtttcaggagcgccgagcaccagcagcgtttcgaggccatcaaaggatggtcgttccacagagagagacgcgcccagctcagggacaatgagtacacggattttcaggaagaaatagctcgccgacattggacatcgctggtcactcccatggctaagtttgatccagatatagtcctggagttttatgctaatgcttggcccacagaagagggagtgcgggacatgcgatcatgggtgaagggtcagtggattccctttgacgtagattccctcagccagttcctgggcgacccgctagtgttagaggaaggccaggagtgcgagtttagtcagaggaggaacaaggccaatgggttcgacgaggaggccattgcccagctgttatgcaccccgggacagtatttcacccggaccgctgcagggagcaatatcttgcctagtgatcataactccaatctccctctaccgaagtgtcagctggtgtatgccatcctgacacggatgagcgtccatgtggctcagttgattgttgatgccatctatttatttgcaggtatgccacccaccaggcaccctctagacctggataagtctaatagggccctggggtttccgacattgatcatggtcctctaccagtcattcggggttctcgtcacccctagtaaggtgatccaaccaccgatcacccgggccttcattgagaagtattgcatgcctaagcaggcgcagggtgatgcacctcaggccgcagacgcaccactaccacctcatcaggctgatcccgctgggtcactaggcatggagcattatctagagcacttggtttgccagcaggcggccaaccaccgggggcagggtttcgctccttttgcgtgccctactccagagcagtttagggctgaggtcgcatggcccagagattggcccgaggcccatgccggggaggcgcctgcaggatctcccggcgatgcagaagaggcccgcatggatgaggagatgacggacttgctcggtttcttgggaggaagcggagccac

SEQ ID NO: 51799 - DNA, 450 bp, Glycine max
  Peptide Sequence Number=SeqID_143484
caccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttctcgcccaggctagcatctagctcgcctgggccaccaaatagcttcatggtgaagaaactagctcgcctggacgagctcactgcttcagggttccaaggttcagaagttgagggaattgagagaagagagaaggaagaggaaatgaggccggggcactatcaagcttatcgataccgtcgacctcgagggggggcccggtaccagcttttgttccctttagtgagggttaatttcgagcttggcgtaatcatggtcatagctgtttcct

SEQ ID NO: 51800 - DNA, 264 bp, Glycine max
  Peptide Sequence Number=SeqID_143485
atgcagctcccggagacggtcaacagcttgtctgtaagcggatgccgggagcagacaaccccgtcagggcgcgtcaccgggtgttgtcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 51801 - DNA, 288 bp, Glycine max
  Peptide Sequence Number=SeqID_143486
atggggtacacagtcccaaagccacaagtgtggaagcacgaagaggataaaaccactaggttgatcacccaccttccaatctatacatctaatgagctcgaagaggcaaaatccactaggccagttgtcggatggcaaggggaccgttgcgcaacttcattgatcaatgaaggtgggcgccaagcgtctttgtgccaaacaatagaggtggattacgggactttatacccttgttccaaggaggaagtcatgaaagcgaggtcaatgtattcagactggttgtcctaa

SEQ ID NO: 51802 - DNA, 228 bp, Glycine max
  Peptide Sequence Number=SeqID_143487
atgaatttattccttagcgctgttcatgtgtcctccaccatcgaggctggagccccgagaattgatttcctagagccgtttgcctatcctccaccctcaactcttattcagagacccatcgcgattcatctgtcctccaccatcgaggctggagccccacgaattgattgcctagcgctgttcgcctatcctccaccttcaactcttattcggagacccatgaattga

SEQ ID NO: 51803 - DNA, 618 bp, Glycine max
  Peptide Sequence Number=SeqID_143488
atggataaggaagagggagtgcaagaacagatgaaggccgacctatcagccttaaaagatcaaatggcttctatcacggaggctgtgctaaagcttcaaaaaactatagaagataatgctacggcggccgcttccaatacagctagggaagcggaaccggtgctactgcctgcaataaacttgggccaagacagaaacacaatgggtttcaatcggaggtatagtcctcaagcctacccttatggtttgcctctggacttcactccccgtactgctccagatgatttgagccaagcccctaccttcgaggggcagctccctcctcatgccaactatcctctgcaagaagatgatgaaagagatgcccatttaggccctctacttcccctcaaggatccagccccccaaaagaccaattctctcctgttcccatggcgtattctgagttgtggccctcattattggaaaatcatttggtggtggccatacccgggaaggtcttccagccaccataccccaagtggtacaactcaaatgccacatgcacataccatagtggagcccctagacacaacattgactcttgcctgccattcaagtataacgtgcaacacctaa

SEQ ID NO: 51804 - DNA, 486 bp, Glycine max
  Peptide Sequence Number=SeqID_143489
atgtgggcttttctcatcggtcgtcagatcgactgggcccatttggttcggtaccgaatccataaggcattacgagccaatgcacctctaccttatccacagttgataactttgtttctgcgtcattttcaaattccgcttgatgatgagccatttgttcaagtcaagcgttcctttgcaattggtgctggtgctgtgacttcctttggttaccgtaaggatcggaatggtcaatggctgaagaaagacgcactccctcctcaagatgaacgtactccttcacctcttcctcagcgtgaagattcagctctcttgaatgaagtccttaccgaattacgaggtcttcgttcttatgttggtgaacgttttgactcattggatacatgctttgccggcatggatatttgcctcacacaagttgaagaagatgtctccttcatccgtacttgctttgatccaccaccaccgcctccatcatcctcttag

SEQ ID NO: 51805 - DNA, 676 bp, Glycine max
  Peptide Sequence Number=SeqID_143490
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggggagagctttcagtcttccctgattaagtatgatgttggcattgggatttgttgtagatgccctttatcagggtatttgatttttccaaatgctacttctatgtctattgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 51806 - DNA, 124 bp, Glycine max
  Peptide Sequence Number=SeqID_143491
tccatggtcagatgtcgcgacaagttggcagcggaagtcaaccaagggtcacgaccgaccgtcgtctcttcccggcactagacaagcagaggacgtcgctgcaaggcagcccaatatcctttga

SEQ ID NO: 51807 - DNA, 404 bp, Glycine max
  Peptide Sequence Number=SeqID_143492
cccgaaccaagatagatgtttatgctggcacattgtctatggaatttggtgatattgttgttcattttaacattcttgatgccatgaaacatccatctgaggatcattctatttttcatgctgagataattgatcagattgttgatgattatatgtttgattttgattatgttcttcatgataggaaacatccatttttatctgatctgcatgtctgtcactcttcatgcattgaatatgaatttgtacttaatcatatggctgaatttgatgctgagagtgaatctgaaattgatattgattacatgtctggtgatgttttacctcttgagattgattttctagagtcagatagaactaaccatgtttcaggaagtacacatacatctgactttctttataag

SEQ ID NO: 51808 - DNA, 994 bp, Glycine max
  Peptide Sequence Number=SeqID_143493
cctaggcaacaacttcgtccagcgcatcgatgatccgttccagcggtgccggccgccccagcaggtaaccctgcacctggtcgcagccgtgcgcggccagccagtccagctgccccggcgtttccacgccctcggcgatgatggtcaggcccatgctgtggcccagcgacaacagcgcgcggcagatcgaggcattgcgcggattggtttccacgtcggcgacgaagctgcggtcgatcttcaggatgtccagcggcaggtgctgcaggtaggacatgctggaatagccggtgccgaaatcatccagcgacacgctgatgccctgctcgtgcaggcgctgcatggtctgcatcgcctgcgccggcttgcgcatcaggctgctctcggtcagctccacgtgcagggcaccgcgggccaggccgaagtcctgctgcgcacgggtgaactcggccaccaggtcgctgttgaagaactgcaccgccgatacattgaccgcgatcggcagctcgccccaaccggcctcgaccagccggcgctgcgctttcgccgccgcgcggatcacccagcggcccagcgccaggatcagcccggtctcctcgcacagctggatgaactcgttgggcgggatgaagctgccgtcggcctgcggccagcgcagcagcgcctccaaggcggccggggtgccatcgctggcatgccggatcggctggaaatagagctggaattcgttgtcgatggcggcatggatgcgcccggccaggcgcagccggtcggccagccgtgtggtcaccgccgcatcgaaccagaccaccacgttgccctcggcgcgtgccgcgtgcgcggcctgcgcggccatgccgatcacctgctcggcactgtggccgtcaccggcagtgtgcacggccacaccgatgcgcggttcgaactggtgcagcgaatccttgccacgcatcggcccgacacgatctgcagcaggtcgtccagcacgcgcggg

SEQ ID NO: 51809 - DNA, 270 bp, Glycine max
  Peptide Sequence Number=SeqID_143494
atgactcaaaagctggtagcccgcggaaacaccttacggttatccgcacctcgtcatttagtggccccaagtgcgattgatgaacagaggccaatatggtcattctgcaccctttgtcatccagaggcggcaggcccgatgacatgcggagacaaaatttggtcattccgcacccctttgccattcagacacagtcgtgtccgatggcacgcagagaaaaaatttggtcattctgcaccctttgtcatccagaggcggcgggcccgatga

SEQ ID NO: 51810 - DNA, 303 bp, Glycine max
  Peptide Sequence Number=SeqID_143495
gctaaaggcccaagtggagaaggacgaaggcccaagtggagaaggacgaaggcccaagtggagaaggacaaagcccccgagtggagaaggatgaaggcccaaacttatcaaggtaatccttgtggcgtctacccagacttatcttccttcattggaagtggcgtctacccagacttatcttccttaaccggaagtggcgtctacccagacttatcttccttcactggaagtggcgtctaccctgacttatcttccttcactggaagtggcgtcatccaaatcttcgtagcctgtatcaagtga

SEQ ID NO: 51811 - DNA, 444 bp, Glycine max
  Peptide Sequence Number=SeqID_143496
atgatggcacatcaggaagagagagaccaatcacgagcacatagcatggtcttaaaagaggagttagctgcttgctcaaggtccaagagaagcttgtctcagtgtttatgcaagacagagaccaacatgttagccatcgtcagcaagtaccaagaggaattaaatctagccacggcccatgagcacaaagtggcggacgagtatgcccgagtgtacgcggaaaaggaggctagaggaagggtgatcgaatcgttacatcaagaggcaacaatatggatggaccgatttgctcttactttgaacgggagtcaagaacttccccgattgctagccaaggccaaagcaatggcggacacctactccgcccccgaggtgatccacggacttctcagctattgtcagcgtatgatagacttattggcccatataattagaaaccgatag

SEQ ID NO: 51812 - DNA, 705 bp, Glycine max
  Peptide Sequence Number=SeqID_143497
atggtcagcgccgatacgctggcgggcgatccgatcaccgcacgtctgaccgcggcaccgggcaacggcgcctcgattggtggtctgaaagtgatgactgaaaacggctggttcgcggcacgtccgtccggcacggaagacgcctacaaaatctattgtgagagcttcctcggcgctgagcatcgccagcagatcgagaaagaagcggtagaaattggcatcctgcatgaagaaggccgcgtttgcggcctttttttatggcatgaagcgatagccgatgccggtttctgtcagcaggtgcgtcggctgggtggggttggcttccagcttttgccgcaggtgtcccatatagatgcgcagcactttgccggcgttattcagcagcaggctgagcaggcgaaattcggtcggcgtcagatgcacctcttcgccgccgcgcagcacgcgtcgcgcggcgagatcgacgcttacttcgccaaactgcaccagcggttccggctggctgcgctgatgacgacgcagcgccacgcgcacgcgcgccagcagttcgccgataccaaacggcttggtgagatagtcgtcagcgccggcatccagcgcctctattttatcctgctcatcgctgcgcgccgacagcacaatcaccggcatgctgctccactgccgcacttcacggatgaaggcattgccatcgccgtccggtaa

SEQ ID NO: 51813 - DNA, 1173 bp, Glycine max
  Peptide Sequence Number=SeqID_143498
atggtcgcccggaagatttcgcccgcacttgccgccggctgtgccatcgtattgaaaccagcggaacagacgccgctggtggcaggggcaatgttcgtgctcgcgcggcttgccggttttccggagggggcgcttaaccttatctatgccggtcacggtgccgatgtcggtgcggaattgtgcaccaatgccaggatacgcaagatcagcttcaccggctcaaccgaagtcgggcggctgctgatgagccaatgcgcgccgcagataaagaagctcaacctcgaattgggcggcaatgcacccttcatcgtttttgacgatgccgatattgatgaagccgtggaaggcgccattcaggcgaaattccgtaatggcggccaaacctgtgtctcggccaaccgcatctatgtccagtcggcggttcacgatgagttttcggagaaattcgttgcgcgggtggcagaattgaaggttggcgacggcttcgatcccgaggtgaccatcggtccgatgatcgacagccacgccatcgacaagatcgaggcacatctggccgacgccggcgcaagaggcggcacaataaggtgcggcggcaagcgtgtcggcaatggcggaacctttttcgaaccaacggtcctcaccggcgtcaccagcgcgatgcgggtggcgcaggaagagactttcggacctttagcgccgatcatccgtttcaacgatgcggagcaggttgtgcgtgaagccaatgacacgatctacggtctggctgcctatttctacgcctccaatctcaagcgcgtgtggcgtgttgccgaagccctggaatatggcatggtcggtatcaataccggtcgtatgtcgtcggaagcagctcctttcggcggtgtcaaacaatccggcatcggccgcgaagcggccggccgtcacgggttcccgtggatcatcgccctcagtaacatttgtgcgccagcgacgctggctgcgatcagcctgtcgttcatcaacgagaaacgcaggcctttgccgctaggcgtgccgacatggctctcgggccactcccgtgtcgcgaaggaagggcaggagatgacgacctcttcaaacatgatcgccggcccgctcgcgatgcgctttttcccgttcgcggaagattgtcacaggcgtattgccgccggctga

SEQ ID NO: 51814 - DNA, 741 bp, Glycine max
  Peptide Sequence Number=SeqID_143499
gtattagcagcaagggtaagcacgaagggaagctgtgcagcaacagagacaaatgcattagctaaaaaaccctctaagttgaatggtgacaacgtcgggctgcatgtaactgccgagaactccaacaaattagtggcagtgggcaaacagtgcgacagttttggcaccatccacaatgtgccctatgctgatgatgttgttcccgtgagtatggtggaagttatttttggtgatgcggaggttccaatccctacatcagaaataaagtttgtcaaagaagctttaggtagttttgttccatggccaacacatttggaagcagagaaggatgtgagctcaccattgaagactgttgaggaggaaaaggtagctgaggttattgatccattgggagagttggtgaagaacttgttcgacatttaccaaaggcccgttgaggtgtcatgggatggtgctaaatttgggatcaataatgtcaaagatggcttcttcatcatacacgctgatgtgagcgagataatattaggagacaagtgtttaaacatctccattctactgctatggcttatgtttattcatgattggagtgcgagcattggttatggagcattgtatgggttccttgaacctcagtgtatccacaatgcaagcagtagacgtcaagagtgtgaaaattacattggaaggtggttgaaggaagcaggaaaacaaatttacatagcaccttatttaaaccagtaa

SEQ ID NO: 51815 - DNA, 492 bp, Glycine max
  Peptide Sequence Number=SeqID_143500
atgactagaggcaatccatctgacttacaaccttttgatcctgagatatataggacatttcacagattagttaggcatcattttataccttttgatcattctgagcattccattactggtgaatctgtgcattctgttattggtgattttgaacatcctgatcttgagcattataattttgagcactctgattctgagcattctgattttgcacattctgagaacatggcacaacctccaccccgtgagaggactctaagggaaatggctgtacctgatttcacctacgaaagcttgtgcatccaataccctgatgaggatgtcccatatgttcttaaaactggactgattcatttgcttccaaagtttcatggccttgcaggtgaagacccgcacaaacatttgaaagaatttcacattgtctgctccaccatgaaacccccagatgtccaagaggatcacatatttctgaaggcttttcctcattcatag

SEQ ID NO: 51816 - DNA, 288 bp, Glycine max
  Peptide Sequence Number=SeqID_143501
atggtgaaagttggaacctcttacgtgccgatcaacgtatcatcatcgccaaaagttggcccagggcttcccggtatcaacagggacacctggatttatttattctgcgaagtgatcttccgtcacagccgtccctcctgttcagctactgacggggtgtctgcgcaactgtatggaagggcgatcgttgcgggccttttcgctattacgccagctggagaaagggggatgtgctgcaaggcgattaagttgggtaacgccagggtttttccagtcacgacgttgtaa

SEQ ID NO: 51817 - DNA, 312 bp, Glycine max
  Peptide Sequence Number=SeqID_143502
atgagggcgtgtagccctctcaaggagaggacgtgtagtcctctgatggtgagggcgtgcagccctcagatggtgaggacgtgtagtcctctcaaggcgaggacgttacccaaggtgagggcgtgtagccctctcaaggcgaggacatgtagtcctctgatggtgagggcgtgcagcctctgtggtgagggtaactacaaggtgaggacgtgtagtcctctcaaggcgaggacgtgtagtcctctggaggtgagggcgtgcaaccctctgatggtgaggacgtgtagtcctctcaacggtgagggtaactag

SEQ ID NO: 51818 - DNA, 908 bp, Glycine max
  Peptide Sequence Number=SeqID_143503
atggtaccgactattgaagagtttgaggagatactaggatgccctcttggggggagaaaaccgtatcttttctccaggtttcttccctccatgagcaagattgcagttgtggttggggattcggcaagagagttggatcgcatgaggcaaactcgcaacggcatagtgggcctgtcacggaaatatttggaaggcaaggcaagggatagggcgagccaagagaagtggggcccgcttgcggatatattagcttttttgatttttggggttgtcctctttctgaatgttgacggtttggtagacttagccgccattgatgctttcctcgcatatcaccatagcaaggaaagtccagtggtggctatcttggcagatttgtttgacacctttgaccggaggtgtgagaaaaacagtgcacggattgtctgttgtttacccactctctgtgtgtggttggtttcacacctattccaacaagacacaagacacccgtgtccgcttcaaagttatcactcatgcgccaaaaaaggaagattcgattgggaccaacatttggcggggataaggggcagcgcaatcaattggtttcctgattggaaggaaggcaaggaaggaattttcttctcgtgtggggactaccctaatgttccattgatagggactagaggttgtattaattataatcccacactcgccataagacagctagggtaccccatgaggggagcgccaaccgaagaaagtctctcgcctttccttatgagggatctaggcacgaaaagtctcaaggtgatacaaagagtccacgaggcgtggagaagtccgttgaagaaagacaaggagcttagaggcatccgaaatggcgtcatcggtggttatcatggatggctaagagttcacacgcgagg

SEQ ID NO: 51819 - DNA, 527 bp, Glycine max
  Peptide Sequence Number=SeqID_143504
gagtccatgaggtggccatggattcatccttatctactgaaaataaaaagcttgaaggaaaacttgatgccttggtcaacctagtaacccagctcgccatgaatcagaaatctgcacctgttgcaagagtctgtggtctatgttcttctgctgatcaccatacagatctctatccttctttgcagcaatctggagtcaatgagcaacctgaagcttatgctgcaaagatttacaatagacctcctcagcagcaaaaccaacaacagcagaataattatgacctttcaagcaatagatacaatccaggttggaggaatcatccaaatatgagattgccaagtcctccacaacaacaacaacaacctttccctccttttcagaatactgttggtccaagcaagccatatgttcctcctccaatgcagtctgacaaccaaattcaagtgcctccacttgtagcaggacttgcacctgaacctgtcaagcttcattctacacttgaaaaagaggatgagatagttgcataa

SEQ ID NO: 51820 - DNA, 261 bp, Glycine max
  Peptide Sequence Number=SeqID_143505
atggcaattttgatcccaagtacttctccacaaagtgtgcttaggtgtcatgaggcatgtaaagcactcgaaggacatagcacaaagtgtgactatgcatggaaatgtcaatggggacctaggatcttctcattggattcctttgcttcttggaagatgaatggcagcggaatggagaaaggaatgaatcattccctcccccttgaagaggagacgccacttcaaggagaagatgagtctagaagaagctcaccaccatag

SEQ ID NO: 51821 - DNA, 213 bp, Glycine max
  Peptide Sequence Number=SeqID_143506
atgctgccggacgtgtacaagaaggtctttgccgattcctatcaacatggtgcacctctcagtagaggggcccgtggagactttgaccgaatgaataggaaccgattcggagaaacaagaagcatgagatacgcggcggcaatctttccgatagcgaattacttgactcgatggatggagggccctccaactcaagcacgaaatcaatgttga

SEQ ID NO: 51822 - DNA, 258 bp, Glycine max
  Peptide Sequence Number=SeqID_143507
atgaaggacatgcacaatagtagtgactccctaaattcgagacccaaaaataatgaagaccttaatctggagaataaatgtacaaagataagtgggctcatactgagccaatgggtccaaaaagtctaccctaaggaacttaagagaaccctaggccttttcctacgaagatgctctgatacccatgatgcttctgtggagcttgtaggccttggagttttctatccaatggagtcattttctcttgaaggtgggtag

SEQ ID NO: 51823 - DNA, 433 bp, Glycine max
  Peptide Sequence Number=SeqID_143508
gcaccctctagacccagataagtccaacagggccctgggatttcccgccttgatcataggactctgccagtcgttcggagtccccgtcgcacctagcaaggccgcagacgcgccgccacctcatcaggctggtccagccgaatcatttgatacagagcagtatttgcggcatttggttcgccagcaggcggccaaccactgggctcatgtacaaactcatgattatctttaccagatgagcctcagcctgcagagccagggttttacttattttccgtgccttactccggaccagttcagggcagaggtcgcatggcctgaggcccgggcaggagaggcgccagcagaggctcccgacgaggcagatgaggccctcgaggacgaggagatgaccgatttacttgatttcttaggagggagtggggccacctga

SEQ ID NO: 51824 - DNA, 348 bp, Glycine max
  Peptide Sequence Number=SeqID_143509
aggcataggcctactgcctcagcccgtaggcaatgggttcatcagatgactgcggatgcacgtgatatggctgaggatgttgctgacatgattgaggatgtccctgatctggctgaggaggcacctgagatgactacggacgtacagggtactgacggtgctgaggggtcaaatgttgatgatgctgagggattccctggtgggccacgtgacccgtcagtgctgacatcatttgcggaccatgttgcacacgctgtttggagtggacaagaacgtcctgatttgaagttggtgtcacatgggaggaaggtgacattgattgggaggtcagcgcctgagattgaatga

SEQ ID NO: 51825 - DNA, 217 bp, Glycine max
  Peptide Sequence Number=SeqID_143510
gcaatcatgaaacaaagctccaaactcgaaggtggaggacacatgaacagcgctaggcaaataaattttatggataccgtcaaccgcagagaagggcccgtcgggaaacctgtcgtgccagctgcattaatgaatcggccaactcgcggggagaggcggtttgcgtattgggcgctagcggtgtgtatactggcttactatgttggcactgatgatg

SEQ ID NO: 51826 - DNA, 321 bp, Glycine max
  Peptide Sequence Number=SeqID_143511
atgaaggctcgggtgatcggcggtcggatcaccttactaggagtgacaggaaccccgaatgactgtcagaggcccgtgatcaatgccagaaaccccagggccctcaatcaactgagccacatggacgctcatccgtgtcaggatggcatacaccagctaacacttcggcagaggaaggttggagttatgatcactaggcaagacattactgagcagcaatgtcatccatatctgggtcaaggtggtcatgctggtgcgcatgatccgcacccggcttcctgtagcggtccggacaaaatcctggcccagtgtgccttatag

SEQ ID NO: 51827 - DNA, 174 bp, Glycine max
  Peptide Sequence Number=SeqID_143512
atgaggacgcatagccctctaaaggcgagggcgtgcagtcctctgaaggtgagggcttgtagccctctaaagattgactgtccttctaaaagaggcgataattcatgcaaccttatcctatctttgctaatctctccgggaactcccttagagtgtttgttctgtttgatttag

SEQ ID NO: 51828 - DNA, 540 bp, Glycine max
  Peptide Sequence Number=SeqID_143513
gtgtcaacgggcttgtcggccgcgattgacgaagggcgcagaagacgacgtttgtctccgcgtgctatcaggctttttgtcttacagatagcaaaaaagaatgtttatacggataaccactcgggtatttccgcccgtcagcatgactcaaatgtcagtatgacagatcttgtgagcgcggaagatgacgtaattctccgcgtgtcaacgggcttgtcggccgcgattgacgaagggcttgtcatcttacagacagcaaaaaagaaagtttatacgaataaccacactggtatttccgcccgtcagcgtgacacaaatgtcagtatgacagatcttttgagcgcggatgatgacacagcaaaaaagaatgtttatacggataaccactcgggtatttccgcccgtcagcatgactcaaatgtcagtatgacagatcttgtgagcgcggaagatgacacaacaaaaaagaatgtttatacggataaccagtcgcgtatttccgcccgtcagcgtgactcaaatgtcaatatgacagatctt

SEQ ID NO: 51829 - DNA, 282 bp, Glycine max
  Peptide Sequence Number=SeqID_143514
atggactttatactcgcgtgtcgatcagatatcagacaaataccatttttatctgtgacgtgttcacgcaagtgtgccaaaaaccatgaccacgctgtcaacgtctcaccttcgaccaccgcgactgctagaggaaggacaccaccatttccatcttgtgatgtggccattaagagggtcccacggtatttgtcgtacaaatgtgtgccgtcaacttatatgattggcttacagtacttgaaagcctctttacattggccaaaagtccaaaaaactctatga

SEQ ID NO: 51830 - DNA, 640 bp, Glycine max
  Peptide Sequence Number=SeqID_143515
gaaagcccggccagaaccacacgtgcaagtttccctgcatgtggctcgtccgtgataacttattcggatttgcgcgaactagcggaccgatcactaagtggggatgctccctccagcatgagcgaaccttttcgaaactggttaggaatgggcgtcactatcccagccctgatccagccagaagaggaaatcgcaatgcatcttgctcagctggcaaggcgtagcttggagtgggagtgtagcgtgggtgccggaggtcccccagttcctcggcagcacctcgaggtgcatttagttgtcttacatgagactcgggatattcctcactccatggcatggcacctttcgctcatccattccgcccgtccagacgcggcgccctttttcattatcatctaccgccctttctttcctcccggctattcacgcatgaagatcgtcgtatgtatgctcgacttcggttgccggatcagtcacccgggcaaaccaaccctcctccaagaagaattgtgctatgccctcccgatccctatagagcgaaagagctgcctggtgatccctaggttgcagcacgtccggtcgttaactcctcgcgccgctgccgccgtttctaggaccgaccgacgcctcgcctgcacag

SEQ ID NO: 51831 - DNA, 233 bp, Glycine max
  Peptide Sequence Number=SeqID_143516
cgcaaggtgaacaaccccagcagcttggggacgaccggcagcgggcaacagacgctctgccaccacctctagagttcacctcagctcatccacaaaaggttagagcgttgcctatgacacatggccgaccaataggcgaccaagtccaaggccaaaggacgcacctagttgctcatgatcctgggaatttaaataaaacaagcgcaagctcggaaggtagcaagataccttag

SEQ ID NO: 51832 - DNA, 201 bp, Glycine max
  Peptide Sequence Number=SeqID_143517
atggtagaaatcaaccaaggtaagacgatgaccggtcaggattggtcgcgtatttttgtttcctacttgcaggttagctcgcctgggcgagttgagctcgcctgggcgagcaacccctgcacccaaattataaaaaacgagggaggggaacgttttggcatccaaaaacttccccccccccccccctcattcaaaagatag

SEQ ID NO: 51833 - DNA, 375 bp, Glycine max
  Peptide Sequence Number=SeqID_143518
atgtgtcctccagaaaaggtcaaaacaaacggtgttcaaaagaaaccgatgaccaaacatcaaagatcaacaaagcgtgattcgtcttattgggagaatgtggatgcattacattttgtgcaaaatagtaattctttagtcaaacatagtgcattatcatctaagcaagcaattccaagaaggactctgccaatattggatcaatttcatccatgcattcatgattccattgaaaacattgttgatgtcaaagctgacgataattgtggatatcgtgcaattgttgtcttattagccatttgttttaagaatttgccaaatgatctgatgagtatatcaacctgcttggtggcatggacatatttgagaaattaa

SEQ ID NO: 51834 - DNA, 573 bp, Glycine max
  Peptide Sequence Number=SeqID_143519
atggccacaatgatggaggccatgatgagcatgaagaagataatggaagccaatgtgattgcagttgcggctactggtgttgttgctaaggtgaacccgacacccccatctggccttaaccaaatgaatcatccaacctcagatatggtaggcaaagatttaggaagtacgggcggcccccattatgtgcaaattcaaaacaagcacgccttcccgccatatggcttgcctcccaactatacaccacccaatgtggcgtacactcccagtgagaatgtcaataactccactaccatactcattaagagccaacaacctcaatctaatcatgcacatgtctctcaacccatgagggagacacatgaaattccctaccacaatctagccgacttcgagccttgcctcggattgccactgaagggcaagcagttggtggtatatccctacaaaatactttggaggggcctcaatttcgcccccaaccacaacccttttatggaaaaatggtgggttacacaccttcatgctttgcggatttggtatttgtcggcgaaaggatcacagcgggtctag

SEQ ID NO: 51835 - DNA, 239 bp, Glycine max
  Peptide Sequence Number=SeqID_143520
gttacattaagcaaaaaggcaacaaaaatgaagagaaagaaggagttctgaagcaagcccagcccaacactcgcgctaagcgcgcgtcaggtgctaagcaagcaaagaagacaggcgctaagcgaggcgttgagctcgaagatgtagaatccgttacgcgcgctaagccccagctacgcgctaagcgcgcgatccaacagaagcacaggctaagcctgcagggcgcgctaagcgcgtga

SEQ ID NO: 51836 - DNA, 1004 bp, Glycine max
  Peptide Sequence Number=SeqID_143521
gcggatgatgtcgagctggccacctgtcagttctacggctgggcgcatcttaaccgccaggggctgctgccaacacgcgaacagattgcccgcgccgaagcggtggttgcgcgctaccgtgagcgcatgggcagcagcggtaatctcaccaatctgctgttcgtcacgccggattactacgaagagcggcccaaaccctgtatgggcggctggggatcgatatttctcagcgtgacgccggaaggtacggcgttaccctgtcacagcgcgcgccagctgccggtgcagttcccttcagtgctggagcagagcctggaggatatctggtacaactcgtttggcttcaatcgctatcgcggcttcgactggatgccggaaccgtgccgctcatgcgatgagaaagagaaagatttcggcggttgccgctgccaggcatacatgctgaccggcgatgccgataacaccgacccggtgtgcagcaagtcgccgcatcatggaaaaattcttgaggcacgccgagaagccagctgcagcgatatcaaaatcgcccagctgcacgctggctttaccggcgatgagcgcctgatgccgtggctgcagcaacagggtggtcaggtgaatgccaccacgcaactcagccgcagtgcctggttcttccagctgccggcgcaggcgctggcggcgggcgtggcaaggctggcagatatgctggctgcgccactgctaaccggtacggcgattacgcaggaagcggcggtcatcgaggcagaatttcagctgctacggcatcatgccgaaacgctgagtgaagcagcgctgctcgacgcggccggtggcgcactgcgccgctttcgcgtcgggagtgcagcgtgttttggtgacaacgtaacggaactgcagcaggcgctgaggctgtttcatcagcagcattttgtcgccgccaaccagcagctgtggctgagcggaccgcaatcgctggatgaattacagcagctggccgaggc

SEQ ID NO: 51837 - DNA, 848 bp, Glycine max
  Peptide Sequence Number=SeqID_143522
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgctggcacagccggctgcaactggcgcgccaggcgctgacgcggccggtgctggcctgcctgggcctgggcctggccggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 51838 - DNA, 513 bp, Glycine max
  Peptide Sequence Number=SeqID_143523
atggtagttattcagcacttccaggttgtagtacaaaatgccgccggcgccgaggaacacggccaggcccaggcccaggcaggccagcaccggccgcgtcagcgcctggcgcgccagttgcagccggctgtgccagcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 51839 - DNA, 349 bp, Glycine max
  Peptide Sequence Number=SeqID_143524
ggattgtgcccgtaagacacctagtggacccgaagaaggccaacaaggtcttggaattgccaactctaaatacgggtctctgtcagttatagggagtgtctgtcgcccccagcaaggtcatcaggccccctaccaatcgagctttcatcaagaagtgttgcgcccccaggcaggcgcagggcgaaacaccacagcagcattgggatggccggtagcaggcaatagacacaccgccaccacctctaaagttcacctcaactcatccataaaatggttagagcgttgcctacgacacatggccgaccagcaggctacccagtccaaagccaaagataagcaaaagtactag

SEQ ID NO: 51840 - DNA, 96 bp, Glycine max
  Peptide Sequence Number=SeqID_143525
gaggtgcaagagcagataaaggctgacatggaggccatgaaagagcaaatggtcacgatgatggaagccatgatgagtatgaaaaaaatgttggag

SEQ ID NO: 51841 - DNA, 669 bp, Glycine max
  Peptide Sequence Number=SeqID_143526
atgacccacgagcacaaagtggcggacgaatacgctcgagtgtacgcggaaaaggagactagaggaagggtgattgattcgttacatcaagaagcaacgatgtggatggaccggtttgctcttactttgaacgggagtcaagaacttccccgattgctggcaaaggccaaagctatggtagacgcctactctgcccctgaggagatccatgggctcctcagctacagtcagcacatgatagacttgatggcccatataattaggagtcgttggggagtttatattgtcgctcagatcttgactaaaaatcagtgtgcatcagatcacttccacatttcatctctagcatacattcatttctcattacgtactcccctcacatttgatctttttaggaaagacgccataactaagtgtgccccaagacatccctatcgcaccagatccaaatctaggatgatgggtgacctagaggaagtacaagaacagatgaaagtcgacatgtcggctttgaaagaacaaatgtcttccatgatggatgccatgctgggaatgaaacaactaatggagagtaacgcggccaccgccgccactgttagttcgactgccgaggcagacccgactctcccgactgttgcgcaccaccctattccaaacatggtgggatga

SEQ ID NO: 51842 - DNA, 144 bp, Glycine max
  Peptide Sequence Number=SeqID_143527
atgtggaccaccatgggggagatgcttgccgcccagctcgcccaggcgagcagggttgcttcctccagaagcaacaaccttctggaggaatattctggagggccaagtgggcctgggtgctatttgcacccccatttttactaa

SEQ ID NO: 51843 - DNA, 601 bp, Glycine max
  Peptide Sequence Number=SeqID_143528
atgaggggcaccgtgcatgagcctcaagtgaacataggggccgatcaaaaaggactacacgtcctcgccaacagagggctgcacgccctcaccttaagaggactgtatgtcctcactttcagaggactgcatgtcctcaccttcagagggctacacgccctcgccatcagaggactgcgtgtcctcaccttcagagggctacacgccctcgccatcagaggactgcatgtcctcaccttcagagggttacacgccctcacctttagaggactacacgtcctcgccaacagagggctgcacgccctcaccttgagaggactacacatcctcgccaacgtagggctacacgccctcacctttagaggactacacatcctcaccaacagagggctgcacgccctcacctttagaggactacacatcctcgccttcagaggactccacgtcctcaccttgagaggactacacgtcctcgccttgagaggactacacgtcctcgccttgagaggactacatgtcctcaccatcagagggctgcacgccctcacctccagaggactacatgtcctcgccttgagagggctacccgccctcgccttgg

SEQ ID NO: 51844 - DNA, 785 bp, Glycine max
  Peptide Sequence Number=SeqID_143529
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataaagaaatctcaagaaccggttggttccttaggaactggacttaggcacagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 51845 - DNA, 276 bp, Glycine max
  Peptide Sequence Number=SeqID_143530
atggtgaggacgtgtagtcctctcaaggcgaggacgtgtagtcctctcaaggtgagggcgtgcaaccctctgttggcgaggacgtgtagtcctctcaaggcgtggacgtgtagtcctctcaaggtgaggacgtgcagtcctctgaaggcgataggtacaagtacccaagggtccacccttatgagaaagcaagagatcgactcatcgagagggccggtcatcccaaatccacaagatttggacattagatgtaggaaatctatgcagttaacatga

SEQ ID NO: 51846 - DNA, 435 bp, Glycine max
  Peptide Sequence Number=SeqID_143531
atgcatatgaatgtggggtaccacatctcccaccagatctccctcatagcacagcatgacacatccagactaggattccctgccttgatcacagcttcattaactttcagaggacccaagaaggccaggggtaagagatttgaggccccttccacttcagcatcagaggcaccaacaccttcttcttctacagtacctccctcttcatccactcagattccagttattcctcctgcacccacacagataccacttccagctcctctatctgcagaaccaacagattttatttttacaccacagatgcttcactccatgctccagagcatccacaagggacaatccatcatcatgcagagccttcagggcttgggcttgccctccattatgagcatgaaggagtttgagactcaagtggcctggccaggagactag

SEQ ID NO: 51847 - DNA, 204 bp, Glycine max
  Peptide Sequence Number=SeqID_143532
atgaagatgctcttcataccacatgatgtagctccctgtggagcttgtaggccttggatcttcttcatcaatggagtcctttgctttttgaagtttgatggcagcagaatggagaaggagaaatatgattggagatgccacttgaaggacaagatgagtctagaagaagcttaccaccataggaagccatggataagagcttga

SEQ ID NO: 51848 - DNA, 303 bp, Glycine max
  Peptide Sequence Number=SeqID_143533
atgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggcgtatcacgaggccctttcgtctcgcgcgtttcggtgatgacggtgaaaacctctgacacatcagctcccgagacgtcacagctgtctgtaagcgatgccggagcagacaagcccgtcaggcgcgtcagcggtgttggcggtgtcgggctggcttaa

SEQ ID NO: 51849 - DNA, 637 bp, Glycine max
  Peptide Sequence Number=SeqID_143534
ggcagagattaatataaagccatggcatattttgttgggagggttgaaagaaggcactacgaggataccatggctgaacagagagccttatgcttactggaaaggtaatccagctgttgctcaaaccagacaagatctcatgaaatgcaatgtttatgaaaatcaagattggaatgctcgtttatttgcccaggattggtttcgagaatacaagaggggttcaacaaatcagacttgccaagtcaatgcacttatagatataaggtgtacattgaaggttctgcttggtcagtcagtcaaaaatacattctgtcatgtgactctaccactctacgtgtacgactacatgtttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaataccgacccttgcaccatgcctgccccttttgaccctccaactttgtatgcaacattagagagaaaggaaagctcaattcaacaagttgaatcatgggagagaagttattgggataatcaaaccataacatcttaa

SEQ ID NO: 51850 - DNA, 525 bp, Glycine max
  Peptide Sequence Number=SeqID_143535
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatccgaaccgatcctggccgcactgaacgggttgctcggcattcccgtggcccacccctgagcgaggacgcgaccgtgagctatcagatcagcgtgctggacaagagcccggtggccgagggggcttcgccggagcaggcgctgcgcaacagcctgcagctggcgcagcgcatcaagcttatcgataccgtcgacctcgagggggggcccggtaccagcttttgttccctttag

SEQ ID NO: 51851 - DNA, 612 bp, Glycine max
  Peptide Sequence Number=SeqID_143536
atgaccggccctctcaatgagtcaatctcttgctttctcaaaagggtggacccttgggtactagtaccctcaccttccgaggactacatgtcctcaccttcagagggctgcacgccctcgccttcacaggactacacatccttgccttcagaggactgcacgtcctcaccttcagagggctacatgcacgccctcaaaggactacgcgtcctcacctttagagggctacatgccctcgccttcaaagggctactcgccctcatcctcagaggactacgcgtcctcaccttcagagggctacatgccctcgccttcagagggctactcgccctcatcctcagaggactacgcgtcctcaccttcagagggctacatgccctcgccttcagagggctacatgccctcaccttcagaggactacacgtcctcacctttagaggactacacgtcctctccattagaggactacacgtcctcgccttcagagggatacacgtcctcacctttagagggttgcacgtcctcgccttcagagggctgcacgccctctcctttagtgggctgcacaccctcacttttagagggctggaagccctcgccttcaaagggtga

SEQ ID NO: 51852 - DNA, 534 bp, Glycine max
  Peptide Sequence Number=SeqID_143537
tgtcaactctggatgggttactccttttcagcttgaatatgttttactgagctcctttggaataggtcctaagtttccagaatggctaaaaaggcaaagttctgtgaaggttttgacaatgtctaaggcaggtattgcagacttggttccaagttggttttggaattggacattgcaaactgaattcctggatctgtccaacaatctgttaagtggagacctatctaacatctttctcaattccagcctcataaatttgagttctaatttgttcaagggtacattgccaagtgtgtctgcaaatgttgaagtgctgaatgttgccaataactcaatttccggaacaatttctccctttttatgtggaaaggaaaatgctactaataagttaagtgtgcttgatttttcaaataatgtcttatctggtgatcttgtcactgttggggcgagccctggtgcagcggtaaagttgtgccttggtgatttgttggtcatgggttcgaatccggaaacagcctctttgcatatgcaagg

SEQ ID NO: 51853 - DNA, 174 bp, Glycine max
  Peptide Sequence Number=SeqID_143538
atggaccaaattagacacacaagttgtccgtttgaggcccactatgatgagaatcatgaaactggcctaatacaggcgaatcatgaaactggcctaatacaggctaaaggcccaagtggagaaggacgaaggcccaagtggagaaggacaaagcccccgagtggagaaggatga

SEQ ID NO: 51854 - DNA, 414 bp, Glycine max
  Peptide Sequence Number=SeqID_143539
atggtggctggtaatacaacaatagagaaacctagagaagagtggtctgaagaagaaaaaagattagtgcagtacaatttaaaggctaaaaatatcattacttctgccctaggaatggatgaatattttagggaacatgagatggagttgcaaagactaaatcaacatgaagaaaatgataagaagaaaaagggaattgctcttaaagtctcatcttcaatccaagaggaaagtgacatagaagattcaattgatttagatgaagatgaagatcttagcctctttgtcaaaagattcaacaaatttattagaatgaaaggaaatcaaagaagaaaaacttcaaatctaaaagaagaactgaagagtcatctcaaatcccaaaatgctttgagtgcaatcaacccgaacatctga

SEQ ID NO: 51855 - DNA, 789 bp, Glycine max
  Peptide Sequence Number=SeqID_143540
atgagtggcggcgctgcttaccatgccgtcggcgttaagccagattgggagcatgatgtgtgcatgctgcaaatggaagatttgccattgacacctgtcaccatgaaatccagccgtgaacttaaatatgagcagcctgtgtttaccattggctatcctagctttgtgccggcaccggtgagcaccagtggggtggtcaaaggcttgtttaccatggatgactctgtcattgtgcgggcgaccagtaccttcaggcagggcgctagtggcggcgggttgtttgatgacagcggtgcattagtcggtttgatcacgctcaaaagcccaggcaaggatgcatattactactacatgtcagtggattggatccaggctttgatcagcaaaccggcaggtcctattgttgtgaaaagcgaattgcctttctggggtaaacctgctgccgagtggccttactttatgaaagtggtgtatccatacctgcataaagactggaaaggcctgaaagtgattgccgagcaatgggcagcgaaagagccacaaaacaccgaggcctggttttacctggcggctgcagagtatgaaacacaggacttcaccattgccgaacaacatctgcaccgtgtactcagtatgaatgaccaacatagccaggctttttactacctgggtatgattgctgaagccagcggtaagcatggtgaagcgatggccagtgtagatgcactgaaacaactggatgcagaagcggccgaagccttgacggtagcaatgaaaagcctgccctag

SEQ ID NO: 51856 - DNA, 336 bp, Glycine max
  Peptide Sequence Number=SeqID_143541
atggcgttaaaacggtccctcgtcacatcacttgaagatttctttttcgtccccgcttgtcggttccacggttcctcctggtgtggggtttcaacggagaacaatggcattttgtggtggctactggtggctgtgggtgatggagaaagagcttggaatgttggaaatggttttggaagaaagaaggagaaagaaatggcgtttttccaaagctacttggactacaaggctcaaaacgcacaagtgactaaggctctcggaaacggaagcgtcacgcacactccagacgtcttcccaaagatcccaacggtcagatcatggaaaattgttctgtga

SEQ ID NO: 51857 - DNA, 123 bp, Glycine max
  Peptide Sequence Number=SeqID_143542
atggaagttggaagttggaagttggaagttggaagttggaatgaaaattattggaagttgaaagttgaaaatggaggttggaagttggaagttgggaggggaaaaattattgtgcatagttag

SEQ ID NO: 51858 - DNA, 492 bp, Glycine max
  Peptide Sequence Number=SeqID_143543
ggatcgcacccacaaagacacccagtggacctgaagaagtccaacagggccctggggtttccaactctagttatgggcctctgtcggccctacagggcagccgttccccccagcaagttcatatcgtcgtggcatagggatcgtgcccgcaaaacactcttgtggacccggagaagtccaacagggtcttggagttgtcaagctctaattacgggtctctgtcagttctacgaagtacctgtcacctccagcaagggcatcaggccccctactaatcgagctttcatcaagaagtactgcgtctccaggcaggcacagggcgaaacaccacagcagcctggggatggccggcagcgggcaacagacgcaccgccatcacctctagagttcacctctgctcatccacaaaaaggtttgagtattgcctacaccacatggccgaccaataggcgaccaagtccaaagccaaaggacgcacctagttgctcatga

SEQ ID NO: 51859 - DNA, 510 bp, Glycine max
  Peptide Sequence Number=SeqID_143544
cgtgactcaaaagtcagtatgacagatcttgtgagcgcggaagatgagggcgcaaaagacgatgttaatctctgcgtgctatcaggcttttcgtcttatagacaacaaaaagtttatacggataaccactcgggtatttccgcccgtcagcgtgactcaaaagtcagtatgacagatcttgtgagcgcggaagatgacggcgcagaagacgacggtagtctctgcgtgctattaggcttttcgtcttacagacagcaaaaagtttgtacggataaccactcgggtatttccgcccgtcagcgtgactcaaaagtcaatatgacagatcttgtgagcgcggaagatgacgcttttcgtcttacagacagcaaaaagtttatacggatagccactcagggcgcagaagacgatgctagtttatgcgtgctatcaggcttttcgtcttacagacaactaaaagtttatacggataaccactcgggtatttccgcccgtcagcgtgactcaaaa

SEQ ID NO: 51860 - DNA, 148 bp, Glycine max
  Peptide Sequence Number=SeqID_143545
tggcgtctcctctctctcttccttcttcattcctctgccattcatcttccaagaagcaaaggaatccattgatgaagaatattctaggcctacaagcgccaatggagcttacattacatcatgtggtattaagagcatcttcatctag

SEQ ID NO: 51861 - DNA, 426 bp, Glycine max
  Peptide Sequence Number=SeqID_143546
atgaccactcttacacagatatggatgaagttactacttagcaacattctgcccagcgaccataatgccaatctccccctgcggaagtatcagttgggatcgcgccaacaaggcacccagtggactcagaggtgtccaacagggcccgggggtttccagctttggttacaagcctctgtcattcctatagggtgcccgtcccccccccccccaacaaggtcatgccatcgtgacataggcgtagggcgagacaccacaacagcctggagatggccggcagcgggcaacagatgcaccgccaccacctctaaagcccctcagctcatctacaaaggctggagcgttgcctatgactcgtggtcgaccagcaagcgaccaagtccaaagtcaaaggtagcaagataccttggatacgcatgtatatag

SEQ ID NO: 51862 - DNA, 276 bp, Glycine max
  Peptide Sequence Number=SeqID_143547
atgcacatgaggataaaaaggtctttaaaggttgtaatggggccaggggcaagaaagaggaacataggctcaaaggggctatcaaaggaattaattcaaggtaggctcatttggctagaggcttataagagcaaaatgcctaaatcatctcccaacatgcatgtgaaccaagaagtatcaacaagagtcaagccaaggctattgtgcaagcaatcaatggggcaaaacacaccgaataaaatagatgatgatggctcaaaatctcaccaagggtaa

SEQ ID NO: 51863 - DNA, 487 bp, Glycine max
  Peptide Sequence Number=SeqID_143548
agcgcaagacgccctcaccttcagaggactacacatcctccccttcagacggctacacgtccttgccttcagagggctacacgccctcgccttcagaggactacacgtcctccccttcagaggactacacgtcctcaccttcagagggcaacatgtccttgctttcataggactacatgtcctccccttcagtggagtacacgtcctcaccttccaaggactacacatcctcgctcatcagaggactacacgtgctcaccttcagaggactacacatcctcgccttcagagggctacacaccgtcaccttcaaaggactacacgtcctcaccttcagagggctacacgctctaccttcagaggactacacgtcctcgccttcagagggctacacgtcctcgccttcagaggactacacgtcctcaccttcagagggctacacgccctcccctttaagaggactcacgcctcgcctttagaggactaa

SEQ ID NO: 51864 - DNA, 81 bp, Glycine max
  Peptide Sequence Number=SeqID_143549
atgaccaagccaaatgatgcttcaagtgttcctaatacacctttggatgcaagaagattttctcgtgctagcaacccttag

SEQ ID NO: 51865 - DNA, 345 bp, Glycine max
  Peptide Sequence Number=SeqID_143550
atgggggcctgtggttggttgaaggataatgatgagaaaaagaataaagaaagagttgaaaaagaaatgagaaaaatgatgaagtggagactagtgaaaaagtggaagaaaaagtgtggagcctcagccacaacaatatcgtctaacttaaaggacgttaaagaagcgctcctgggaggcaacccggtgtttttaaactttgtcttaatttttgttactttaatcttatgtcttatatgtctgaaacttactttaatcattgcatggcctagggataggcctatttttcaggaggaggatgaagacatggcagatcctgttgattatttcattggaggagattga

SEQ ID NO: 51866 - DNA, 135 bp, Glycine max
  Peptide Sequence Number=SeqID_143551
atgggtgccaagtaccttgaagtggtcaaacgagggtcgcatcccaacaatgaatggtccccggacgaaattaggatgtttactcagtcaccgcctaaccttacggttttggcagttgtgcatgccgccatgtga

SEQ ID NO: 51867 - DNA, 267 bp, Glycine max
  Peptide Sequence Number=SeqID_143552
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcagtccacgccgctgtgcctcgtcggcgaacgcctgcgatggatcgtcgcgcccggcgatgccgaggtcgatcaagcttatcgataccgtcgacctcgagggggggcccg

SEQ ID NO: 51868 - DNA, 510 bp, Glycine max
  Peptide Sequence Number=SeqID_143553
atgacatttttaggagaaactagcagtcagacgattgtcaactcaaggttggctttcatttttccaaatggatcaattattcacaatgatactggcgtttacttccaaacttcaactccgatgctcattcaagtaccaaatagctgtgattttgcaagcctaaaaaccagaatacataatacccttcagctatccgacaaacaatttttggatgaaattcactaccggaagccgttcaccgatacaggaaaaaattctaagaaatttcaaattccttcaacatgtaccatcgatgaactgaaaaatttaataaaacaagttgcacctaaagggattccccctcttggaattcatgaatcacaaacgctgaggaccaacgaagaactgctgaaggtgttagtacaacctaactactggaaaaaatatggaccaatagaaattttagctgtctttactaaatatgttgtgaaaattgaagacgaggtcactgggacattgctaaacaactga

SEQ ID NO: 51869 - DNA, 507 bp, Glycine max
  Peptide Sequence Number=SeqID_143554
atggggacaaggggttgcatcagttacaatcccgttcttgctataaggcaacttggctaccctatgagaggggcaccgctagaggaagagctcgcgcctgtcatttcacgaggtttcaataagaccaacggggagacactgcagaaggtccgcaaggcatgggacgtggtgcaaaagagggacaaagaactgaggagcagtaacaatgggcccatcggtggctaccgaaggtggttgaaagcctacgtgcaaggtttggattggctcccgagtttgagaaccgctagaagggaggaagttaaggcaccagaagaagacgaagaggtgcaggcccttaggttggaactcgagcaagcccaaatagtcaaaaaaaagttcaaatcagcagctcttaaaatccaaaaggaaaatgccgaactaagagatataaatatagctaccaccaaggccatggaacaagacactaagagggctcgtagggaagagcacggccggaacaagttctga

SEQ ID NO: 51870 - DNA, 137 bp, Glycine max
  Peptide Sequence Number=SeqID_143555
gcttatgcgaagcagtgatgtgatcgattcatcttttgccccattttacgacacagagccggtgtctgccatcgtggccttggctaacacatcgaaacaatgggaagttttgacgcttcccccttctgttgttcaag

SEQ ID NO: 51871 - DNA, 213 bp, Glycine max
  Peptide Sequence Number=SeqID_143556
atggcttattccctagtggatggcgcctcctcccacctcttctcctttgtcttccactgcatctccatggttttactctcgtcgtccggaaatattcaagcccgacgacgtgcaagattcttctctggtgggcagggacgatcgagtgcaatggcgtacggaagtgtcatggttgtccaactttgtcactttcaagacactgaagtttgttga

SEQ ID NO: 51872 - DNA, 672 bp, Glycine max
  Peptide Sequence Number=SeqID_143557
atgtgtaagcgaacaagactcctctcgagaagtaaattatatgggcataccgaatcgtcacggattccagggctacaaccagggaaattcatccaaattccatcaaggggcaacaggattcaatcacgggccaccgagattcaatcaaggaagaaacttcacgcaaggctcagggtggagaggaatcaaggaaatcaatataaggagcaaaggaaccaaccaccataccaaccgccataccagcaccctagccaaggtccgaatctgcaagaaaagcccaccaacatagaagaactgctgctgcaattcatccaggagacaatatcacatcaaaagagcacggacgcaaccattcggaatctggaagttcaaatgggccaattggcacaagacaaagccgaacggtccaccagaactttcggggctaacacagagaaaaaccctaaggaagaatgcaaggcagtactgactcgagggcagagaagagcacaagaggagggtaaggttgaagaagaagaccgaccagaggaagagaggacagagacgccagaaaaagaaaggacagaagaagaagagaaggtggcatcaccacctaagaccaagagccagagagcaagggaagccaagaaggaagaaccacccgccctaccacaggatctcccatatcctatg

SEQ ID NO: 51873 - DNA, 880 bp, Glycine max
  Peptide Sequence Number=SeqID_143558
atggagagaagtatgatagatgctgccagtggtggagcccttggagacatgactcctgctgaagccagaaatttaattgagaagatggcttccaactctcagcagtttagcgccagaaatgatgccatagtcattagaggagtgcatgagctggccttgaatcaaaaatctgtacctgttgcaaggtttgtggtttgtgctcctctgctgaccaccatacagacctttgcccttccatgcagcaacctggagcaattgagcaacccgaagcttatgctgcaaatatttacaatagacctccctcaacctcagcaaaaaaatcaaccacagcagaacaattatgacctctccagccacagatacaaccctggatggagaaatcaccctaatctcagatggtctagccctcagcaacaacaacaacagcctgctccttccttccaaaatgttgctggcccaagcagaccatacattcctccaccaatccaacaacagcaacagccccagaaacagccaacagttgcggcccctccacaaccttccctcgaagaacttgtgaggaaaatgactatgcagaacatgcagtttcaacaagagaccagagcttccattcagagcttgactaatcagatgggacaattggctacacaattgaatcaacaacagtcccataattctgacaagttgccttcccaagctgtccaaaatcccaaaaatgtcagtgccatttcattgaggtcgggaaagcagtgtcaaggacctcaacccgtagcaccttcctcatctgcaaatgaatctgccaaacttcactctactccagaaaaaggtgatgacaaaaatttacctaacaatttctatgcaggtgaatcttcttccactg

SEQ ID NO: 51874 - DNA, 834 bp, Glycine max
  Peptide Sequence Number=SeqID_143559
atgaaaagaatttcaaaagataaaaatatagcaagtccaaagttcagcttatgttgtggagatggcaaagttgaacttccattattacaaaatccaccaaaacatcttgaacgacttctgtttgatgataatgcaactgatagtaaaaattatcaacataacatacggacatataacatgatgtttgcctttacctctgctggtattaagctagacaaatcaattaatgaaaccagaggacctcctacaatttcaattcagggccaaccatgccatcgaataggcagcctattaccaatgcctggaaaacaaccgaaatttgcacaattatatatctttgatacacagaatgaagttgaaaatagaattgataccgtgagtcaaatgctggatgaccacaatgtccatgcaaaaagttttagaatggtcatggatagattgtcagatagtcaactagataatttgaaattgagattgatagctggacgtgaaaaggatggtcgtacatacaatctcccaaatgtttatgaagttgttgccctgattgttggtgatttagatgcagactcaataagggatattattgttaaaactcaaaatggagaattacaaagaatccatgaattacactctagctatctaggactgcagtaccctttactcttcccttatggtgaagatggatatagacctgacatacttcaccgttctacatctggcagcaaaaaaaggaagagaaatcgtctaacgatgagagactggtttgcttatagacttcaatccaggtcaaatgaagcacaaactttgttgcattctagaaaactattccaataa

SEQ ID NO: 51875 - DNA, 246 bp, Glycine max
  Peptide Sequence Number=SeqID_143560
atgacccgtaagcaaccaggtcgacttgggccttccagaatattcctccaaaaggcagttgcttctggaggaagcaacctggctcgcctgggcgagctgggtggcaagctcctcccgtattttgctataaatagagggaggagtgaagaagaaaaaggttcaaccctcttggcacttcctaatcacttaaaattagtgaggaaaattgtttccgtgaagaaaatccaagtcgaggcgcttccgtaa

SEQ ID NO: 51876 - DNA, 291 bp, Glycine max
  Peptide Sequence Number=SeqID_143561
atgactgagacaagtatgcgagcggggaatgccaatgtgtatggattcctcgagccacagtccatccagagatctgggcaatcacaatttgaatcagaaagttacattaagaactggatgcataattataaacgagatatgtacctaggagcctacttgaatggtgctttgaaagaacttgacaatactccacaaagtaaatccaaagatgctgctaagtggattgttgttaaatatttcaatgatgctagaccattggaaccagagagattgaaggcgcttcacatctag

SEQ ID NO: 51877 - DNA, 255 bp, Glycine max
  Peptide Sequence Number=SeqID_143562
atgcattctaaaactgaagcactagaacatacgaagaaaagagatacaggccatcaaagtgtgtcattggagaataagacaggagattcaactatgctgaagatgggagattcaactaaagttgtgataaaacaagacatgaagggaataaggcataaatatgggtttaacaacaataaacgtgagaaggcacaaaagaaaagggtggtggatgatgaaattggcgacaaacatcagctagatgaagtcttataa

SEQ ID NO: 51878 - DNA, 145 bp, Glycine max
  Peptide Sequence Number=SeqID_143563
cgggttgcttggggactggacgtaggcacaagggggttgtaggggatggccttaggcctagggtgcatgctgaagcaatggggcatgccacattgcccccactctcttgctattcatgcttaaacatgcgcccaccgagtgctcg

SEQ ID NO: 51879 - DNA, 141 bp, Glycine max
  Peptide Sequence Number=SeqID_143564
atgaagggaaaccaacaaagggtccccagtggagtcgccaactatcgcaacctacccttcggcgggagggcgacgcgagactcgcgggatgcgtgttccactaaaggaatacgcgcggagtcgccaccaatgtttatttga

SEQ ID NO: 51880 - DNA, 457 bp, Glycine max
  Peptide Sequence Number=SeqID_143565
atggagacttttcaagtctcacaagttatccagaactacgtaggtcatgtgacgtgcacccttgtatcatccaaaggcggcgggcccgatgatacgcggagataccttacggttatccgcacccttttgtcatccagaggcggcgggcccgatgacaagcagagacaaaatttggtcattctgcacccttgtatcatccagagaggcggcgggcccgatgatacgcggagataccttacggttatccgcacccttttgtcatccagaggcggcgggcccgatgacaagcagagaccaaaggcggcgggcccgatgacaagcagagaccatgtttggtcattctacacccttgtatcatccagaggcggcgggcccgatgatacgtggagatatcttacggttatccgcacccttttgtcgtccagaggcggcgggcccgatgacaagcagagaccaa

SEQ ID NO: 51881 - DNA, 884 bp, Glycine max
  Peptide Sequence Number=SeqID_143566
atggttggtttcacaccttttccgccaagagatgagacatgcttgcccgctagaaggccatcgctcatgcacagagaaaaaagaggcaagttgggaccgactcttagcaagcgaagaaggagtgtctatcaactggttccccggatggaaagaaggaagacccatggttcttatttcgtgcagaggatttccaaatgttcccttgatggggacaaggggttgcatcaattacaatctcgtcctcgctataagacaacttggctaccctatgagagggcaccactaggggaagagcttgcacctattattgcacaaggtttcaatagcaccaacgcggaggcacttcagaaggtccgcaaggcatgggagatggtgcaaaagaaggatgaggaactcagaggcagtagcaacgggcccatcggtggctaccgtaggtggttgaaagcctacatccaaggtctggattggctcccgagtttgagaaccactaagggggtggaagttgaagctctggaggaggacgaagaggtgcaggccctcagggcagaactcgagaatgcccaaacagtcaaagaaaagttcaaatcagcagctcttaagatccgaaaggagaatgccgaactgagagacgtaaatatagccaccaccaaggccttggaacaagagaccaaaagggctcgtaaggaagaacatgaccggaacaaattccgaggggctctgtgggacagtaacaatgagcttaagctccggagagaggaaagggaccaatcacgagtagactgtttaatcttgaaggatgagttgaggatttgcctaaggttcaagagaagcttgtctcagcggttatgcgagaccgagaccaacatgttagccatcatcaacaa

SEQ ID NO: 51882 - DNA, 357 bp, Glycine max
  Peptide Sequence Number=SeqID_143567
atgggacaattggctacacaattaaatcaacaacagtcccagaattccgacaagctgccttctcaatctgtccaaaatccgaaaaatgtcagtgtcatttcattgaggtcgggaaagcagtgtcaaggacctgaacccgtagcaccttcctcatctgcaaatgagcctgctaaactacactctactccagaaaaaggtgatgacaaaaatttacctaacaatttctgtgcaggtgaatcttccactggtcccttgcagtcaactgatgtagaaattcatttagctaatagaagtgttgcctatcctgttggcttcatagaagatgtcttagttagagttggtgaacttccctgttga

SEQ ID NO: 51883 - DNA, 255 bp, Glycine max
  Peptide Sequence Number=SeqID_143568
atgttaataactccactcctatactcattgagagccaacaacctcaatctgatcatgcacatgtctctcgacccatgggggagacacatgaatgctcaccacaatctagccgacttcgagccttgccttggatatgccactaaagggcaagcagttggtgaattgtgcctagtgccttatgtcatcatccctccaaagttcaaggtgtcggagttcgataagtacaaggaactacttgccccaagaaccatctaa

SEQ ID NO: 51884 - DNA, 55 bp, Glycine max
  Peptide Sequence Number=SeqID_143569
atgaggctgttgtcctttgagacaaatgtcagaggtgctaataccttcctcaaac

SEQ ID NO: 51885 - DNA, 612 bp, Glycine max
  Peptide Sequence Number=SeqID_143570
atggcggaagggctggttaactacacgcgcttcggcgatgacgagcaaaccattctgactacccaggggcgtccgatttcggaagatgacgaagtgtgggtggccgacgagaacggcaatccgctgccgccaggccaggtgggtcgcctgatgacgcgcggcccttacaccttccggggctactacaacagcccggagcacaatgccgccagcttcgacgctgacggtttttactgctcaggcgatctgattgagatcaacgctcagggttacatcaccgtacagggacgcgaaaaggatcagatcaaccgcggcggcgagaagatcgccgcagaagagattgaaaacctgctgctgcgccatccggatgtgatccacgccgcgctggtgtccatgcacgacgagctgatgggggaaaagagctgtgccttcattgtggcgcgccagccggtgaaaccggtcgcgctgcgccgccatctgcgcgagctgggcattgccgaattcaaacttcccgaccgcattacctgcgtcgacgccctgccgctgaccccggtgggcaaagtggataaaaaacgtttacgccaacagcttgctgagcagacgcaagcctga

SEQ ID NO: 51886 - DNA, 336 bp, Glycine max
  Peptide Sequence Number=SeqID_143571
atggagaagcagctgaggaagaagaagaagcagctgaggaagaggaagaagcagctgaggaagaagatgatgcagcagaggaagaggaagaagcagcagaggatactgaatcagatgatgatgattctgaagccaccccatgaccatcagacctctactgttgcttttactggatacgatgtatgcatgattcatgattttgagggggagttgtatgtatatgattttgagggggagactgctgctgctgatgatgactggtgtaagctactagtagccgataaaagatgcaacagtaagagcatggagacagggggagcagctgatgtcacatga

SEQ ID NO: 51887 - DNA, 369 bp, Glycine max
  Peptide Sequence Number=SeqID_143572
atggggcgaggtgatgtcgaagatagctacaatggagacgcaacaaaacctatcaacaatgttgatgcttccaaccccacattatcattaaagatacaagtaggaaagaaagtgttgcaacaagtaccaaagcaatgtttgtcaaggcaaacacgatacaagacaaatcatctcataagagcattgttggaaaaggttggggtaaagatatcctttgagtttgataagacaattatgactaagaataatgtatttgtggggaagggttattatgatcagggtttctttatgctcaatgtttatgaagtgattaatgataatgcatcttcttcttcttctattttgttgattgattcttatgatatatga

SEQ ID NO: 51888 - DNA, 987 bp, Glycine max
  Peptide Sequence Number=SeqID_143573
atggctcttaatctcttaatttcaatcccattctttttactctttgtagtgaatccatttcactttgttgagccaagaaccttagaagtctccgagcatccattcaccagaactctccgaaaactcaaggacatcaacaagggacaaagggtgagaggcgtgggcgagctcaaaagctacctaaaaaaatttggctacctaacaacaaatgacaattcttcaaacaacaaccacttcgacaaaaacgttgagtttgctctcaaagaataccaagtgttccatcacttacgtcccacgggtcgtgtggatgccgaaaccatcaaaagaatgggcctcccacgttgtggtgtgcctgatattatcaccccccaaaaccataagcttaaggggttggtgattcttgcaaactatagcttcttctcgggttcaccaaaatgggaagagtctaaaagggcactaacctacacattcgtatcaagtgctaacgtgttgaggatgtatgatgtgaggctagcaacaaggaatgccttccaaagttgggcaagagcctctaacttcacatttatggaaatgccaagtgagtataataacctagctaacatagtcctagggtttcatcgtggggaccatggtgatgggtacccatttgatgggccgggccaggttttggcccacacttttgcaccacaagatggtaggttgcattttgatgctgatgaaccatggagcattgaatcaacaagctggaatgtaggaccaggatggaatgtgggttgggattggaggaggtgggtgcgtcctagatggcaaagccgaaggaccattgatttgcaaaccgtggctttgcatgaaataggtcaccttttagggctagggcatagtaacgttcccggctccattatgtatccctcttatgaaggggtaaagagggatctaactcaggatgatgtggatggcatacgggctctatatagattgcccaactag

SEQ ID NO: 51889 - DNA, 2004 bp, Glycine max
  Peptide Sequence Number=SeqID_143574
atgctgcttcctgcaactcactttcactacttccacacctttccttcttcttcttcttcttcttcttcttcttcttcttcttcttctacattgcacattttccctcttcaattccccaaacccaaacccaaattcctcattcgctgctccgacacagaaaccctcccggactccgccattcagcgaatcgccgacaagctccgcagcctcggcatcgccgaccaaccctccaccgccactcctggtccctccgactccgatgccggtgaaatcttcgttccccttccgcagcaactcccgacgcggcgcgtggggcacacgatcgacccgacctgggcgaagcgggagaggcgagaggacaaggttccgacgctggcagagctgagcctctcggatgccgagattcggcggctcacgacggctgggctggcgatgaggcagaagctgcgtgtcgggaaggcgggactcacggaagggatcgtgaacgggattcacgaacggtggaggagtttcgaggtggtgaggattgtgtgtgaggatctctctaggtttaacatgaaaaggactcatgacttgttggagagaaaaactggaggccttgttgtttggagatctggaagtaagataatattatacagagggactgattataagtacccttacttcctatctgataaagtgtcgagagatgacaacactggtgatgctatgcaacatatggatgaggatgctaaaaattttgataaaagagagagtcactcgtctgaaaagaattcagtgacatatgctgggaaaagttcaaatgtcaaaacagcaaaaccagctttgatacaaggtgttgggagtcccaataaagtacgatttcaactgccaggtgaggcagaacttgcaaaagatgcagacagcttgttaacaggtatcgggccacgattcattgattggtggggatatgaccctctgcctgttgacgctgatcttctaccagctgttattcctggatataggaagccatttcgccttcttccttatggtgtgaagcctaaactaacagatgatgaaatgaccacaatgaggagacttggcaaacatttaccatgtcattttgcattaggtagaaataaaaaacttcatggattggctgctgcaattattaagctttgggaaagatgtgagattgtcaagattgccataaagagaggtgtgctgaatactaatggcgagttgatggctgaagagataaagtatctgactggaggtactctcattgctcgggataaagaattcatcgttttctacagaggaaaagacttcttgccaactgcagtgtcatccgcaattgaacagcgaaggagtattggaatgtacaaactgaagactagaaacagtttgtcagttacagacgatccagacctgaaagatggaaccatagagtgtgattctgaagtcaagggtatgaacttcaagaaagatactaaacaaggaatgttgactgaggctgaggcagctattaaaagcactagcatcaaattgtcaatggcactagaagagaaagcaaaggctgaaaaacttctatcggagctggaaaatgcagagagcccccaagaagaagaaatcaataaagagggtattactgaagaagagaaatacatgttgcggaggattggcttgaagatgagtcccttcctgttactaggtagacgaggggtttttgatggaacggtggaaaatatgcatcttcattggaagtatcgggaacttgtgaagataatatgtaataaacagatgagcctggaagatgtccaacagatagctcaaaccttagaggcagaaagtggcggaatattaattgcagtagaaagagtgaacaagagctatgcaatcattgtgtatcgtggaaagaattatagtcggcctgcaagtttaaggcctcgtacacttttaaataaaaaacaagcattgaagcgctctatagaagcacagcgctgtgaggtaaaggtgtattaa

SEQ ID NO: 51890 - DNA, 1401 bp, Glycine max
  Peptide Sequence Number=SeqID_143575
atgcagattaatagttcaactaaattgattgttactgggcatggtcttggaggagcagttgcttctctctttactatatcgctattaaatagcattggttctggaaagaatcgcccactctgcatcacctttggttcaccccttattggtgacaagaaattgcaacaagccatatcacgtagttctaattggaattcttgctttctacacgttgtgtcactcaaagacccacttccaacgctcttcattacaaactatagttcttcacctgctgtattgactcctgaaacaagtggctacatgccttttggaacatttttcttgtgttctgatgcaaactccacttgttttgagaaccctgactctattttggaacttctcattgcaatgggctcaatccacactcagaatcaaggatttcagtcttctgattacggaaatatagtagaaaagctcaatgataaagtaatttgcaagttcttcagtacaagggttgaaaacatggctcatgcaggttcagcacttgaaagtagtattagtttacagttgcaagcattagcattgacaccgcatttgcagcagcagaacattgataccaatactttggaaacaaagattaaaatacaagaacaaaaattcattctccataggaggataaaaaattttgatccagccaaaaaattgaatgtagtgaagctatgtatgtcccaacttgaatggtacaagaaggaaacaaaaaatcagcgaataggatactatgatagctacaagaatatgaactcaccgtgggattatgatgttattcagttccataaaagactcacaaattactgggaaaagatggttgaagaagtagagatgaagcctcagaaagaaggtgcagcttttcgtacccgctggctctatgctgggactaactacaggagaatggttgaaccccttgctgttgctcaatactatagagaagggggtatagactatgtgacccaaaataggtctaaacactttgtaaggttggaggaatggttaaatgaagggacaaaaaaagcaacaagtgatttaagcagtacaagtaagaagaatgtggaagcacttttaacttttgattcttgcttttgggcccatgttgaagaggctctcctttcatgcaaggagttgaaggttgttagagagaaggaagagacattgaagaaattggttatatttgaggagtacgtttatgggttggtcaagaactatgcagtatcaccagagattttcttggcgcaaagcagctacatgtgttggtggaatgagtataaagcaattaagggaactttctataactcagcactctcaaatttcatgagtgatgctaggaagcgtgagcagtatgctttgggagtttatgatttcccttga

SEQ ID NO: 51891 - DNA, 93 bp, Glycine max
  Peptide Sequence Number=SeqID_143576
atggtttatcatgattcactgactatcattgtactaggaagagcttacggaggaacaccaccacaagagctcgtcagttcagtttttgcatag

SEQ ID NO: 51892 - DNA, 828 bp, Glycine max
  Peptide Sequence Number=SeqID_143577
atgcaggatgaaattccaaaggacgtttacaaggactcagaagacaggtttcgcaaatggtatttccccatccacgatttcactctcacgatgctgtggagcaggtttctcatagtaggcgaggagagaatggtaaacggcacaggcactagcattttcgacatgcacctcgacaaggtcgacaaagattgggccaaagaacttcccaacctagactacgcaataatctcagcgggacactggtttttccgagtaatgcacctccatgaagcaggaaaacaagtaggttgtgtctattgcaacgaagaaaacatcacaagctacaatccagacttcaccataaggaaagcattcagaacagccttcagacacatcaatgcatgcaaggaatgtgggagaaaaaaaatggtgacagtgttgaggacttttgcaccagcacactttgagaatggagtatggaacactggagggtattgcaatagaacaggtcctgtgagtgagagtgaggttgattttggaaagtttgattgggaagtgaggggtattcagatggaggagtttgagagagcaaggagagaaggcactatgggaaaattagggcataataataataataataataataataataataataggtttgagatggtggatgttgctagggctatgttgatgaggccagatgggcaccctggggagcattgggggaataagtggatgaagggttataatgattgtacccattggtgccttcctggtcctgttgatgtgtggagtgagttgttgcttgctgtgctcaaaagagaggctgggatggtggtggcatga

SEQ ID NO: 51893 - DNA, 429 bp, Glycine max
  Peptide Sequence Number=SeqID_143578
atggcgtgtttggaaataaagcatgttatgtgtttcaaaggcacctcaccaaactttattgaactcatcgcaccaagagaagttgcaagccaatgccctctcaaatctttcaagttctacaagacaaaggaaattcccactggcttctttgagatcaaatccggatcgtcaaacatccgtacaccttggtgggatggaagcgtcatatatggaagcaatagagaagttttagagaaagtgagaactttcaaagatgggaagataaagatatcaaaggatggtcatcttctccataacgaaaatggaacagcaatttcaggtgatgtccggaatagttgggctggtgtttcaaccttgcaggcacttttcactcaagagcacaatgcagtatgtgatgctctcaaggtacgagttgaagcatttgaataa

SEQ ID NO: 51894 - DNA, 207 bp, Glycine max
  Peptide Sequence Number=SeqID_143579
atgaagagaaaagcgtctattattgtcatcctagccactgcttcatggaaatctttatggatgagttggtgtataactcttgctgcaagagctctaatgagatccgttactagagaccacatgatattgctctcttgtgagatcgatgacacaacagggctaattctggctagggctaagtttgatgaaatagtttatggagtgtga

SEQ ID NO: 51895 - DNA, 72 bp, Glycine max
  Peptide Sequence Number=SeqID_143580
atggggaatctgaaaccacgaaactacttgctaggaggacatacaaggatactggaaagcaatttaatgtga

SEQ ID NO: 51896 - DNA, 876 bp, Glycine max
  Peptide Sequence Number=SeqID_143581
atggaaaagatagctgtaaaacgtagaacaacccaagctaagatattgggcagcataatatcagtattaggtgcatttgttgtgactttctacaaaggccaatcggtcatcatagctgataattccccttccattcaacttccacaatcaaatggcattcttacttcagtggatagaaattgggtcattggtggccttctgctcacagcttgcaatatactacttactgtatggttcgtttaccaggttgaaatcttgaaggagttcccggatgaactatctatgggaatatttaacaagttcctgagtagtgcaatatatgcttggggaatacacttaaaagggcctgtgtatgtagcaatgttcaagcctctctcaattgttattgcggttgccatgggtgttatgttccttggtgattctctatatgttggaagaattgctacatcaacagaaacagaacatgttaaaacacctggttgggctcctcaacaattgagtctcaaaatgcctgctaactttgtgcctacaatgcaacaatcgagtccttcagtacaaatgaataggccaagtagttcgagacatgtgtttaatgctgaccaattgcaattgatgggggcaaatgtcaatgaacatttatcattaaatgatagtcagatcccgacttggatcacgaatcagacatttataattggagccacaataatatcaattgggttttatactgttatgtggggcaaagcaactgaacagaaggaagaggagggggaggaggaaaatgttggtagccaggaatcatcaattactgagaacgttcctcttttgcaaagctatataactgtaaattctacgaagaaaatagatggaagtgtatag

SEQ ID NO: 51897 - DNA, 615 bp, Glycine max
  Peptide Sequence Number=SeqID_143582
atggaaaagatagctgccaaaagcagaagtagtcaagctaaggtagttggaagcataatatcaataacaggagcatttgtattgactttgtacaaaggccattcaatcatcaaagctcattcccatgatctttccataccacttcaacatccatttagctttcttaaatctggggatgcagattgggtcattgctggcattctgctcacagctgaatgtttaataggttcattatgttacattgtgcaggctgatgttctaaaagtgttcccggatgaagtgacaatagtcctcttttacaacgtgacttccacagtcatgtctacacttgtagctttatttgcagtgccaaacgcaaatgcttggaaagggcctgtgtatctagcatcattctcacccctccaaattgttttttctattgccatgggtgtcatcttccttggtgactctcttcatgttggaagtatagttggagcggcaatagtatcatttggcttttatgctgtgttgtggggcaaagcaacagaggagatagaggaagaagttgattacccggaatcaccagctactgagaatgttcctttattgcaaagctatggaaccgaaaacttgtga

SEQ ID NO: 51898 - DNA, 369 bp, Glycine max
  Peptide Sequence Number=SeqID_143583
atgggttctttagcaaacagccattgccaatggcgagtttgctgtgcaaagccacgtggcatcaaaaccgccactcgtagtggcgagttgctttgcaggttcaagtcgccacctgtgctggcgagaggtttagacgtagggggtaggcgggcggtgcagctacggtgctgcaggttgcagcagcaggagcagaaagccaaatcgccagtcatggtggcgatttggctgtgctgtttgcttccaaaaaaatttctggcctataaagcaatgcaggaggtgctcccttgcttcgtttttgaatcttcactcttcacttcactgcattgcttcttccttctcttgccattgttgtttgcttccttccagtga

SEQ ID NO: 51899 - DNA, 405 bp, Glycine max
  Peptide Sequence Number=SeqID_143584
atgacggtactaccggcggcgaccaccgacgccgtcgacgtcgacgcgcagatcgccttcttctgcattccgtgcttcccctccgaaacgacgtcgtcgtcgtcgtggtggtggcagagtctgcggtcgccggcgaacaacaagggccggtactggtggcgtcggcggtggaacgccgttattcgccgcttcaaaagcaacaacaactacaagaagcactgctccttccgctacgatccgctcagttacgcgctcaacttcgacgacggaatcgccgaagaggacggttgcggatacaaaggcttctccgcgcgcttcgtctccgttccgccaccggagaaggccgtcgacggcgaggagtcacgtggggagcacgtgccgccggtttcgaaaatccagatatga

SEQ ID NO: 51900 - DNA, 174 bp, Glycine max
  Peptide Sequence Number=SeqID_143585
atgttgatggtgagtggtgtccatggagggtgctctgattgcgcgatagaggctttgggaaacgatggttcaaaggaggaagatgctaagccggagacagtaaaagagttgctagagtggaagggagaaacaaccatcggacatgaagtgagagtaaagagggaaatgctttaa

SEQ ID NO: 51901 - DNA, 2301 bp, Glycine max
  Peptide Sequence Number=SeqID_143586
atggatcttgagtctgtgatccacaggaacacaattaagcatgatcatggtggtggtgatgtgatgattgcaggaagaatcatggaagacggtgttgactttggcctatcaaagcttggggacaccaatgaagaaatctatggagtgttgtcttttgtgttctggacactcacactgattccactgctcaagtatgtgttcattgtgctgagagctgatgacaatggtgaaggaggcacctttgcactctactcattgctgtgtcgccacgcccgggttagcttgctgccaaacactcagcttgcagatgaggacttaactgagtacaccatggataatggaactgttcctgttgataagaaaaatgttgggttggggctgaagaacttgttggagaaacacagggtgctgcaaagggtgctacttgttcttgccttgatagggacttgcatggttattggggatggtgtgctcacaccagcaatatctgttttttctgctgtgtcaggattggagctttccatgtctaaagaacagcacagatatgtggaggttccagtggcttgtgtaatactgatatttttgtttgcccttcaacattatggtactcatcgtgtggggagtctctttgcacctgttgtcttgacctggctgctatgtatcagtgctattggtgtctataatatcttccattggaatccacatgtttatgaagctctctccccatattacatgttcaaatttctgaagaagacacaaaagggaggatggatgtccttgggtggaattctactgtgtataacaggttcagaagccatgtatgctgatttaggacacttttcacaattgtcaattaagattgcattcacctttttggtatacccttctttaatcctagcatatatgggacaagctgcatatctttccagacatcattcccttgaaagtgactatagaattgggttctatgtatctgtacctgtaaaacttagatggcctgttcttgcaatagccatacttcaagctgtggttggaagtcaagctgtcatcacagggactttctccataatcaaacaatgttctgctatgggatgtttccccaaagttaaaataattcacacatcatccaaaatgcatggccagatttacattcctgagatcaactggagtttgatgctgctttgcctggctattacagttgggtttagagatactaaacgcatgggaaatgcagcaggcttggctgtcataactgtcatgctggtgaccacttgcttaatgtctctagttatagtcttgtgctggcacaagaacatactgctagcagtttgcttcatattgttctttggttccattgaagcactctatttctcagcatccctcatcaagttccttgagggggcttgggtccccattgccctctccctcatatttctcatttccatgtatgtgtggcactatggcacattaaagaagtatgagtttgatgttcaaaacaaggttccaatcaactggctcctcagtttaggcccctctctaggcattgtcagggtcaagggaattggtctcatacacactgagcttgtatctgggatcccagctattttctcccactttgttaccaatctacctgccttccaccaagttgttatcttcctctgcattaaatcagtccaagtgccacatgttagacctgaagaaaggttcttggtgggtagagttggcccaaaggagtatagactttaccggtgcatagcgcggtatggctaccgcgacattcacaaggatgacattgagtttgagagggatcttatttgcagcatagctgaattcatcagatcagatgcatctgaatatggcttaggatttgggagctttgaagaagatacaaagatgacagttgtggggacttcagcatcaaacttagagggttcaataaggatgactgaagatgatgatcaacaagattctcaaatggaagaaggtccttcagagttgatggaggttaagtcttctcctgagaaagtgaggaagagagtgaggtttgttgtgccagacagtccacagattgatttggatgcaagagaggagttgcttgagctaatggatgcaaaagaggctggaatggcattcatattgagtcactcatatgttagagcaaaaagtggatcaagctggttgaaaaaagttgttatcaattatggatatgatttcttaaggagaaactcgagaggaccagcatatgcattgagtatacctcatgcatctaccttagaggtgggaatgatctatcatgtatga

SEQ ID NO: 51902 - DNA, 276 bp, Glycine max
  Peptide Sequence Number=SeqID_143587
atggggtacatactgccaaaaccaaacacagaaaaagggaaagtaaagagaaaagggaaagaagatgaagaggaacaggaagacaattatgctcgagcatattacaaaactcaaaatcgagatcactggttaaactggaatacctcatgctgccaattgatctacatgtttggtgctaaaagtgttgacaatgacagttattgtaacagtggtgttaatatttgttggatttgtgttcctggtcctacttcatgtttgtttttccgagagagctag

SEQ ID NO: 51903 - DNA, 207 bp, Glycine max
  Peptide Sequence Number=SeqID_143588
atgactgttggtggcgagggagtgcttagtgcaagtggcacatggagaggagcctccatgggggagggtggtggcatcaggttgtcacgatatgcttggacgatgtcgatgtggcgacaacatgttgaggttgtggtcaccgtggtgaaatcagatagttccatgatcattggagagtcggcgttgagtgacatggaggcgagttag

SEQ ID NO: 51904 - DNA, 240 bp, Glycine max
  Peptide Sequence Number=SeqID_143589
aatttgaggccagagattccgcgatgttgtcctagcgctctggcaaatgtgatgaaaagatgctgggatgcgaatcctgacaagaggccggagatggatgaagtggtgaccatgttggaagctattgatacttcaaagggtggagttatcgaggaccttgaaagatttttcactgccaaggaaattgattatggagggatgatatacagtgttctggaaatcagtttgcattttatttga

SEQ ID NO: 51905 - DNA, 924 bp, Glycine max
  Peptide Sequence Number=SeqID_143590
atggagaggggacgaatcaaaggggtgaggccatggtggagaagggtaatgtgggaatataaaaataatggggtgcataaaacaattttcctagttttattgcaacacgtacggtacacaaacacagccctaaatccaggcccaaaccaagacgtagttctgcttctcagttctctcgaatcaatccggaatcccaaacccctaatccctaatcaatcgcaagttcgaatccctaatttcaacctgttcttcctcaacgtgcgtcgtgagcgagttaaggttaagggcatgcttgatgcagggaaagacaaagcgattatggacggttcacgacggctactaggacagtctgtaggggttttcaatgaagggatttgtttagttttatctcgctggtcggctcttcgatcggctgttgagaatgaatggggcggccgtgagtcccgccttaaagccgatcaacttgccggtgacattcttacctggttcactcaatccaaagagccactttatattgatgacttagaagacatactggatcaaggtatgctttctctcaatgtagaggtcgaggatggcagcgttgaagaggtagctgaaaaactaatggttatgcatgaagaattcttagaaggtaattttagttcttttgaagatctcaggaaagccaatcttgagcaagctactcttcctcatgtaacacagattgtaaacgaagacgattcagatgaagatggtgatcatgatgaaaaaatgattgtggatgataattcttcaaacatgaatccggagatttcaacatctgattcaaacatgaattcagtgaacaggccagtaaatgagcctctaccaaaggtttcaggcaaagcagatgatggatgggttgtagtttcaaacaaaagaaataagggaagaaaaaattag

SEQ ID NO: 51906 - DNA, 963 bp, Glycine max
  Peptide Sequence Number=SeqID_143591
atggcaagcatttctagcattccatcacacataaaaacttgggtttattctgaatatgggaacacagaagagattctaaaatttgatcccaacgtacctataccagacatcaaggaagaccaggtgctcatcaaggttgtggctacagctcttaatcctgtggattataagagggctcttggctatttcaagaacactgactctcccttacctagtgttccggggtacgatgttgctggtgtggtggtaagagtgggaagtaaagtgaggaaattcaaggttggggatgaggtttatggtgatatcaatgagtatgctgtgaataatccaaagaccattgggactttggcagagtacactgctactgaagagaaattgttggctcacaaaccctccaatttgagctttattgaagctgctagccttcctttagctatcatcactgcttatcaaggacttgaaagagttgatttttctgctggaaaatctatacttgttctaggaggtgctggtggagttggatcccttgttattcagctcgccaagcacgtttttggcgcatccaaggttgcagctactgctagttccgcaaaactggatttattaaggaacttgggagcagactttcctattgattacacaaaggagaattttgaagagcttgcagagaagtttgatgtagtgtacgatacaatagggcagagtgacaaggcattgaaggctatcaaagaaggggggaaagttgtgacaatagcaccaccagcaactccacctgctatcccattctttctcacttcagatggtgctgtgttggagaagttacaacctcacttagaaagtgggaaggtgaagccagtattggatcctaagagtccctttccattttctcagattgtggaagcatattcatacttgaagacaaatagagccattgggaaagtagtcatacatcccatcccttga

SEQ ID NO: 51907 - DNA, 507 bp, Glycine max
  Peptide Sequence Number=SeqID_143592
atgggctatggtgttggatcaggcagccccttgtgtccatccttcaatttcaaccttgagcttgtcaaaagctctcagtttattgcctcgttctatcaacatatggttgttcaaagacgggtgaagaacccccttgaagagaattccgttgttggaattacaaactacattgattttgggtttgagttacaaacatgtgttgatgacgccatagcagaaaacaatatgttagaccccacctttcgaataggggcatcctggcaggctaataaaaacttcttgctgaaggcaaaggttggacctcgtagctcatcaatggcattagcattcaagtcatggtggaaaccttctttcactttcagcatttcaggtggttctagaggaatttttctattcaatcttgcttcagttctgtataccccgttgcctattcctttttttagtgtgactgggacttttcttttcctttgtatgtgtattaggaggccaacacttatttggtcataa

SEQ ID NO: 51908 - DNA, 195 bp, Glycine max
  Peptide Sequence Number=SeqID_143593
atgtttgaaatcctgactgtaggaaatgtgtatccaaagaggcttgatggccccagtcaagcaccttacccttgcatatgcaaagaagctgtttccggattcgaacccatgaccaacaagtcaccaaggcacaactttaccgctacaccagggctcgccctcagggtagctctacctttaatttcattaaattga

SEQ ID NO: 51909 - DNA, 147 bp, Glycine max
  Peptide Sequence Number=SeqID_143594
atggagaagatgaacaagaaagagatggaggaaaaacagaataacggaattgaacacactttttcagcaaaaataggtcattttggtcagagctccagagacccaaagttaacagaaagttctagaagaagaaattgcgaaaattga

SEQ ID NO: 51910 - DNA, 66 bp, Glycine max
  Peptide Sequence Number=SeqID_143595
tccatcacccttgctcagttgccggaagagagggagaaggagtatcagattatagggatcctctag

SEQ ID NO: 51911 - DNA, 147 bp, Glycine max
  Peptide Sequence Number=SeqID_143596
atggccacaatgatggaggccatgatgagcgtgaagaagataatggaagccaatgcggttgcaattgccgctaccagcgttgttgctaaggtgaacccgacgaatgggaaagttggatcatctaaaggaaaggctcagggccattga

SEQ ID NO: 51912 - DNA, 429 bp, Glycine max
  Peptide Sequence Number=SeqID_143597
atgtcgtttgcattgctcagagctttagttttcaatagagcgtctcgatatattccgggactcaatcggacatcagagttaaaaatattgtcgtttgattttgtcagagcttccgttttcaattacgagcgtctcgatatcctatcgggacacaatcggacatccgatatccaaagttattgtcgtttgaatggctcagagcttcagttttcaattacgacgtctcgatatattacgggactcattcggacatccgaagcttctgttttcaattacaagcgtctcgatatcctatgggacacaatcggacatccgattcaaaagttattgtcgtttgaatttgctcagagcttcagttttcaattacgagcgtctcgatatattacgggactcaatcggacatccgagttaaaagttattgtcgtttga

SEQ ID NO: 51913 - DNA, 87 bp, Glycine max
  Peptide Sequence Number=SeqID_143598
atggagtgcctagagggagcttgggagaccgtcgaagatgaacctgcacggacgcttcagcgcacggtggagtggacaactccttag

SEQ ID NO: 51914 - DNA, 844 bp, Glycine max
  Peptide Sequence Number=SeqID_143599
gactacacgccctcaccttcaaagggctatacgccctcatcttcaaagggctacacgccctcacctttagaggactacacgtcctcgccttcaaaggactacacgttcttgccatcagagggctacacgccctcaccttcagaggactacacgtcctcaccttcagagggtcatcggactacctgttctcgccttcaaagggctatacgccctcatcaaaagggctacacgccctcacctccagaggactacacgccctcaccttcaaagggctacatgccctcatcttcaaagggctacacgccctcaccttcagaggactagatgttctcgccttgagaggactacacgtcctcgccttcggagggctgcacgccctcgtcttcagaggactatatgtcctccccttgagaggactacacgtcctcgcctttggagggctacacgccctcgccttcagaggactacacgtcccccttttgagaaggttgcacgctctcgcctttagaggtaatttcccttcaaccattgtttttcccgggccaccccttgatctcaaaggagggccaactgtgcgagcacaaccagaggaaggctatcgccagctactgtgcatactggggcaagggatcgcgcccactagacaccaagtggacccggagaagtccaacaaggccctggggtttccaactctggttacgggcctctatcagtcctacagggtgcccgtaccccccggcaaggtcatgccatcgcgacataggggtcacgcctgtaggacacccagtggacctaaagaagtccaacagggtcctggggtttccaactctgattatgggcctct

SEQ ID NO: 51915 - DNA, 501 bp, Glycine max
  Peptide Sequence Number=SeqID_143600
atggttggcgacttgcacgcctttcagcccttgcacgtggatgatgcggttccgatgctcatgaacttattgatggtctctgcagaggcttccagggctgagacagggcagtgtcgtggaccgtacgtacgcctgcaatgggtatgttatatctacgagcgccgatgccaggaccacctgaatgatgcttctattagcagcaacagacagcttggcggttatatcacactgctacaggtggattgccacgaagaagaccgtgaagagcatatgtacaccggtgtacagggagcacctggaccgactccggattttggatgtctgttggatcccatatggggagcatcgaccagtctaggacttccatatgatttcatgctattccggtctcctgcgatggagacccgttgctgtgtattaccgaccagagagggtcatgcggtagtttggatacacccagaccatttcttctctgcctttcgattcatgggtgtcgtatga

SEQ ID NO: 51916 - DNA, 381 bp, Glycine max
  Peptide Sequence Number=SeqID_143601
atcatggtaaggaccagaggattaggtcgtgccttaggtcaggtcactggcagaggtgtgggcagaggagatcatgatgattccgatgatgttccacagcgtcaacagcctactgcatccgcacggaggcagcgagtcgctgtgactgcggcacacaatgaaacaaatgttcaggatgacccgatggaggcaccagctgttgtagaggaaattgtggcagacattcctgcggacacaggtgcagaggctgctgaggatgaggatgagggatttccgggtggtccgagcaacccatccgtgttgatccagtatgcggatcacattgcttacagcatatggacgggagagttatttatactatttatttttagttacttgtaa

SEQ ID NO: 51917 - DNA, 156 bp, Glycine max
  Peptide Sequence Number=SeqID_143602
atggggggggggggggtttggttgtttgggaaaactgccaggaaaccacattacaagcgaaacctcaaagagagttgggcttcgtcctcaaaaggaaacaacaccagaaaatctagccttccatggattcaaacagaaaacgcaattgaaacatga

SEQ ID NO: 51918 - DNA, 581 bp, Glycine max
  Peptide Sequence Number=SeqID_143603
aacatcctgagttgaagttatcctcccatgggaggaaggtgcagaaattaggtaggcctgtccctacaattgaagggctagttgttggcacaggactaagtcctttgatcgcgtgttcagtagacactggtgatcgaagacttatatcctcgtttgtggagaggtggcacggggagactagcagtttccatcttcccgtgggggaggttaccatcaccctggacgacatggcacctcttcttcatctgcccatcattggcaacttccataccttccagcctctgcacgtcgacgaggcggtgttgatgttggtttacttactattggtctcagcagatgcaaccagggtcgagacaggacattgtcatggaccatacgtacgcctatcttggctacgagatatatatcagtgcaaatgtcaggccaaacattggacagctgcaactcgtgcctatcttcttcttcttcttctaggttgcactctttttgctaacaagagtgaaacccatgttcgtgttgtcttcttagatgctttacgtgattgttcaaagtccgacaaatgcatcggatcgcgcaagtag

SEQ ID NO: 51919 - DNA, 93 bp, Glycine max
  misc_feature (38)..(38): n is a, c, g, or t
  Peptide Sequence Number=SeqID_143604
atgtgggtgtcccttcaagcttcgtgggaaaccagtgnttggggggcaaggtttcacatcgacaagaatgttaaggcaaatgtaaatccctaa

SEQ ID NO: 51920 - DNA, 300 bp, Glycine max
  Peptide Sequence Number=SeqID_143605
atggcacgcaacgtgtttgctccgtgcccctatttaaagggacctatatgggagggaactaaaagggcttttagtgataattcccaaggtggtcatatctctcttgatgggaaacccaacaaaggagtaagtcacggtaaaacattgcacaagattaaatggcctaactctctaaaaatcgtccccagtggagtcgccaactgtcgcaacctacccttcggagggagggcgacgcgtgactcgcgggatgcgtgttccacgaaaggaatacgcgcggagtcgccaccaacgtttatttga

SEQ ID NO: 51921 - DNA, 369 bp, Glycine max
  Peptide Sequence Number=SeqID_143606
gcgcagggcgatgcactacaggctgcggacgcaccaccaccccctcatcaggctgatcttgctggatcattaggcatggaacggtatctacagcacttggttcgccaacaggcggccaaccaccgggggcaggtgcagatacatgactgtctctaccagctcagcctcagtcagcagggccagggttttattccttttgtgtgccctactccagatcaatttagggctgaggtcgcatggcccggagattggcctgaggcccaggcaggggaggcgcctgcagaggctcccggcgatgcagaggaagcccgcatagatgaggagatgacagatttgcttaatttcttgggagggagcggagccacatga

SEQ ID NO: 51922 - DNA, 618 bp, Glycine max
  Peptide Sequence Number=SeqID_143607
atgggagttcctaacaattgttcttttgatacactcaagcgtagaatgcacaacacccttcaactaaccaacgatcaattactggatgaaatctactaccaacaaccattcatagatgcagaattattatgtaccattattagaacaccggatgctatactcaacctgcttcaatcaaccatcactcctactcatgatgcaattatgtattacaacgggaagtggaacataccacgtcaaggcgagtttttgggttactcctttgctggaactaatctaataataagatttggcattcctccaggatgtggcatgaagaaactcaaggatttaatcaagcaagtcgcacctataggggtttcccctaatggaattcacggatcacaattggttaggcgattgttctttcgacaatcaggtcattctaagtattccgaaaatttgattgaatatgagataacagaattgaaaaatgatgaagacgtgctaaaggtgttagcacaatccaactattggaaacgattctgctcaataaaaattttggctatttttagcaaaccagtaattcaaatagaagaagacatatattctgcacaacatattttagatcctcattag

SEQ ID NO: 51923 - DNA, 129 bp, Glycine max
  Peptide Sequence Number=SeqID_143608
atggatgagagcttgaaggttggagaagatgagtggagggagagggagagaaggagcacaaaattttgtgcctcaaatgagcccattaatccaagatcaagtccaagattctccactaagtttgcttag

SEQ ID NO: 51924 - DNA, 1209 bp, Glycine max
  Peptide Sequence Number=SeqID_143609
cagcactcccccgttgaccaccacgcgctcgccggccgccaggcccgagaggatctcggcctggccgtcctgctgcgcgccgacctgcacgtcgcgcggctcgaagcgccagccgcccttgtccacgaagacgcgcgtgctgacctggccctgcagcagggccgcggccggcaccatcacggcctggcgcgccggggcgtcgaagcccacgcgcgcaaacatgccggggcgcagccgcccttcggggttgtccacggccacgcgcaccttgacgctgcgcgtggcggtgtccaccagctcgcccacgtactgcacgcggccctgcagctgcaggtcgggataggcggccagcgcgatgtgggcctgctggcccacgtccacatgggccaggtcgcgctcgctgacgctggcgctgagccagaccttgcgcaggtcggccacggtcatgacggaggcattcacatcgttccagtagccgccctgcgagcccgccatctcgaccacgcggccgctgatgggcgacttgaccacgtagctgccgcgcgagccttcctgcacggccgcacccagctgggacagatgatcggaggcggcgcgcgcatcggcacctgctgcggccagcgactgctgcgcggcctcgtaatccttgcgcgcggcgatctcggcatcgaacagcagcttctggcggtcgaattcctggcgcgcgtgcagcagcgcggcctgggccttggcgtgctcggcacgcacgctggagatctcggaggagtccatggtgatcagcgcatcgccggccttcaccgcatcgcccagctggtggtgcaggcgcaccaggcggcccgccacgggcggcgtgatgcggaccagcttttcaggctcggcctcgatggtggcgggggccgacaggcgggtctgcagcggctgcagggcgatctcggccacctgcaggcgctcgcgcagcggcgagccttcgggcaccacgatgaggttgccttcgcggcgcacgggagccggctgcggggcggcggtggcgggggttgctgctgcagccggggtttcggccgggccgttgcaggcggccatggccacgctgatcagcagcccgcccacaggccaggcggccgccagcaagggatggcgctggtgcaggccatgggggtcggccatggggtcggcctggtcgttcagaagcgagaaagcgggtcatcctga

SEQ ID NO: 51925 - DNA, 549 bp, Glycine max
  Peptide Sequence Number=SeqID_143610
atggctattttaaaacattccaaacctctggtaatcaattacaagccatgtgtaatcgattacatgctttctaaaatatttaaaaccttttcagaaagcatattggccactggtaatcgattacatcctctgcatttgatcctttggcatcatcaaaatatcttgcttctacatggagtaccaaggaaatgtttggaagcaaaggtgagaaccttggcaagtcaagacgaatgggctccgttcattgatgtcctagcactcttgatctttggagtggtcctctttccaaacatggatgggttggtggacctggcagcaattgacgcttttctcgcctttcacgaccgcaaggaaagcccggtcgttgctatcttagccgatctatatgacacattcgaccgaagatgtgagaagaacagtgcaatgattgtttgttgtacaccggccctctacgtatggttggtctcacaccttttccgccaagaggagagacacgtttgcccactagaaggtcaccgctcgtgcaccgagaagaaggaggcaaactag

SEQ ID NO: 51926 - DNA, 266 bp, Glycine max
  Peptide Sequence Number=SeqID_143611
gtgagacacaggtaaggcaggaggctgctactccagagagatcaccacagatttcaccaaatccatcctctccaatggtagatcaatcttctcttcagcagccagcagaccttcctacaccagtgcatgagatgccagcagacccttctacaccagtcctgggattgactaccactccttcggccactcctgtgctacatcttacagatgaggaggacactcaagatgaggatactcagtcacaagacctgtcacaggaattttaa

SEQ ID NO: 51927 - DNA, 459 bp, Glycine max
  Peptide Sequence Number=SeqID_143612
atgcagtttagagccacgttccacaatgataggggcatcataaaagtctcatttttttaccacattcaatgggcaccagaatatcccgaatatgtccgtttcaaatataatggagttgtataccaaatccgagtcagactccataaagggaaaattttctttgttgaaggactgaaacagtttagaaaggaattagccatttatgaatctaccatcatccatttatttgcaatcgatcacatctcaatattcgacattcatttcagtccaccgctagaacagcaaacctctgtaagattgtggatgatatccaggcaacatatttggacacttgaaataacacaatcaatgattgacgcaccgcaccctttgaatcttccaagctgtgtaactagacatctaaatgtctctgatcaacacatgacaatccttagaaaattaggaccttcgttacaatga

SEQ ID NO: 51928 - DNA, 324 bp, Glycine max
  Peptide Sequence Number=SeqID_143613
atgaatgtgttgagtggtgcaaccctcctttgtaaaatcaccaatgcatccaacatcttcatgattcacatacaaagggactcattaggtaggaagaagcccagagttcaagaacctgatttgaggtcaaatccttttcagggggagggaatgataccacatgataatgacgaaaggaagagagagaagagacaccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 51929 - DNA, 198 bp, Glycine max
  Peptide Sequence Number=SeqID_143614
atggggtgtacccatgggcccgaaatctaccctaaggctcatgagaaccctagggccttctcttgcatctctggcccaatcttcttggagtgttctatccaatgcccttgcggggtaggattgcatcaaatagtgtgtacaacatcagccctgtcacaacctaccctacggcggggttgcgaaaaaaggccaaaataa

SEQ ID NO: 51930 - DNA, 531 bp, Glycine max
  Peptide Sequence Number=SeqID_143615
atgccacctaccaggcaccctctagacccagataagtctaacagggccctgggttttccggcattgatcacgggtctctgccagtcgttcggggttccggtcacacctagtaaggtgattcgagcgctgatcacccgggctttcatagagaagtactgcacagctagacaggcacagggtggcgaaccacaggccccggacgcaccgccgccacctcctcaggctgatccagctgggtcatttgacacggagcggtatttactacatttggttcgccagcaggcggccaaccacagggcgcacgtgcagacccatgactctctctaccagcttagcctcagcctgcagagccagggttttgcttcttttccatgccctactccggatcagttcaaggcagaggtcgcatggcctggagattggctagaggcccaggcaggggaggcacctgcagaggcacccgcagaggttcccggcgaggcagatgaggcccgcgtggacgaggagatgaccgatttgtttgatttctag

SEQ ID NO: 51931 - DNA, 549 bp, Glycine max
  Peptide Sequence Number=SeqID_143616
atggcttccatttcggaggtcatgttaaaacttcagaaaaccatagaggataaagccaccgcaaccgcctccagtatagttagggaagcggagccagtgctgcagcccgccttgaatccgggcctagacagaaacacgactgtgttcggtcgaaggtatagtccgcaagcttatccttatggcctgcctccggacttcaccccccgtgccaccccggaagagttaagccaagcccctacttttgaggggcaactcccaccttatggagactatcccgggcaagacgatggggaaggagatacccatcttggccccctgctccacctcaaagatccgtccccgcatgaactaccccaaccgaacatagtccgtcataccccggccccacccacgcccgtaaaagaatctgttccctttgcggaagataagggaaagattgaggcgcttgaagagcggttgagagcagttgagggcctcgacaattactcattctcggatttagcggatttatgtctcgtgcccaacatggtcatccctcccaagttcaaa

SEQ ID NO: 51932 - DNA, 144 bp, Glycine max
  Peptide Sequence Number=SeqID_143617
atgactgaagcacgtcaaaagggggggaggagcttgccacccagctcgtccagccgagctcagctcgcccaggtgagcaatcacccttcctctagaagctacagccttccggaggaagaatctggaaggcccaagtgggcctga

SEQ ID NO: 51933 - DNA, 1074 bp, Glycine max
  Peptide Sequence Number=SeqID_143618
atgggatcaagtcaaatgccttcacttaaaaagaggttctatcaagtcaaggtcaagagcctagggaccaccagtctaaaagagttagggcagttgatgggtcagctccaacggcaagcttttcgcaaagcttacggtaaaatctgggacctagccatggtagaagtctccacagaggccattgcctccctcgcccagtattataatctgccgttgaggtgcttcacctttggggacttccaactatcacctatggtagaagaatttgaagaggtcctaggatgccctatagggggaaggaaaccatacctcttctcatggttctatccctcattagctagaatttctaagatagtccaaatctcggtgcaggaattagaccacagaaagcaagtaaaaaatggggtggttggaataccgagaaaatatttggaggcaaaagcaagaatcttggcagtttcacacctttttcgccaagaggtgaggcatgcttgcccgctagaaagtcgccgttcatgcacagagaaaggaggggcaaattgggaccaactcttagcaagcaaagaaggagcatctgtcaactggttccctcgatggaaggaaggaagaaccgaagttcttatttcatgcggaggatttccaaatgttcccttgatggggacgaggggttgcatcaactacaatcccgttcttgctataagacaacttggctaccctatgagaggggcgccactagaggatgagctcacgcctatcatttcacgaggtttcaataagaccaacgtggagacacttcagaaggtccgcaaggaatgggaggtgttgcaaaagaaggacaaggaactcaggggcagtaacaatgggcccatcggtggctatcgtaagtggttaaaagcccacgtgcaaggtttggattggcttccaagtttgagaaccgctaaaagagaggaagttgaggcaccggaggacgacgaagaggtgcaggcccttagggcggaactcgagcaagcccaaacagttaaagaaaggttcaaatcagcggctctaaaatccgaaaggagaataccgaactga

SEQ ID NO: 51934 - DNA, 887 bp, Glycine max
  Peptide Sequence Number=SeqID_143619
cgcgccgacgatctgccgcagccgctgctgtggccacagctgcaggtgagcgacgaagagatcgccgacaccaccgcggccttcaacctgaccgacagccggccgatcgtcggcttctgcccgggcgcggagttcggccccgccaaacgctggccgcactatcactacgcgacgctggctcagcggctgatcgagaacggctatcagatcgcgctgttcggctcggcgaaagatcacgaagccggcgaacagatccgcgccgcgctgcaggaagacgcccgcgatttctgccttaacctggccggaaaaacccagctggagcaggcggtgatcctgatcgcggcctgccgggcggtggtcagcaacgactccggtttaatgcacgttgccgcagcgttgaacaaaccgctgatagccttgtacggcccaagcagccccgacttcacgccgccgctctccgacaaggcgcgggtaattcgcctgatcagcggttatcacaaggtgcgcaagggcgatgccgagcagggataccaccaaagtgttaattgtaaaaacctcctcaatgggggacgtactgcatacgctgcccgccctgaccgacgcgctgcaggccattcccgatatccgcttcgactgggtggtggaagaaggtttcagccaaatcccgacctggcacccggcggtggatcgcgtgatcccggtggccattcgccgctggcgcaagaactgggcctgatcaaaagcgccgcgctgatcacgcgcatcgccaaaggcaataaacatggcctggactgcaagagcgcgcgcgagccgttcgccagctggttctacaacgtgcgccatgagatagacaagcagcagcacgcggtggaacgcacgcgcgaact

SEQ ID NO: 51935 - DNA, 261 bp, Glycine max
  Peptide Sequence Number=SeqID_143620
atgtcactcgatccttatcaaactgactgcaatctttttctgtacgtgaggatcccaccagagcgccttctacttctaataggccatgaactagatcagaattattctcaacgagtccgggtagagaccaaaggtcttgagcgaccgatccggcagacaactcaaaagcccttcctatctgatagaaaaggatcccatgatcctgaaccgatcttacctgagatcggaaatcccaagtttgtctatgaagaacagatctaa

SEQ ID NO: 51936 - DNA, 779 bp, Glycine max
  Peptide Sequence Number=SeqID_143621
gacggtgcggctgctctgttgagccgcgccatggaatcgagagctccaagtgggccatttttggtaagcagaactgccgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaattcctgaaccgggacgtggcggctgacggcaacgttagggagtccggagacgtcggcgggggccccggaaagacctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 51937 - DNA, 1161 bp, Glycine max
  Peptide Sequence Number=SeqID_143622
atgagcgaaatcgacatcacatgggctgcgctgaaactggccgaagacggacatcgtgcggaaaaggccggtcatccggaagccgagggcaaaggcgcaatcgcctattacctgtccggcgaagggcgcaaggagctggaaaaggtttgtggctacaaggcgccgttcggcgtcaaggcgctgcgcttctatcgtggtctcggtctgtgggggctgttcatcccgacggcgatcttcacgatcctgatccttctgctcgtcaattactgcatgatccgcgccggtctttcgactgatctgcgcacgctgttcacgcttctggcgatcttcccggcaatggacgcgtcctattcgctgttcaatgcgctggtgccatggtttgtccagccgacgcggctcatcggtttcgaatataaggaaggcttgccggaggaggcgcgcacgctggtcgcggtgccgaccttcatcacctcgcgtgattccatcgacgagcagattcgcaatctggaagttcattatctgaccaatccgcgtggtgaaatctactttgcgctggtcagtgactggaccgatgcgaagcaggaaatcacccctgcggatatggaaatctatgaatatgcgcgcgaggaaatcgccaagctcaacgagcattataccggcgacgaccagccacgctttttcctcatgcatcgtcgtcgcctcttcaatgagaagcagaattgctggatgggctgggagcgcaagcgcggcaagctgcatgagctgaacatgctgctgcgcggcgacaaggacacgacgttcctcggcggcgcgaatatcattccggaaggtgtgaaatatgtcatgacgctggacgccgatacgcgcctgatgcgcgatgcggtgacgaagctggtcggcaagatgcaccatccgatcaaccgccccaggatcgatcctgaatccggtcgggtggttgaaggttatggtctgctgcagccgcgcgtcacaccttccctgaccacgggcaaggatgcttcggttttccagcgtgtcttttccatcaaccgcggtatcgatccctacgtcttcacggtttccgacgtttaccaggacctgacctccgaaggcaccttcaccggtagggtctttacgacgtggatgctttcgaggcggcgctga

SEQ ID NO: 51938 - DNA, 156 bp, Glycine max
  misc_feature (31)..(31): n is a, c, g, or t
  Peptide Sequence Number=SeqID_143623
atggaaatttatgtgagtgatcgactagganaaaaagatgatgacaaaggtgatgacaaaaagctcaaagatcaatcaaagaacaactcaactgaatcaaagatcaatcaaagaacaattcaagtgaatcaagaacaagtcaagagttcaagataa

SEQ ID NO: 51939 - DNA, 417 bp, Glycine max
  Peptide Sequence Number=SeqID_143624
atgagctatttcagaaagatcttcatgctttatgtacaatgtaaaattatcattatacaccccaaacaagctagtatcccacgacgcctgcaatggcttgaggaaaagctacaggatgatcaatgtcatcaagtagaggggatcttcatcaggattcaacatatgagtgtgagcatcagcatctcagacttcctcaacacctaccttcacttaattattgcccaaaggaatgttgtggatagttgtggacccctcataaactctcccaacagcaaccagtcggggaggattgtcatcgacatacaagccacatttgtccgagtctcccgtttctgggtcgtgtctcgagggatcgactcaacttttctttgtgctaacatgagcagcacaaggaccaacctcaacctcaggaggtag

SEQ ID NO: 51940 - DNA, 582 bp, Glycine max
  Peptide Sequence Number=SeqID_143625
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggcaaagatttgggaagtacgggcagcccccataatgtacaaattcaaaacgagcacgccttctcgccatatggtttgcctcccaaactatacaccacccaatgtggtgtacattcccaatgaggatgtcaataactccactcccatactcattaagagccaacaacctcaatctgatcatgcacatgtctctcgacccatggaggagacacatgaaattccccaccacgatctagccaacttcgagccttgcctcggatatgctgctgaagggcaagcacttggtggtataccccgacaaaaccctttggagggccctcagtatcacccacaactgcaccttttgcattccacagcggttaaaaaccctcatgactatggcaggaatgggaaagttggatcatatagaggaaaggctcagggccattga

SEQ ID NO: 51941 - DNA, 474 bp, Glycine max
  Peptide Sequence Number=SeqID_143626
atggatatgaatgtggggtacctcatctcccaccagatctccctcactgctcagcatgacacatccagacttggattcccgaccttaattacagctttatgtaaggctaggggagttcagtccaattcgagatccctggagagcctgagtcctaccattaatctggcttatattaagaagaactatgatgacaaaggtgatgacaaaatgctcaaaggtcaatcaaagaatgagttcaagatgttcaagatagaatcaagaacacttcaagactcaagaggaaagttgaagaacacttcaagattcaagaggaaaattgaattcaagaatcaagaatcaagattcaaggatcaagcttccaagaatcaagatcaagattcaagactcaagattcaagaatcaagagaagacttaatcaagagtttttactctctggtaatcgattaccagattattgtaatcgattaccagtag

SEQ ID NO: 51942 - DNA, 433 bp, Glycine max
  Peptide Sequence Number=SeqID_143627
ggtgagggcaaggccagctgagcttccttcaacttttgcagctcctactccagcatccacttcaacagccccttttgtcccagctcagatagattctcagtgctttgaagccatgcttcagagcattcatcagggacagataattttattacaaagtttacagatgatggcacctccagactctattccttcagtagagcagtttaatgagacggatgagtcatctgaggccaccatccatgagccatttgatataggagaagaggcagaggagacacaggtgagacaggtagctgttgccactcctgagcgatccattgaggctacttcagagccttctccaccaatggacacttctcctctaactactctagtgcttcagctgacaaatgaggaggatggtcagacacaggacacccaggaccagccatag

SEQ ID NO: 51943 - DNA, 144 bp, Glycine max
  Peptide Sequence Number=SeqID_143628
atgtcttataggctgcatgaagctctcgcatgtataagttttacaatcccacctttaagttcaggtttgacacatgcaagactccttaaggaaattgagtttggaggggaaagaaacacaatgagtattgtcttcaaagaataa

SEQ ID NO: 51944 - DNA, 49 bp, Glycine max
  Peptide Sequence Number=SeqID_143629
ggtgaacgctgtgaagattttcccagacgcccaaaatggactcggatga

SEQ ID NO: 51945 - DNA, 270 bp, Glycine max
  Peptide Sequence Number=SeqID_143630
atggtagctcgtgtgatgttaaggcatgggtacgagcctggaaggggtttaggttggaacggtgacggtgcgacaagcttggtggagtttaaagaaaaccgtggaagcttcatcagcgtaggctggatgtgtgaagggcggatcgccatgatcaacaatgaagtccctcaagagcaatcaaactcagtatggtcatgccctcctgagttcgagttgggaaactggcaaattatcgaacaacccaaaattttcatggcaaacataatgtaa

SEQ ID NO: 51946 - DNA, 1802 bp, Glycine max
  Peptide Sequence Number=SeqID_143631
acctatgggaagatttgggatctagctatgatagaagtctttattgaagccattgcatccctcactcagtattacgatcagttactaagatgcttcacgtttggcgactttcagttagtaccgaacgtggaagaatttgaagaaatcttgggctgtccgctaggaggaagaaagccgtatcttttttctgggttctatccctccatggggagaatagccaaggtagtcaaaatcttcgcacaagaattggaccgagtaaagcaaaatagaaatggggtggtcggaataccgaagaagcacttggaggagaaagcgaaggctttggcgaatcaagtcgtcctctttccaaatgtggatgggctagtggacctagcggcaatcgatgccttccttgcttatcaccatagcaaggaaagtctgatcgttgttgttttggccgatgcctatgacacatttgaccgaagatgcaaaaagagcggtgcaaggatcgtctgttgcacacctgctctttatgtatggctggtctcgcacctcattcgtcatggaagtagacccgtctgtcccctgcaaggtcaccgcacatgcgccaagaaagggaaggccaattgggagcaactcttggttagtatggtggggatgaggggttccttatgcgaggggttcctaaacatccccttgatggggatgaggggttgtatcaattataatctcatccttgccataagacaacttggctaccccatgagaggagcgtcgtcggaagaaagtaccacacccttcatcgcacggggtttcagtgaccccaatgcaaggatcaatgggatcatcgacggatatcacaagtggctgaaggctcgaacacaagggttagattggctcctgaagctaaaggtctcgagtaaggaagaggctgaaacccttgaggagagtgaggaggtgcaagccttaaaggtgaaacttgaaagggcacaagcggtcaaggaaaggttcaagatgatggccatcaaggtccggaaagagtgcgatgaactgagagacgtcaatgtggccacaactgaagcattggaacgggaaacaaagagggcccaaaaggaagaatggggacgaaacaagttccgaggggcgttgtggggtagcaacagtgagcttaaacttcgaagggccaagaaagaccagtcaagagtcgagggaatgatactggaagacaagttgaaggcttgtcaaaggacaaagagaagtttgtccgaccaattgagaaagacggaagaaaacatgctagaggatgagtacacaaaggtgtcgatcctgcaagcagaaagggaagcaagagaaagagtgatcggttcattacacaaagaagcaatgatgtggatggataggttcgctttcaccttaaatggaagtcaagagcttccaagacagctagccaaagctaaggcgatggcgaacgcagtaaacaccataactaaacacactttaaggcacccctatcgaacccgttccaaaactagagtcatgggtgacatagaagaggtgcaggaacaaatgaaggtcgatatgttggccttgaaggatcaaatggcttccatgatggaagccatgttaagcatgaagagaatgatggaaagcaatgcggccgtagctgccgccgccaatgctgccattgaggcagatcctacccatccatctgtcacaaatcaagcacaccaacccatcctggacatggtggggcaaggaggagaggtgttgggtagcaccagaagtccacatatggggtattacaggaatgcttacccctacgg

SEQ ID NO: 51947 - DNA, 117 bp, Glycine max
  Peptide Sequence Number=SeqID_143632
atgtgttttcgtgaagaaaattcaagccgaggtgcttccgtaagcgattctgtggaaattcttcatcgttcttcaccgttcttcgttcgttctttgttgttcttcggtcttcaatcg

SEQ ID NO: 51948 - DNA, 215 bp, Glycine max
  Peptide Sequence Number=SeqID_143633
ccagagcacaccacaatgcctatttcgggaaaagtgctctggaggtagcaagaggagaagcttttgcaaagatacctaggttttgcctaggaccttcttcattaacggattcatttgcttcttggaagatgaatggcagcggaatggagaaggaagagagagaggagacaccacttcagggagaagatgagtctagaagaagctcaccaccatag

SEQ ID NO: 51949 - DNA, 408 bp, Glycine max
  Peptide Sequence Number=SeqID_143634
atgattggcgagtgggtttgtttacacgttaggccgatcctcttgaaatgtcagccatccgacgtctatcaaatgttggaccttgtatttaagggccaggcatttttcggtggagtggcctggggttttcccatgatcttcccgggagttattacggccatttggttggcgacgagggacggcaagaggtcttcgtatgtcaccgggatcggggtgaattctggaatcggtctcgggggaaagttcctcatcgcgttggaaccgataccaaagtgggcattgccggccgggcgagtcgtggttggagccggagcttggggggcctccctctggatgggggtgggcgctctaggctgtatgggtgctgaattggaggagttcccggcgcgagctaagatgctcggatga

SEQ ID NO: 51950 - DNA, 243 bp, Glycine max
  Peptide Sequence Number=SeqID_143635
atgcccgaagatttttcttcatctgttcttgcacctctacccattctcattcatttgcatgttacgcttatacgatacagatccaacaacgagtcccgcgaaggtactaataccgggaacccaaccgtcgatttcgagcaagaagcgagtcggacgaaggatgaagaagacgaagatgtaaggcttcccccagagctggaaaggataattgctcgagaggatcgagagataaggccgcattaa

SEQ ID NO: 51951 - DNA, 339 bp, Glycine max
  Peptide Sequence Number=SeqID_143636
atgactaggggcaatccaggtgatttacgaccctttgatcctgaaatagatggaacctttcatagatttgttaggcatagtgtgcatcctggtcattctgtgcattttgagcattctgttgagggtgattttgaatattctgattttgagcattccactactaatttttatactgagaacatggctcaacctccacctcgcgagaggactcctagggagatggctgcacctaatttcacttatgaaagcttgtgcattcaatatcctgatgagggtgttccatgtgtgaagatcctcataagcatcttacggagttccatatcgtttgttccaccatga

SEQ ID NO: 51952 - DNA, 473 bp, Glycine max
  Peptide Sequence Number=SeqID_143637
atgttagaagacgactgtcagtatctgatggtaagtaagatacctacggtcggtatatctttgaaagctcagacggagataaacggactcctcgagggctacttaaggcactttagtgcaaaccaaccagaaggactggagctgttggatcctctgacgccccacaccattgcggcaggaggaggcttgcccatcagcctacttttttgccaagacgtggcaggagcgcaacgacctagcccaaacctacttaaactaaaggcttggcccggtctgaaggaagaagaaagtagaccttgtagagaagcggataggagagaccgacccagagaggaacgtgcccagcccacgagggcaccaccagatgttggccaacctgagagcgaggcaagctgggaacgggctgaaactgacgattctaagaccaagtcagagactactggacgtctcgcagagcgactctcaacgaggac

SEQ ID NO: 51953 - DNA, 513 bp, Glycine max
  Peptide Sequence Number=SeqID_143638
ctgtggtggttccaggaaagatcttccagtctccgttcccaaaatggtataaccctagcacaacctgcgcataccatgggggaatcacaggccactcggtcgaacaatgcttggccttgaaaagcaagggggggggggttaatgccatcgaggtgagtaggtcacacggccccaaacttttgaaggacgtgacgacctctagaaatttcatctacaaagccttacaaaaggcgggcatgattccccgcggcaagcacagagaggattcatgtttaatgcatccgggtgtactgcatgacatggaaacatgttcggcggaagagaaaaaaccagaggaaaacaaagtggaggagaaaaaagcagaggaagaagaaaagaaagaagaagagaaaaaaccagagcaatcaaaagatgacaaggaatccaaggaggaatctgcgtcgccagaaatcatgcaaggcacaaccattgcaatgcatggacactttaagcatgatttctggcattttttaa

SEQ ID NO: 51954 - DNA, 126 bp, Glycine max
  Peptide Sequence Number=SeqID_143639
atgcttggagtatgcatgaaatggccccaaggaagcttgcctcaaagaggtccaggaaggattaggcgaccgaaggaactagttccgctcccgagtatgacagtcaccgctttaggagcgctgtag

SEQ ID NO: 51955 - DNA, 285 bp, Glycine max
  Peptide Sequence Number=SeqID_143640
atgtcaggatttacacgtgattctcctcaaatttcagccaacctgcatcaattagaccttgcaccttacgcttcaggcccctacaatgctcaatggaatgccccggggcttttccatgacaagcaccacgttgcgttcgagtcgtattctcggagaaatggagggatggcctttgtggataactgggtggtgggtaaggaggagccgtataggaatggcagtcacagcatgggtttctccctctttctcaccctcttcatttgcccagtttctcagtcgtcctag

SEQ ID NO: 51956 - DNA, 213 bp, Glycine max
  Peptide Sequence Number=SeqID_143641
atggaggccttgaaagagcaaatggctataatgatggaggccatgatgagcatgaggaagataatggaagccaatgcggttgcaattgctgctaccagcgctgttgctaaggtgaacccgatgcccccatctagcctcaaccaaatgaatcatccaacctcagatatggtaggcaacgatttgggaagtacgggcggcccccattatgcgtaa

SEQ ID NO: 51957 - DNA, 342 bp, Glycine max
  Peptide Sequence Number=SeqID_143642
atgacaccttcgaccgaagatgtgaagaaagcaatgcaaggattgtttgttgtactccagctctctatgtggggctggtttcacacctttttctccaagaaggtaggcccgtctatccgctacaaggacagagagcttaggggaagcagtaatgggatcatcggcggctatcataagtggctgagagtccgaacacaaggattggattggctcccaaatctaaagactgtgagggacgatgaggttaaagcttcggaagaaagtgatgaggtacaagccctaaaggcagagcttgaaagagcccgagtagtcgaagagaagttcaagtccatagccatcaaa

SEQ ID NO: 51958 - DNA, 177 bp, Glycine max
  Peptide Sequence Number=SeqID_143643
atgactacactagatatggtacctatattcatacagctgaagtttcaatccttagacattgaaatgacatttaaggccgaagttgaacgtcacgttgaaaagaagttaaggttgtcaaatctaactgtggtggttttgattgtagaagcaagcttcatgatgatgaatcaagattga

SEQ ID NO: 51959 - DNA, 396 bp, Glycine max
  Peptide Sequence Number=SeqID_143644
atggacctgcaaaagtatcagttggtttgtgtcgtcccgacatggggatcgcacccacaaagacacccagtggacctgaagaagtccaacagggccctggggtttccagctctggttacgggcctctatcggccctatagggcgcccgtccccccagcaagctcatgccatcatgacatagggatcgtgcccgcaagacacctagtggactcgaagaaggccaacagggtcttggagttgctagctctaaatacaggtctctgtcagttcaagggagtgcctgttgcccccagcaaggtcatcaggccccctaccaatcgagctttcatcaagaagtactgcgcccccaggcagacgcagggcgaaacaccacagcagcattgggatggccggtag

SEQ ID NO: 51960 - DNA, 168 bp, Glycine max
  Peptide Sequence Number=SeqID_143645
atggctattactagtactattagtattgctcaagttgatgttatggatgagtttatacaatttgaagatgaagatatgtcacaagagggaaaagaggatgaatatgtggagatggagaaggctcaagctacttcaaatatggaatcatttgttgttggagatgtttaa

SEQ ID NO: 51961 - DNA, 147 bp, Glycine max
  Peptide Sequence Number=SeqID_143646
cgaaaagaaggagaagcttgccacccagctcgcccaggctcgcccaggcgagctaggttgcttcctctagaaggcaccgccttctcgaggaacttcctggaaggcccaagtgggcctggttgctatttgcaccccgatgtttactaa

SEQ ID NO: 51962 - DNA, 1170 bp, Glycine max
  Peptide Sequence Number=SeqID_143647
atgacccatgaagttctatctggaaattgcgatgaacccgctaagtgcgcctatggcttcttggaaaagaaaggcaccttctacaccctctcaaatgagctggatagaagacactggaggaaggagttgactgactttctggatggcaacattgatgttgccattgtaaaagaattctatgcaaacctctatgaccccgaggacaaatcacctaagcaagtaagggtgagaggtcatctgattaagtttgatgaggatactcttaacacatttttgaagacctctgttgttgtggaagagggggaaacactttgtgcttactctagatttgcactccttgggccttatcctcaggagttagctgctaagctctgtatcccagggaggggattcgagcttaatgctgatggttatccggtgaagattctgaggaagaacatgacccctcttgctcagacttggagcgttctttctttttcaaaccttttccctacttcccacacttctgatgtcactcttgacagagccaaattgatttatgggattatcatgaaggtggacatgaaggtggggtacctcatctcccaccagatctccctcatagcacaacatgacacatccagactaggattccctgccttgatcacaactttatgtaaggctaggggagtccaatcagattcgaggtccctggagagcctgagtcctaccattaatttggcatatattaagaagaattgttggaatcttgatgatccaacagtaactttcagaggacctaggaaggccaggggtaagagatctgaggccccttccacttcaacaccatcagaggcaccaacaccttcttcttctccagtacccccctcttcatccactcagattctagttattcctccaacccctctacagatgccactcccagctccattatctacaggaccatcagactttttatttactccacagatgctttactctatgctccagagcatccacaaggggcagtccatcatcatgcagagccttcagggcttgggcttgccctccattatgagcatggaggagtttgaggctcaggtggcctggccaggagaccatccctcttcttttggaggggtggggcctcagcagcccaggagcctgatattgaggagccaccaacactag

SEQ ID NO: 51963 - DNA, 432 bp, Glycine max
  Peptide Sequence Number=SeqID_143648
atgaatcttgaaatttcttccccaccaagtgattccacacaagctcctgaagtcccaactagtaatgtccctctttctcccccccccatgtatcaacatctgaagttccacaagaagatgaaacaaactagacgtcatgttaagcgtgagtctacacaatgttggactgttgaggcgatagacgttgaagaaaccatcaagaagattaaggtgaaagttaggggagtcaatagcttacctagggagttacgcatcattgtgaattttgatgaccaaggccaagcaattggtgaagcacaagccttgcttgcaggatttcttggaacactagcagctgattgcaaattatttcctatggattatgatagatggtctagaccttcaggcgtacctaaagcttattttgatgattgctttgaaacaattttaaag

SEQ ID NO: 51964 - DNA, 333 bp, Glycine max
  Peptide Sequence Number=SeqID_143649
atgcaaaatagtggggtcaccctaagtgctgaatctcaacacttcgccagtgatgacagcaacaccggtgtacggaccgatgatgtaggatttacattggtagatctaaagaaactcgcttaccagaatgaccctttcatcatggcagaacaagctaaacagcactgggcccatcagaaagcttcatcaggaagcaaccagctcgcctgggggagagaggctgagtatgaagggttcaacaccctgggtattcagaattcacttaaaattagtgaggagaagaagaaagaaggagaaaatccaagccgaggcactttcgtgacgtttccatga

SEQ ID NO: 51965 - DNA, 555 bp, Glycine max
  Peptide Sequence Number=SeqID_143650
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccggctagacacgacttatcgccactggcagcagccactg

SEQ ID NO: 51966 - DNA, 836 bp, Glycine max
  Peptide Sequence Number=SeqID_143651
atgactacacgtcctcgccttcagaggaccacacgtcctcaccatcagagggttgcacgccctctccttcagaggactacatgtcctcaccttcagaggagtacacatcctccccttaagagaactacatgtcctcgccttctgaggactggacgtcctcaccttcaaagggctacacgctctcatcttcagaggactacacgacctcgccttcagaggactacacggttccacgccttcgccttcagaggactacacgtcctcaccttaagaggaccacacgtcctcgccatcaggggaccacacgtcctcgccatcagaggcttgcacgccctcgccttcagaggactacacgtcctcgccttcagaggaatggacgttctcatcttcagagggctacacgccctcacctttagcggaccacacgtcctccccttcagaggactggacgtcctgaccttaagagggctacacgccctcatttttagaggactacacctcctcccctatagaggactacacgtcctcgccttcagaggaatggacgttctcatctttagaggactacataggactacacgtcctcaccttcagaaacctacacgccctcgccttcagaggactacacgtcctccccttcagaggactacacgtcctcgccttcacaggaatggacgtcctgaccttaagagggctacacgccctcaacttcagaggactatacgtcctccctttcagaaggctacactcatcgcctttagagggatacacgccctcatttttagaggactacacgtcctcaccttcagggggctacacgccctcaccttcaaagg

SEQ ID NO: 51967 - DNA, 554 bp, Glycine max
  Peptide Sequence Number=SeqID_143652
aaggtcaccactcatgcacagagaaaggaggggcaaattgggaccaactcttagcaaacaaagaaggagcgtttgtcaactggttccctcgatggaaggaaggaagagtcggagttcttatttcatgcggaggatttccaaatgttcccttgatggggacgaggggttgcatcagctacaatctcgttcttgctataagacaacttggctaccctatgagaggggcgccactagaggatgagctcgcgcctgtcatttcacgaggcttcaataagaccaacgtggagacacttcagaaggtccgcaaggcatgggaggtgttgcaaaagaaggacaaagaactcaggggcagtaacaatgggtccatcgatggctaccgtaagtggttgaaagcccacgtgcaaggtttggattggctcccgagtctgagaaccgctaagagggaggaagatgaggcactggaggaagacgaagaagtgcaggcccttaggacaaaacgcaagcaagctcaaacggtcaaagaaaggttcaaatcagcaactcttaaaatctga

SEQ ID NO: 51968 - DNA, 219 bp, Glycine max
  Peptide Sequence Number=SeqID_143653
atggctggaagaaaaattgggggcgagggttttcgagagaatgaaaggttgcagggacacgtcgtaatcgattacacaaatatggtaatcgattaccagagagcaactttgccagaaataactgcttgtaatcgattacactattatggtaatcgattaccaatggttattttagccagaaacaaaatagaaggctttctaggagagaagaagttttga

SEQ ID NO: 51969 - DNA, 416 bp, Glycine max
  Peptide Sequence Number=SeqID_143654
cgctgtacaccagcagcgcttcgagcccatcaagggattgtcatttctccgggagcgacgcgtccagctcagggatgacgagtatactgattccaggaggagataggtcgtcggcggtgggcatcactggttacccccatggccaagttcgatccagaaatgctatcggccagctcctgggatatccgttagtgctggaagaggccaggagtgcgagtatggcagaggaggaaccggattttgcccggactgctgccggacgggtgcggtcagcgcaccacatgccacctgatcagatatggagattgtgtcagcacatctgccccgatcatatccgacctccccatgccgaagtgccagctggtgtacgccatcctgacacggatgagcatccatgtggctcagttgatcgctga

SEQ ID NO: 51970 - DNA, 348 bp, Glycine max
  Peptide Sequence Number=SeqID_143655
atgtcgtacaggatgtcacgacatcacgcttcagaacatgcagattgtatgtgtccgtatgaacagattaaacaagtaaataacacaagagaattgttaacccagttcggtgcacctcacctacatctgggggctaccaagccagggaggaaatccactctcaatagtggtaccatcaaggtggctcacaaaagactcaagtcccaaaactcacaaaataactcttcaatcccggacttggtacagaactcgtgcagcctccatgattatatagccgtgtacgattctgggctgcaagttcttgatgctggaggagatctatcttcttctgaaaaatctgccagttaa

SEQ ID NO: 51971 - DNA, 654 bp, Glycine max
  Peptide Sequence Number=SeqID_143656
tgctggatttacgagcactttccctcggtcgcggagtccaccactgatcaggactacgacgagggcttctccgcgtgcgtgcaggtggattgcgacgaagaagaccgtgaagagcattcacacaccgttgtacagggagtgcctgaactgactccggattttggatgtctgttagatcccttatggggagcatcgggaggtctgggacttccacgtcagatcatgctattccgggtcgtgcggcagtttggctacacgcagaccattcctgctcctcctatcgattcatgggtctcgtatgatgatatatatgacaggtggatgcactacgaggatcatatcgtaccagcaggtgaggtgtgcgttgtgccaagggcgtgttccagtgactacatcgactggttcttccgcatctcccatcctttcatgacaccaggccatgcattagatcctctacctcatggtcacgccccgcagccccgagtcgtccctcaggccccgcagatggatatccctcgcgtgccgaagctaggagcatcgtcgacatctgcggaggagcccagacatgcaatggaagtttgtgatgacattgctgagagggttggagcgccatctgagtctagggtggtcacgcctggctcatcgacacatgag

SEQ ID NO: 51972 - DNA, 96 bp, Glycine max
  Peptide Sequence Number=SeqID_143657
atggagcatctcaatcagctgctcccaaggcaaataatgtcaatctttcttaaggatttgatgacagggatgatgattggtttgggtgaacaatga

SEQ ID NO: 51973 - DNA, 207 bp, Glycine max
  Peptide Sequence Number=SeqID_143658
atgaggggccaagacatttatagtagccaagatgaggctactacttcaccttcctctagtaaagtgaagaagcaaaggggaagatctagtgaagagatctaccccaagaagaaggacaagcttgggtggttaaggaggagtgtaaggagggttcccatgaaccctaagagaataaaggtcattcctgagtggcccgctccaccaagt

SEQ ID NO: 51974 - DNA, 331 bp, Glycine max
  Peptide Sequence Number=SeqID_143659
gatcacgctcgtaagacacccagtggacccgaagaagtccaacagggtcctggggtttccagctttgattacgggcctctatcagttctacggagtgcccatttcccccagcaaggtcatcaggcttcctactaaccaagctttcatcaagaagtactgcgcccccaggcaggcaaagggtgagacaccacagcagcctggggatggccagcagcgggcaacagacgcaccgtcgccacctccagagcctttcagctcatctacaaaggctggagcgttgcctatgacccatggccgaccagcaggcgaccaagtccaaagccaaaggtaa

SEQ ID NO: 51975 - DNA, 476 bp, Glycine max
  Peptide Sequence Number=SeqID_143660
atggccaagtttgatccggatatagttctcaagttttatgccaatgcttggcctacggaggagggcgtgcgggacatgcggtcatgggtaaggggccagtggattccttttgatgtagaagccctcagccagttcttgggatacccgctagtgttgaaggagggccaagagtgcgagtacagtcagagaaggaatcgggccgatggattcgacgaggaggccattgcccagctgccgggagacgggtacagatcatgtatgctgcctaccaggcaccctctagacccagataagtctaacagggccctgggttttccagcattgatctcgggtctctgccagtcgttcggggttcccgtcacacctagtaagaagtattgcacgccaagacaggcgcagggtggcgcaccgcaggccctagacgcaccatcgccacctcatcaggatgatccagctaggtcatttgacacagagcg

SEQ ID NO: 51976 - DNA, 632 bp, Glycine max
  Peptide Sequence Number=SeqID_143661
tggatctagcggcgatcgatgcttttcttgcttatcaccatagcaaggaaagttcggccattgctattttggtcgatgcctatgacacgttcaaccgaagatgcaagaagagcagcgcgaggatcgtttgttgcacacccgctctttatgtatggctagtctctcacatttttcgtcatgaaagtagacccgtctgtcccttacaaggtcaccgcatgtgtgccgagaaagggaaagaaaattgggaacaactcttggtgggtatggtaggggcgttcgttaattggttccccctatggaaggaaggaagggtcggagtattgtcctcatgtgaagggttcctaaatgtccccttgatgggaacgaggggttgtattaattataatcccaaacttgccataagacaactaggctatcatatgagaggggcaccatcggaagagagtatcatgcctttcatagcacgtggcttcaatgaccccaatgcaaaaatgcttcgacgagtccgaaaagcatggaatgtggtgcaaagaaaggataaggagcttagaggaagcatcaacggtgttattggtggatatcataaatggttgaaggctcggatgcaagggataacttggctcccgaactaa

SEQ ID NO: 51977 - DNA, 732 bp, Glycine max
  Peptide Sequence Number=SeqID_143662
atgactgggcctctcgatgagtcgatctcttgctttctcataagggtgaacccttgggtactagtacctatcgcctttagaggactacaagtcctcaccttcagagggctgcacgccctagcctttgtagggctacacgccctcaccttcagagggttgcacgccctcgcctttgtagggctacacaccctcgcctttagaggactacacgtcctcaccttcagagggctagacgccctcgcctttgtagggctacacgccctcacctttagagggttgcacgccctcaccttcagaggactacacgccctcaccttcagaggactacacgccctcaccttcagaggactacattcctcgccttcatcagaggtgccgctcgttccctttgcattcagaggactacacgtccttgccacttcagagaggactgctcgcccttgcctacagatgactacacgtcctcgccatcagaggacagcacgtcctcaccataaaaggactacatgtcctcacctacagcgggctgctcgccctcgccttcagaggactacacgtcctcgccttcagagggttgcacgccctcaactttcagaaaactacgcgtcctcaccttcagaggactacacgtcctcgccttcagagggctgcatgccctcgtcttcagaggactacaggtcctcgccttcagaggactacacgtcctcgccatcagaagactacacgtcctag

SEQ ID NO: 51978 - DNA, 399 bp, Glycine max
  Peptide Sequence Number=SeqID_143663
atgcctcctaaggcatcaggaatctccctaaggggaggacgaagcacaggcaaaggacccagacaggctcttccagagccaaccactaataaatcatcaacctcttctgggtcatcaacccaggctgggtcatccacccagaaaaccaatttagaagggccatcaacccagattacctcaatcaaacctgagtcatccactcaggaacctcccaaatcggcaaccgccaaacaaacatcggtcgactatgcatggacaattgaaacccttcaggcccttcaagacatggatggaacctggattttgggacaaaaatcccttcaaggcgtcggccaaggctttcccatcaggatttcactacaaaccaacgatcatcctgaagacaagaactttttatga

SEQ ID NO: 51979 - DNA, 521 bp, Glycine max
  Peptide Sequence Number=SeqID_143664
gggtcccaggaaccggcgctgagccatgtgacgcccggaatttccttataggcttcctcccagatttcattgagtccgtaccagttgaacagggcaggcacatcgaggctgtagcgcgatgcaaaggggaaataagccccaaacaccgcgacatcgactgccttgttgaaggcgtcgatagacggcttgatgacgtgctctgcaagtgccggacctgcataagtctggagccgccatttgattgggctttgcgccctcacatatggcgttgcaagcgtgcttgcacccagcgcgccaacggttatgtctatcagcgtgacttccttcggcgccaaggctcgcatcatgaagagattgtagccgaagggcggcgtgatatacgcgatctggcaagtgatggtgtagagcacgccgaaccagatggcgttaaagccgaggctcttgaccagcggtatgtaaagcggcgctacgatgaccagcatggccgtatcatcaaggaacatgcccagtatgatgaatga

SEQ ID NO: 51980 - DNA, 195 bp, Glycine max
  Peptide Sequence Number=SeqID_143665
agactaacttcatcatctacacctttgtcatccaaagacgacgagtccgatgacatgccaagataccttatggttatccgcaccttttgtcaaccagaggcaagtgagcccgtttacacgcagagactaacatcgtcatctgcacctttgtcatccagagacggcgaatccgatgacatgcggagacacccaagg

SEQ ID NO: 51981 - DNA, 183 bp, Glycine max
  Peptide Sequence Number=SeqID_143666
atggtaaacaatcctagtgagttcaacatacataggaaggttgaaaaaaaaaaacagtatccagaagaaaaaggtgaaagggaattggaaggaggattggtgccatcccttgaagaatttgagtcaagaagcaaggggccaaccaccttaagagctattggactaagaagcactccaaattga

SEQ ID NO: 51982 - DNA, 360 bp, Glycine max
  Peptide Sequence Number=SeqID_143667
atggcacgcaaatcgaggcaggattttagcgtttcaaagccaagagaaaaattcagaagctctctctctatctcacgcagccttcttctccttttctcccatccaccattgttgcccaacaaagcttcagcctttagtgcccatttctgctccaagtcgcgaaaggagggcattttcggagtcgtgaagcgcgtctctacgtgtgggacttcaaaatttcaggtgagagtttgcttcaaatttacctcattctcaatttcacttctcaaacctagaaaaaccattgaattgaggggtattggacacctagatcctgtgttgctgtgttttgaaggtggactttggtttagacatgattga

SEQ ID NO: 51983 - DNA, 493 bp, Glycine max
  Peptide Sequence Number=SeqID_143668
atgacccttcggtcacttttccagggacccaaaaatccagggctacaagatctgaggccccatccccttcagttcagccctagttcttccaggtccctccactcaaagcttagagcctttcttgtctatgctgcagagcctgaaccagggccaactcctgattatgcagagcttgcaagatgtggtcttgcaacgaccagttatgagcatggaggagtttctgcagaaggttgcctagccaggagtccagccttcttctttgggaggggagagtttctctccgggttccttgttgaaccaattatcagacttatcaaggtaatccttgtggcgtctacccagacttatcttccttcaccggaagtggcgtctaccctgacttatcttccttcatcggaagtggcgtcatccaaaactctacagcctgtatcaagtgatccgctcctactcaggttcatgtcatctggtatcagagctttggctcttgatacag

SEQ ID NO: 51984 - DNA, 840 bp, Glycine max
  Peptide Sequence Number=SeqID_143669
atgagcttagctcctctgggtgctaggcgctcccgtggttcgcgagaaggaaaaagaaggactcatcctttgttgcatctggcacgagatgataaagagagagcttcgtctatcgatgaacagcggattgacggagctcttggcattgctttgtttttctctcctttcctatcagcgagttccgatccttttgttcgaaatttcttcgttcgtaccgaaccgcttgcagaatcaaatcctgttccacaagatcctatatcagctatacatcctccttgcatttatgccggagacgtcgccagtgctatgggatttggattatgtagatcaaaaatgatgaatgggattgtggcactccactcgccgccaatgcggaaggatgccgccgaaaagaagggaacgctgcttcgctctgctggatgcgtcggatcccgtataacaagcgagctttttaccaaaaaattcaaacatgtggtcgcaaaatgctatccagctctcttgttgcgtagcaatagaagcctgctcatgctgctttggcggcgctttttcgccttctcttcgctctggacaggagcgctagtggacacggggggggagcaggcgaagcgtgtcgttcgtaatgaacagaaagataccactacttcgcctctttgttggagcgccggcgcgaacacagtggtatctgaccaggaccagaaacagattcgaatttggatcttgacatgtcggtggtttttaaccgtgggcatcatgccaggaagttggtgggctcatcatgaattaggtcggggtggctggtggtttcgggatcccgtagaaaatgcttcttttatgccttgg

SEQ ID NO: 51985 - DNA, 333 bp, Glycine max
  Peptide Sequence Number=SeqID_143670
atggttgaagcagagagttcgcaaaatttacaaagcacgcaagattctactgattggacaaatgatatatattcaaaagtcaaaggacctgaaaaaagaggacgtgtgcattgtcttggcaagcttccacatcaagcaagttcatctcaaagctcttatacaaacaatagaattcaaaagttggagaatttgcttggaaaccttgtagctgtgcttaaagtacgatttgcagaagatccacaaattaatcaagtcttagaagctatagatcaagaggtacctacaaatgattctaccggtaaagatcatcaaactacaaacaatcttagctag

SEQ ID NO: 51986 - DNA, 157 bp, Glycine max
  Peptide Sequence Number=SeqID_143671
gacgctgggtgtttcggtcttttcctctttgttcatgtggggtgggatattgccagtcgagaacgaccttgaatggcaatctgaagggaagagacaccaaaaatgggttttcctttgccggcagtcacttaccttgccgaaaatttatctggtctga

SEQ ID NO: 51987 - DNA, 270 bp, Glycine max
  Peptide Sequence Number=SeqID_143672
atgaagaacgtcgaagaacggtcgaaaccttcgcgaaattcctcacggaaacgttacggaaacgtttcggaagcacctcggcttggattttcttcacggaaacaatttttccaagcaaattcgaaagagagagaaaaaattgggggagaagcgtgccacccagctcgcccaggcagaaaggttgcttcctccagaagtaacagccttctggaggaatcttctggagggcccaagtggcctggttgctatttgaacccctatttttactaa

SEQ ID NO: 51988 - DNA, 225 bp, Glycine max
  Peptide Sequence Number=SeqID_143673
atgaatatgataaaggcatgtcataggtactccgaagacgtatatgtcatgatgcaagaaaatcaacacattactacctcgcattatgttcgcatgtatgttcgagaaacaggggaatttgaggttcaagaaattgcaaatacgctacttggtcgacgagcaatggcatgcactgtcaaattgaatgaatggtcgtgtgattgtgaacaatttcaagcactttga

SEQ ID NO: 51989 - DNA, 948 bp, Glycine max
  Peptide Sequence Number=SeqID_143674
atggtagaagtctccacaaaggccattgcctccctcgcccagtattatgatcagccattgatatgcttcacctttggggacttccagctatcacccatggtggaagaatttgaagagatcctaggatgtcctctagggggaaggagaccatacctcttctcaagaaagcaagtcgaaaatggggtggttggaataccgagaaaatatttggaggcaaaagcaagaatcttggcaagtaaaggcaaatgggctccattcatagacattttcgtgctattgatcttcggaggagtcctctttccaaatgtggatgggttggtggacctagcagcgatcgacgcttttctcgcctttcatgaccacaaggaaagcctggtgagacatgcttgcccgctagaaagccaccgttcatgcacagagaaaggaggggcaaattgggaccaactcttagcaaacaaagaaggagtgtctgtcaactggttccctcgatggaaagaaggaagaatcgggaggggcacgctagaggaagagctcgcgcctgtcatttcacgaggtttcaataagaccaacagggagacacttcagaaggtccgcaaggcatgggaggtggtgcaaaagaaagataaagaactcaggggcagtaacaatgggcccatcggtggctaccgaaggtggttgaaagcccacgtgcaaggtttggattggctcccgagtttgagaaccgctaaaagagaggaagttgaggcactagaggaagacaaagaggtgcaggcccttagggcagaactcgagcaagcccaaacagtcaaagaaaggttcaaatcaacagctcttaaaatccgaaaggagaatgccgaactaagagatacaaatatagctatcaccaaggccttggaacaagagaccaagagggttcatagggaagagcacggccggaacaagttctga

SEQ ID NO: 51990 - DNA, 300 bp, Glycine max
  Peptide Sequence Number=SeqID_143675
atgcgaaagggttttcctctaagctcagacataatatctgctcggaattgggttgcgaacgtggtgctcaaattttacgacgatccaacaatgaatgagcccgagatcgtcgtttttctaagacagactcaatcttatatgcaatgtggtaccatgtcagttaaaaacctcgtcagatgtctaggagtacgtgacaagacagaccacacattggtaagtcaagtcactctcactagttttaactcgtcgcgcctcaaagtgattaaactcgttgggttcccactgtggatcccattataa

SEQ ID NO: 51991 - DNA, 576 bp, Glycine max
  Peptide Sequence Number=SeqID_143676
atgaaagataagagggatgaggaagaaaaactagaaaaacaaaagaaaaagaaggatagtaaggccttgtcttcaaaggccagggggaaggaaaaagaggaaaaggattcctccaagaagataaggaaaatcatcttgcaacaaaaggtgatatcaaaagagcactccttcataaacaatctttctaccttgtcctatcaagggaagcatccctcaacactgccatacctctttagcttgaggtattctgaggcatcgaatccctatgataggtgtgatcaaggggttcccacgaaccttaagagaataaaggtcattcttgagaggcccactccaccaacaccactcattgagttggtgaggaactatgttccctcatgggaagttgcccaggaaatgggttttcagaccttaccttactccaacataccaaacaccactaatatatatgtttttattctttttacaagtgttgagggaagaatcccagagtttcaagaacctctggatttgaggtcaaatccttttcaagggggagggaatgatgcaatcctaccccccaatggcattggatag

SEQ ID NO: 51992 - DNA, 465 bp, Glycine max
  Peptide Sequence Number=SeqID_143677
atgaaccgtaaaaatgccgcgttgctggcgttttccatagtgctccgcccccctgacgagcatcacgaaaatcgacgctcaagtcagaggtggcgaaaccgacaggactataagataccagtgcgttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 51993 - DNA, 294 bp, Glycine max
  Peptide Sequence Number=SeqID_143678
atggggcggtatttccagcacttggttcgccagcaggcggccaaccacagggggcaggtgcagatccatgagtgtctctaccagctcaacctcagtcagcagagcctggatttcgctccttttgcgtgccgtactccagatcagtttagggctgaggtcgcatggcccagagattggcccgaggaccaaacagaggaggcacctgcaggagctctcgacggtgcagaagacgcccgtatggatgaggagatgatagatttactcgatttcttgggaggatgcggagccacgtga

SEQ ID NO: 51994 - DNA, 740 bp, Glycine max
  Peptide Sequence Number=SeqID_143679
agaggaaagtagagatatatcattctgagctagatgagtttaaggctgaattagagaggcgtaatttccataaacgcctcaccaatttagtcgatgggagcatagacctagccttggtgaaagaattctatgcaaatttatacagttctgaggatcatccaccaaagcagtctagagtcagaggtcatttggtgaagattgatgctaacaatctcaacacattcttggagacacttgtggtattagctgagggggagaccttacccgcttactccagatattgcaggttgcctacagactacagagacatagaggctgccttatgcatacctagccgagggttcatcttgaactcagagggtcatccggggaagattctcaggaaggatctgactacactagctcagtctaacacttctagacttgggttccctgctctaatcaccgcattatgtagagccagaggagttgtctctgatagcctcagttttgagcgcctgagcccggtcattaacttggccttcataaggaagaactgggctaggagggcgagggcaaggccagctgagcttccttctacttctgcagctcctactacagcatccacttcaacagctccttctgtcccagtggtggcacctccaggatctattccttcagtggagcagttcactgagatggtagcctggcccgggacccaaccttctcttcacagggaatatgaaggtcccacagcctaa

SEQ ID NO: 51995 - DNA, 344 bp, Glycine max
  Peptide Sequence Number=SeqID_143680
gtgaaagacctaccgaggtctataaagctccggaaacttttaaaggaaatctggtagaatggattacggagctcacaagcaatgcagaacaccatgatgccattgatgaatcactagtcagcaaggatgctgatggcgagcttttccaatttctaaaggttgtatgcaactgtgtctcaccaacgccaaaggagaggcccaccatgtttgaagtgtatcagcttttaagagctattgggggtagatacaatttcacaactgaggatgagatattggtacctactgatattggtgatactgataaaatggaggaatttattgtagctcgagaaggaagttattga

SEQ ID NO: 51996 - DNA, 219 bp, Glycine max
  Peptide Sequence Number=SeqID_143681
atgcctataggttggacctcccagaagagtggagctgatattgagggggaggaactaacagatttggggtcaaatcctcttcaaggggaaatggatgatgcaatcctccctaggaaggaaccagtcactagagccatgagcaagaggctccaagaggattgggctagagttgctgaagaaggccctagggttctcatgaacctcagggtagatttctga

SEQ ID NO: 51997 - DNA, 316 bp, Glycine max
  Peptide Sequence Number=SeqID_143682
atctttcttgatcggtgctgctgtggttgcgtcctttggttactgcaaagagcgtgatggctcttgggtaaaaaagggtgctcaaccaaatgatgataaaggacaattaccagttgaaggggactcttctctccttcaaagtattttggacaagttcgatggacttcaaacctatgttggtgagaggtttgatgctttggaacgacaagtggacatgcgattcgatgcaatggactcaaggatcacaaaggttgaggaagatgtcaccatcattcgtgactgccttgatttacctctaccaccatcatcagtttag

SEQ ID NO: 51998 - DNA, 253 bp, Glycine max
  Peptide Sequence Number=SeqID_143683
atggaaatttcttcattccatcaatttcctaacgaatccctcagcgaggcgctcgaccgtttccacggattactcaggaagacgcctacacatgggtaccgcgagccggtgcaactaaacatcttcatagatggcctacgaccacaatcaaagcaactactagatgcatctgcaggaggtaggaggatgtcacacatgtggaggaacgcacgagcctgggcaatgtatagtccaagaagatccttccaggaaa

SEQ ID NO: 51999 - DNA, 363 bp, Glycine max
  Peptide Sequence Number=SeqID_143684
atgtcggccttcaccttctcttgcacctcctctgctttacccattactctagctctagcacaggtgaaactggaagtaacaaggatatcaacaatcctaaacgtgtttgacaatagccgaagcaatgatgtaacacaatccatcttttgccccaacttttgcaagatggttacttccatacttcaacttgactcgatgaaccttttcgtaaaagcacgagcttggttcaaccccataacccagggaatggcaattttgatcgccaatacttcatcaacatttcataaggatgaaagactcgggaatacgcatgctatgcatggaaaatgggaatacgcaaggttcacgcatgagcaaacatga

SEQ ID NO: 52000 - DNA, 426 bp, Glycine max
  Peptide Sequence Number=SeqID_143685
atgttggctactggtaatcgattactgccttctgcacatgagtttttgacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 52001 - DNA, 583 bp, Glycine max
  Peptide Sequence Number=SeqID_143686
aagaatcgttagaaaccgctttccagtcttttgaggtggtcagcatttcctccgtggactccctctttgggcaaccttgtctgtccgatgcggcggtaatgatggcccgagttatgttggggaacggttatgaacccgggatgggtttaggcaaagacaatggcggcataactagcctgataaaaacccaaggaaatcgtgggaagtatggtttaggctataagcccactcaggcggacatgaaaagaagcaccgcgggaaggaaggacagtggtcagagctcgcgttggagacaagaaagtgaaggaagcccgccctgccacataagtagaagctttataagtgcgggtctgggagacgaaggtcaagtggtcgcaatatgtgaagatgatgttccaagtactaatacctgggacccgtctatcaacttcgagcaagaaatgaaccaaacggaagatgaaggagatgaggatgtgggatttccttcggaactagaaagaatggtcgcccatgaggaccaagaaatgggcctcatcaagaagaacagagctagtagacttaggattggcagtgaaagagggaa

SEQ ID NO: 52002 - DNA, 485 bp, Glycine max
  Peptide Sequence Number=SeqID_143687
gcacccagagacgaggaagggcgtagtaagcgacgaaatgcttcggggagttgaaataagcgtagatccggggattcccgatataggtcaacctttcgaactgctgctgaatccacgggcaggcaagagacaacctgagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctg

SEQ ID NO: 52003 - DNA, 237 bp, Glycine max
  Peptide Sequence Number=SeqID_143688
atgcgtaaggagaagataccgcatcaggcgccattcgccattcaggctgcgcaactgttgggaagggcgatcggtacgggcctcttcgctaatacgccagcaggcgaaagggggatgtgctgcaaggcgattaagttgggtaacgccagggttttcccagtcacgacgttgtcgactctagaggatccccacattcatggggctccgaaaaagggtgagaatggaggattgccttga

SEQ ID NO: 52004 - DNA, 804 bp, Glycine max
  Peptide Sequence Number=SeqID_143689
atgcccactgggaggaaggaagccatatctgttctctgggttctatccctccacgacaagagttgccaaggaagtgcttggaggaaagggcaaaggccttggaaaatcaaggcaaatgggctttcttttattgacatcttggcgcttttgatctttggagttgtcctctttccgaatatggaagggttagtggacctagcagtgattgacgcttccctcgcctttcatcatggcaaggaaagcccggtcgtcgccattttggccatgtatgacacgttagaccggagatgtgaaaagagcgacgcaagaattgtttgttgtacaccggctctctatgtgtggctggtttcgcaccttttttccaagaaggtaggcccatctatccgctacaaggaaggaagaatcaggattctatcttcatgcgaaggatgtccaaatgttcccttgatgggaacaaggggttgtattaattataatcccgtcctcgccataagacagcttggctaccccatgagaggagtgccatcagacgaaagcatcacgcctttcatcgcacggggttttagtgaccacaacgcgagggatagagagcttaggagaagcagtaatgggatcatcggcggctatcataagtggctgagagtccggacacaaggattggattggctcccaaatctaaagactgtgagagacgatgaggttaaagcttcggaagaaagtgatgaggtacaagccctaaaggcagagcttgaaagagcccgggtagtcaaagagaagttcaagtccatagccatcaaagtctga

SEQ ID NO: 52005 - DNA, 648 bp, Glycine max
  Peptide Sequence Number=SeqID_143690
atggaagagaaaactagctctataaagtgctttaaatgtcttggaagaggacacagtacgtctcaatgcccgaccacaaaaaccatgattatgaggggccctgacatttatagtagccaagatgaggctactacttcaccttcctctagtgaaagggatgaagaaaaatgggaagaatctagtgaagaaatttacccccaagaagaaggacaaccattagtggttaaagagaagtgtaaggaggtaagtgtctcctccaagagtttagctaagaaggaaactcattttacaataaagacaaacattaaagaaattttccctcttagacaacctccacattttctcttttgtaaaaagacacttgttagcactgccacaccttttgggcttgaggttaaatccttgtgctttgttggtgcccaaaatagtgatcaaggggttcccaaggaccctaagagaataaagatcattcttgattggcccactccaccaagtataagggaaatctggggctgccatgacttaacaaacttttacaaaaggtgtcaagggaaggagccagagtatgaagaacctcaggatttgaggtcaaatcctttccaaggtggaagggatgatgcaatcctaccccccaagggtattggatag

SEQ ID NO: 52006 - DNA, 1023 bp, Glycine max
  Peptide Sequence Number=SeqID_143691
atggtcgatctggagcaattacaaaatcaattgagaagcaaacttgccggtaaaaaattcttacttgtcttggatgacgtatggaatgatgaccgtgttaaatgggttgagttgaggaatttaatacaagaaggggttgcaggaagtaaaattctagtgactacacgtattgattccattgcttccatgatgggaactgttacctctcacaagttacaaagactttcttcggagaattcattgtctctttttgtcaaatgggcatttaaagaaggcgaagagcaaaaacatcctcatttggtaaatatcgggaaagaaattgtgaaaaaatgcagagggattccattggctgtgagaacattggggagttcactattttcaaagtttgaggcaaatgagtgggaatgtgtgagagacaatgaaatttggaatttgccacaaaaaaaagatgacattttacctgcacttaagttaagttatgatttcttgccctcctatttgaggcaatgttttgcattattttcgctttacccaaaggattatgaatttcgtagttttgaggtagttaggctttggggtgcacttggtgtccttgcatcacccagaaaaaatgagacactggaagatgttgtcaaacagtatctggatgaattactctcaagatctttccttcaagattttatcgattgtggcactttttatcaatttagaattcatgatttggtgcatgatcttgctgtatttgttacaaaagaggagtgtctacttgtaaattcccacattcaaaatattcctgagaatattcggcatctgtcttttgctgaatacagttgtcttggaaattcattcacctcaaaatcggtagttgtgagaaccataatgtttccaaatggtgcagaaggaggcaacgttgaatctttgctaaatacctgtgtgtcaaagttcaaattattgcgagttttggatttaagttattcgacatgcaagactttgccccgttccattggtaagttgaacacttga

SEQ ID NO: 52007 - DNA, 453 bp, Glycine max
  Peptide Sequence Number=SeqID_143692
atgtgggcctttcataccgggcgtcaacttgactgggcacacttagtcagatatcgcatgcttaaggcattgcgattaaatgctccattgccatatccacaccttgtcactctctttcttcgccattttcaaattcctcttgattctaaaccttatgttccaatcaagagatcctttttaattggtgttgctgtgattgcttcttttggttaccgcaaagagcatgatggctcttgggtcaaaaagggtgctcaacccgctgatgatgaaggcaaccaaccagttgaagataattcctctcttcttcgaaggcttttggacaagtttgatggtcttcatacttttttgggtgacaagtttgatgccatggaattgatcaccaaagttgaagaagatgtctccttcatccgtacttgctttgatccaccaccaccgcctccatcatcctcttag

SEQ ID NO: 52008 - DNA, 306 bp, Glycine max
  Peptide Sequence Number=SeqID_143693
agcacaggaaatcaccattggaagatcacctcagtctcttcaccattggaagatcacctcagtctctttaattccaagcctgcttctgttggaataaagttgctggccctgaagttcttggaaacgtttgtattactcttttcatctgacatcggtgatactgagaaattagccacaaaaggaattaggcaagctgttaatgtcgaatggttggttggtggtcaccctcaccctgttcttgatccagtggtgctcatatcagatgcaaataggactattggcattctattaactttattgctgttg

SEQ ID NO: 52009 - DNA, 399 bp, Glycine max
  Peptide Sequence Number=SeqID_143694
gagccttttggaactcatagcttgagatgcaacactttcccaaaacaagctattggcctgacagatagaggccttgatggagaccctcagcaagctccctcaacaactacaagcggtaaatctctctcactccttgatcatgcaaataaggggatgccacatctgcggtggagcacacgagctaggacaatgcatagccttagaagattcttccagggaggtgaactacatgggagctcagaatcgccacgaattccaaggctacaaccaaggaggaccatcaggattgaaccgagggaggaatttcacatagggatcaagctagaggaatcatctggggaaccagttcaacaaggagcaaagaagtcaacctggccagaattccaaccaagggattga

SEQ ID NO: 52010 - DNA, 384 bp, Glycine max
  Peptide Sequence Number=SeqID_143695
atggcaagagctggtgacaatggtggtgtatatcatcaactggacgaatctcagcgcttatttctggacgcgtggactacacaaatgcaacgtttgttgaaccgtaacaaagaagagccctacagacgaatagccaaatcttcctcgtttactcttaaacctctatcccctagaaaagtgtgtgatgaccaaatcagaatgagagaaaagagagaacaagagaaagaaaatagtgaggcaccacaaaggaatatgaaaaagaagagtgatacacccgaggaaaagagtgatacacaagagagagagagtgataattctaatcagaatttaaagatgtctttcccaaggagattcctcatggactgccaccttcaagaagcatag

SEQ ID NO: 52011 - DNA, 109 bp, Glycine max
  Peptide Sequence Number=SeqID_143696
cgaaggcgcttccgaaacgttccgtaacgtttccgtgaggaattcgcaaagattcaaccgttcttcgacgttcttcattcgttcttcatcgttcttcgatcttcaacgg

SEQ ID NO: 52012 - DNA, 396 bp, Glycine max
  Peptide Sequence Number=SeqID_143697
atgttgctaagtagcaatgtcatctatatctgtgtaagagtggtcatgttggtgcgcatgatccgcactcgtctctttgcaacggcatgggtgaaatcttgccccggtatgcatagtagctatgtgatagcctccatttctggttgtattcgcacagttggccctcctccaatatcagggggtggcccaggaaccgttaaaaggaaactactggtgtggatacggagcccactgaaagtgaggacgcatagccctctaaaggcgagggcgtgtagccttctgaagttcaggacgtgtcgccttttgaaggtgagggagtgtagtcctatgatggcgaggacatccaatcctctaaaggtgagggcatgtccccctttgaaaatgggggacatgtag

SEQ ID NO: 52013 - DNA, 294 bp, Glycine max
  Peptide Sequence Number=SeqID_143698
atgcctataggttggacctccaagaagagtggagctgatattgaggcggaggaactaacagatttgaggtcaaatcctcttcaagggggaggggatgatgcaatcctccctaggaagggaccagtcactagagccatgagcaagaggctccaagaggattgggctagagctgctgaagaaggccctagggttctcatgaaccttagggtagatttcttcatgctttacatgtttcatgacacctatgcacacttagtggagaatcttggacttgatcttggattagtgggctga

SEQ ID NO: 52014 - DNA, 480 bp, Glycine max
  Peptide Sequence Number=SeqID_143699
ctagaactacctaggtctgagttccttatcacaaatggaggatatgcaggagcaaaagccccgcttttgtcgaccaccccaccttttgctttcatgacctgtgagtctggtgtcatgcgaagacacccaatggttatctgcccacatattgttgctattcagggaccccaagttcgattgacaagcggagaccaaatgtggtcatcagcaccctttccggagatgtcaacatcttccggtcaggtggcaggcggacatacccaagtgattgtccgtacaagcacaacatctgttgatcttgacccacgagttggctggcaagcggacatacccaaatatacccaagtgattatccctacaaagacaacatctgttgatcttgacccaagcgtcagatatacccaagtgattatccctacaaagacaacatctgttgatcttgatccatgcgtcaggtggcaggcggatatacctaagtga

SEQ ID NO: 52015 - DNA, 300 bp, Glycine max
  Peptide Sequence Number=SeqID_143700
atggcacgcagcgtgtttactccgtgcccctattttagggacctacatgggaggaaactaaaagggattttagtgataattcccaaggtgggcctacatggtaaggaaagcacattgattgattggtctaactctctaacaaaagtccccagtggagtcgccaactgtcgtaacctacctttcggcaggagggcgacgagaggctcatgggtgcgtcttccaagaaaggaaaatgcgtggagtcaccaccaacgtttattcgaggaaaatgtcggaaaaaccggaaaagacgtggtctag

SEQ ID NO: 52016 - DNA, 456 bp, Glycine max
  Peptide Sequence Number=SeqID_143701
atggctgcatgccctcaccttcagaggactacacgtcctcaccatcagagggctgcacgccctcacctccagaggactacatgtcctcgccttgagagggctacacgccctcaccttggtgagaggactacacgtcctcgccatcagagggctgcatgccctcaccttcagaggactacacgtcctcaccttcagaggactacacgtcctcaccatcagagggctgcacgccctcacctccagaggactacatgtcctcgccttgagagggctacacgccctcaccttgggtactacttaccctcaccgttgagaggactacacgtcctcgccttgagaggactacacgtcctcaccatcagagggctgcacgccctcacctctagaggactacatgtcctcgccttgagagggctacacgccctcaccttgggtactagttaccctcaccgttga

SEQ ID NO: 52017 - DNA, 65 bp, Glycine max
  Peptide Sequence Number=SeqID_143702
atataaaaactggaggtgtaacaagcaaaaaggccagaaaaattgaagaaaagaagaaaatctga

SEQ ID NO: 52018 - DNA, 378 bp, Glycine max
  Peptide Sequence Number=SeqID_143703
atgatattgctggataatcaagacatagagagtgagagctcaagacatgatgaaatgccaccattggaggattgcagtgatgttgatgtcgttgaacctataaatggagatgtgcttgttactagcaccttgttggttgagaaattgggtttgcccacattaaagcaccctaatccatatagacttcagtggcagaatgattgtggagacataagggtgaccaagcaagtgttggtttctttttccattggtaatgatgcaatcctccttaggaagggaccaatcactagagccatgagcaagaggctccaagaggattgggctagagctcctgaagaaggcccaagggttttcatgaacctcagggtagatttctga

SEQ ID NO: 52019 - DNA, 195 bp, Glycine max
  Peptide Sequence Number=SeqID_143704
atgggtggtggtgggtggccgttcttagttggtgggggcgatttgtctggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgtgtga

SEQ ID NO: 52020 - DNA, 654 bp, Glycine max
  Peptide Sequence Number=SeqID_143705
atgggaacaaatcaaaccggtaagaggttctaccaagtcaaggttaaaagcctagataccaccagcatcaaggaattagggcggttgatggaacctctccaaatgcaagccttccgcaagacttacggaaagatcttagagttgaccatagcagaggtgtccatagaagccattgcatcactcacccaatactacgaccagcctttgaggtgcttcacattcggagacttccaattagtaccaaccattgaagaatttgaggaaattctaggatgtcctctcgggggaagaaaaccatatctttcctccgggtgtctcccctctttgagcagaattgcaactgtggtcaaggattcagcaagaggtttggaccgcataaaacagactcggaacggcatagcgggcctaccacgggggtacctagaagacaaggcgaggggtatggccaatcaaggagattgggtcccatttatggatgtgttagctttgctaatctttggggccgtcctctttccaaacgtggatggtttggtggacctagccgcaatcgacgcttccttgcataccaccatagcaaggagagcccggtgcaagacacgaggcatccatgtccgctccaaagccatcgctcgtgtgctgaaaagaggagaatag

SEQ ID NO: 52021 - DNA, 210 bp, Glycine max
  Peptide Sequence Number=SeqID_143706
atgccactgcattgtatgtcatcccgacaagggtcggagttgggggcatattttggtgccaaggctacaatgccagcgccattgcacaaagagaagggagaagatgaggtgcacattatgcgggtttggaagaggaagaagaagaagggtaaaaaggggatattgaaaaattcggggtgcaccaagcaaaaaatggagggcgttaagtaa

SEQ ID NO: 52022 - DNA, 444 bp, Glycine max
  Peptide Sequence Number=SeqID_143707
atgaaaatatatagcacacttttgtttttggcagaattttcacttgcagaagaacaaggtttggaaaatagaaaacttagaaagcttcttggcaaaggaagaagaagaaagatgagtagcaaaggtttcaagatttcacaaaagttgtttaagaagatcaaaaagttgtttgaatgcaagtcaaggtcttggttttatagactcttcatgtctggtcaagaaaaccattggaagagttataaccttgagaaaatcttgagaaaaccattggaagagttacatctcttgaccttttattcaaaacttgtcactgttaaaagctttttgaaatcaaattctatcactggtaatcgattacaggaaactggtaatcgattaccagagagtatgatggaagcttgcttgtggagcttctatggaggctggatctttgagcttcaatga

SEQ ID NO: 52023 - DNA, 189 bp, Glycine max
  Peptide Sequence Number=SeqID_143708
atgatggctcttgggtcaaaaagggtgctcaacccgctactttttgttggtgacaagtttgatgccatggaattgcaagtcgacatgcggttcgatgccatggaatcaaggatcaccaaagttgaagaagatgtctccttcatccgtacttgctttgatccaccaccaccgcctccatcatcctcttag

SEQ ID NO: 52024 - DNA, 297 bp, Glycine max
  Peptide Sequence Number=SeqID_143709
atggctccacatctgcgccttcagagaactcaagttcctgggccaccgcctgatattggaggagggccaaatgtgcgagcacaatcagaggaggaggctatcacgcagctactctacatatcgggacaagatttcgcccgggcagttgcaaagagacgagtacgaatcatgcgcaccaacatgaccactcttacacagatatggatgatgttgctacttagcaacattctgcccagcgaccacaatgtcgatcttcccctgtggaagtatcagttggtctgtgccgtcactacatag

SEQ ID NO: 52025 - DNA, 465 bp, Glycine max
  Peptide Sequence Number=SeqID_143710
atgctaaacatccaaaatctcatttatggttatgagaaaatttcatcagcatactctccttccccggtggacgcattgtttttcactcaaaaaaaggcatatgctgctctaatcagttggaatatttgtctctttgctaaagcatgtttgcattttagtggagaaaacaccgagactttttcaagtctcacaagttatccagaactacgtaggtctgagttcctcattggaggatacgtaggagcaagagccttgcttttgtcgaccacaccaccttttgctgtaatgacccaagagctggtaacccgcggagacaccttacggttatccgcacctcgtcattcagtgaccccaagtgtgattgatgagcagaggccaatgtggtcatctgcgccctttccggagatgtcagcatcttccggtggagactttttcaagtctcacaagttatctacaactacgtag

SEQ ID NO: 52026 - DNA, 462 bp, Glycine max
  Peptide Sequence Number=SeqID_143711
atgagagggtacatctcttgtgaatcagttctagtggagggtacatccacttggtttttcaaagagaacaagggaagggacatcccttgcggatctttggcttgtaaaggattgtacaaggttgaaagaaatctcaagaaccgcaggtatcttgtagaaagtttcacaacttctagattcatggcctcctcaaattctctgtttccagaaggaaactccatccctaggccactcatctttaatggtgagggttatcactattggaaaaccccaatgcaaatctttattgaagccgtagatttaaacatttgggaagcaatagaaataagaccttacatacccaccatagtagatgtaagcactagcacccaacacaaaaacctagagataagtggactgatgaggataaaagaagaatcccatataatcttaaagccaaaaacattatcacttctgccctag

SEQ ID NO: 52027 - DNA, 345 bp, Glycine max
  Peptide Sequence Number=SeqID_143712
atgatgcaggacattaacgctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 52028 - DNA, 201 bp, Glycine max
  Peptide Sequence Number=SeqID_143713
atggtcattctgcacacttttccgccatccagaggcgatcgtgtccggtgtcacgcagagacaaattatggtcattctggggctcgccgcccaggctcgatcgtgtccaacaaaacgcagagacaaattatggtcattctgcgtcttgtatcatccaagaggaacaaactcgacagtaccaggatgatgtgtcggtactga

SEQ ID NO: 52029 - DNA, 135 bp, Glycine max
  Peptide Sequence Number=SeqID_143714
atggctgatgaacaccagcaaagggttacccttgaggactactcaagcagttcagtgccgcaattctttaccagcattgcacgtcctgaagaaaagccaagaggtggctccactcatttaagggtaacagtttga

SEQ ID NO: 52030 - DNA, 477 bp, Glycine max
  Peptide Sequence Number=SeqID_143715
atggggatacaaaagaattctcaggcggttaaacctttgaacgcttttgtattagggaatgggaagaatcaaaaagaattctcagactgtgtcgtgttgaattctttgacaagggagaagggagacacaaaagaattcaggcggttagtcctttgttcttttggaaaagggagaagagagacacaaaaagaattcaggcggttagtccttggcgaattctttttggcaaagggagaagagaatgaaaagatgaatagcacaagttttcaaggtttagaaaaccagaaaacttcagaaagcttttggtacaaagaagaagaagaagttcaaagagattcaaggcttgtaaaggattgtatgaataatttttcaagattgttgttagaaagattgattgaaaattcaaaacaaagccttgcttttatagactcttcatgtctggtcaagaaggccattcagaagagttataacttttag

SEQ ID NO: 52031 - DNA, 126 bp, Glycine max
  Peptide Sequence Number=SeqID_143716
atggttaaggaggagtgtaaggaggtaaatgtctcctccaagagtgatcaaggggttcccatgaaccctaagagaataaaggtgttgaggaaaacagcccagagtttcaagaaccttaggatttga

SEQ ID NO: 52032 - DNA, 671 bp, Glycine max
  Peptide Sequence Number=SeqID_143717
ggaaaggaatagcactgaaagtcaactccttaagggaagaatatcagggcagttccagtagtgaggaagatgctaaaaacttcagtttaatggacaaaaaattctccaaatcctacaagaaggttgacgacaacaacaacaacaacaacacatattttgaatgtggtaagcaaggccacattaaatctgagtgtcctatctaccttagaaaacatggtggtgaaaagaaaaggaagaagggcaacaaacaaaagaaagcctacatagcgtgggaagatagttcatcaaaagcttccaactcttcaagtgatgatgaaattgctgatgtgttcttaatggaaaaatccaaaaatgatccgtcaacaagtgaagaaattgaggtgaactctaattttggagaacttttagaagcacttgatgagatgcaagaggaagctcaaaggcttgttgtgttaaacaaaaagctgaaaagtgaactgaaattgcatatgtgcctaaaagcaagagactcactatggtacttggatagtagcttctctaggaacatgatgggtgacaagtccaaactctctgacttcatgtcaaaggatggtggatacatcacatttggagacaataacaatggaaatataatgggagaaggaaatatagggaatcaacacaaaacttag

SEQ ID NO: 52033 - DNA, 297 bp, Glycine max
  Peptide Sequence Number=SeqID_143718
atgctttcagcaactccagtattttcgggcaggatgtcctggacattgtatccgacatcgtggatcctgcaacttcaatgctttcagcaactccagtattttcgggcaggatgtcctggacattcttcttctagactcatcttctccttgaagtggcgtctcctctcaactattcttcttctccattccgctgccattaaaattcaagaagcaaaggacttcattgatgaagaagatcagaggcctacaagctccaatggagctacatcatgtggtatcaagagcatcttcatctag

SEQ ID NO: 52034 - DNA, 480 bp, Glycine max
  Peptide Sequence Number=SeqID_143719
atggaggagacacatgaaattccccaccacgatctagccaacttcgagccttgcctcggatatgctgctgaagggcaagcagttggtggtatacccctgcaaaacactttggagggccctcagtatcacccacaactacacctcttgcattccacgacaagtaaaaaccctcatgctatggcagaaatgggaaagttggatcatctagaggaaaggctcagggccattgaaggaggtgaagattatgcctttgctaacctaaaagagttgttcctagaacccaatatcatcacccctcccaagttcaaggtgctggaccttgacaagatgcaactacagaacatgtgcaaaaagggggacggatctttcaaagaacacacccaaaaggtggagggatctggcggcccaggtggtacccccaatgatggaaagggagacgataatcgtgatggtagacacattatcgatactctactatga

SEQ ID NO: 52035 - DNA, 318 bp, Glycine max
  Peptide Sequence Number=SeqID_143720
atggaaatttatgtgagtgatcgactaggaaaaagtgttttttctaaaggttataactcttctattggtctcttgactagacttgaagagtctataaaaagggtacatctacttgggtttttgactgagaacaagagagggtacatctcttgtggatcagttctagtggagggtacatccactaggttgttcaaagagaacaagggagggtacatcccttgtggatctttgcttgttaaaggattttaccaggttgaacagaaatctcaaggaccgcaggtcgcttggggactggatgtacgcccgggttgttgctga

SEQ ID NO: 52036 - DNA, 273 bp, Glycine max
  Peptide Sequence Number=SeqID_143721
atgttagtctttgcgtgctatcaggcttttcgtcttacagacagcaaaaagaatgcttatacggataaccactcgggtatttccgcccgtcagagtgagtcaaatacagcaaaaaagaaagtttatacggataaccactcgggtatttccgcccgtcagcgtgactcaaatgtgagtatgacagatcttgtgatcgtggaagatgacgtaaatctccgcgtgtcaacgggcttgtcggccgcgattgacgaagggcgcagaatacgacattag

SEQ ID NO: 52037 - DNA, 345 bp, Glycine max
  Peptide Sequence Number=SeqID_143722
atgattggtacctcaaagccttacactggggcaatgaggggcaccgtgcatgagcctcaagcgaacctagaggcagatcaaaaatttcctacatctaatgtccaatcttttgaatttgggatgatcggccctctcgatgagtcgatctcttgctttctcataagggtggacccttgggtactagtacctatcacctttagaggactacatgtcctcgccatcagaagactacacgtcctcgccatcagagggttgcacgccctcaccttcagaggatttacacgtcctcaccttcaaagggctacacgccctcaccttcagagggctgcacgtcctcaccattag

SEQ ID NO: 52038 - DNA, 279 bp, Glycine max
  Peptide Sequence Number=SeqID_143723
atggggaagaggaaactacaaatggccatagaagaccagcaaatcagtttcgatatgtttcatgaagagaaaactttgcctgacaaaaatatctatttgaaggtgattgtgatggaggaaaagagacaaaaaaagaactggatgttggaaccttgttggacccaggatcacaagatgatgcgtcaagctaatgacgttaaaagagcgcttactgggaggcaacccatgttttctttcccttttctctttttcattttgtatctcttgcatcttgtttag

SEQ ID NO: 52039 - DNA, 658 bp, Glycine max
  misc_feature (26)..(26): n is a, c, g, or t
  misc_feature (131)..(131): n is a, c, g, or t
  Peptide Sequence Number=SeqID_143724
cgccacgcttcccgaagggagaaagncggacaggtatccggtaagcggcagggtcggaacaggagagcgcacgagggagcttccagggggaaacgcctgcctatggaaaaacgccagcaacgcggcctttntacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccccattatccgccactgtcaattcggaccacgcgaagttgcttgaagtaagatacaaagggtggcattacccaagtgcagaatggaatacatgggtccaacaaatgcaacacaagtatgaatgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 52040 - DNA, 321 bp, Glycine max
  Peptide Sequence Number=SeqID_143725
atgagcgagtcaagggggactggggtacagtgctttcagtgtggaggaccgcatcttaggaggaattgcccacagctccagcagacacaggagaatcgttgttatgtttgtggcaaggtaggccattatgctcgagaatgtagggtgactcggagaccgacggtaactgccaattccaacaccgtcaatcatggacctactaattccacaaggagcggtaatgttagcaacaataaccctagtggtggaagaccaaaggtaccctcccgggtatttgctatgagtggatcagaagctgctgcctccgacgatttgatatag

SEQ ID NO: 52041 - DNA, 372 bp, Glycine max
  Peptide Sequence Number=SeqID_143726
gaatacgtgcgtgaagcgcaggggcgcgacgtgcgctgtttggtggtcggcggccgggtggtggccgccatcgaacggcaggccaagcccggcgagtttcgctccaacctgcaccgcggcggcaccgcccgcaaggtgaccatcaccgccagggagcgggcgatcgcggtgaaagcggccagtacgctggggctggacgtcgccggggtggatatcctgcgcgccgagcgcggcccgctggtgatggaggtcaacgcgtcgccggggctggaaggggtggaaaccaccaccgggctggacatcgccggcatgatgatcgaatacattgagcagcgcggccggccgggctttcgcctgaaatccggcggttga

SEQ ID NO: 52042 - DNA, 552 bp, Glycine max
  Peptide Sequence Number=SeqID_143727
atgggtgaccaagaggagacacaggaacaaatgaaagccgacatgttagctttgaaagaacaaatggcttctatgatggaggccatgctaggaatgaggcaactcatggagaaaaacgtggccaccgctaccactgtcagttcggctgccgaagtactccaagctactgtgcaccatttgggatacaacccggtggcttacccttatggattgccgcctaattacacgccgccagtcatgcaagatgatgcgggtcatatctcttctcccatccttgaaggggagcctcctcgacagcctgacgaggtccacgaagatcatcaagagtatgcccaaagggatgtcgacttctaccccccgatcctcgtcgaggggccggaacccaacactttgcctctacccaacctcacagcacagccaataatcttgtccacagaaggaccacccccggcgaccgaagaaagaaggaaactcgatctcctcgaggagagattgagagctgttaaaggctttggtgactatccattcgcggacatgacggatctttgcttg

SEQ ID NO: 52043 - DNA, 1186 bp, Glycine max
  Peptide Sequence Number=SeqID_143728
tgttgctcgcgctaagcaccgcccttgtgggctaagcgctattcgttgtggcatgcatagggctaagctagcactgctcgctaagccattgaaaaggaaaagcactgcttctagacctcaagctcagtatgataccaggcgattccattcttttgacgcttggaatagatacatcgataacattctcgaccggaatatccttctagagagaaatgtgcagatttatcatactgagtttgacgagtttaaagtggaattggagaggcgtaatctacacaaatgccttgccaatctccatgatggaagcatagatgtagctatggtgaaggagttttatgctaatttatacaccataaaggagcaagcacccaagcaagccagtgtacgaggacacctgatcaaagaagcccagacatggagtgtcttctcttactccaacctagctcccacatcccacacctcaaatctgaatatggatagagctaggttggtctatggcttggtgactaatatggacatgattatcggagtccttatctcaggtcagatttcttctattgctcagagtaactcctctaggctcagatttccagccttgatcactgcactatgcagagctagaggagttacctctgacagtctgacttgtgagaggctaagcccggccattaacttggcctacattaagaaaaactgttggaatgtggatgatctaatagttaacttcagaggggagaggaaggcaagggtgagaccagctgaagtttgttcttcttctactctactagctccttccacttttgctactcctacaccagctcctcgaggctcatctactcaagactctcagcgctttgaagccatgcttcagactcctccaaggtccattctgtcggtagagcagttcattgagaaggtatcctggcctggaaccttgccttctgttgtgagagaaggtgagggtcccagtgctcaggtacctcagcagatttcaccagatccaccttttccagtggtggatcaatcttctcttcggcagccagcagaccctcctacaccagcagacgcatctacaccattacttgatcttctagaggactatgccacaccagtcctgggactgactaccactcctccaaccactcctatgctacatttgacagatgagaagggcactcaggattag

SEQ ID NO: 52044 - DNA, 383 bp, Glycine max
  Peptide Sequence Number=SeqID_143729
ttcaagtggagggtacatccacttggttattcagagagaacaagggagggcacatcccttatggatctttggcttgtaaaggattttacaaggttgaaagaaatctcaagaaccgcaggttgcttggggactggatgtataggtcattccaagatcatgatgaagaccaagccaacttgtgtctcatgacaaaatctcatgaaaacaacaaagaagaatctgtaaggaagaagtggtacatcaacagtggatgttccaagcatatgaagagagatgtatccaagtttacaaccatttctcccaagaaaagtggacatgctatatacagcgacaacaatatcagtaaaatctcaaaagatgtaacatctaagccatctctatga

SEQ ID NO: 52045 - DNA, 681 bp, Glycine max
  Peptide Sequence Number=SeqID_143730
atggccccgaggaaacttgcctcaaagagatccaggaaggataaagcggtcgaaggaactagttttgctcctgagtatgacaatcaccgctttaggagcgttgaacaccagcagctctttgaggccatcaagggatggtcattcctccgggagcgacgcgtccagctcagggacgacgagtataccgatttccaggaggagatagttcgccggtggtgggcatcactggttacccccatggccatgtttgatccagacatactcctcgaattttatgccaatgcttggcctacggaggaaggcgtgcgagatatgaggtcttgggtaaggggtcagtggatcccgtttgatgcagatgctatcggccagctcctgggatatcctttagtgctggaagagggtcaagagtgcgagtatggccagaggaggaaccggtccgatgggttcgatgaggaggtcatcgcccagttgctatgtataccggggcaggattttgcccggactgttgccgagagacgggtgcggatcatgcgcaccaacatgaccaccctgactcagatcgggatgactttgctgctcagcaacatccagcccaacgaccataattccgacctccccctgccgaagtgtcagctggtgtacgccatcctgacgcggatgagcattcacatggctcagtaa

SEQ ID NO: 52046 - DNA, 186 bp, Glycine max
  Peptide Sequence Number=SeqID_143731
atggaagaagatctcaagaagactctcaaattcttagatgctacaaatgaaaccaacttggtcacatcaaagcaaatagtccctcaaatgaggaatggcccgagaagtgtgataagaaaaaagaaggaaatcaaccttctaaccaaggactatgagagtgatgagaacatctctcaagaagattaa

SEQ ID NO: 52047 - DNA, 462 bp, Glycine max
  Peptide Sequence Number=SeqID_143732
atggggaagaacaagggtcgtcaatcgcactcaactgcaaagcaaattatggtgaagggtactacctcaggttcaggcaaggtgctcgtaaaaaaggcagggacaaattctacaaaaattgatgatgtcacacaccaagtgtttgataatttgccagaatgtagtgctaaatctgaatcttcctcagaggtttcttgcaccttaggggacaatgattcaaccactgatgatgattcatctcactcctgtggctctaagtcatcaccgcagctagacgacaataaggctcccactccttgggtcaatctgttcaaagataacagaaacccttccaaaggttttggaatgaaattctcccctctaccctctgatgatgaagtgctgttgaaagaaactgatttgcaacccctggaagaggcttgggacatagccttattggctatgtggctagccgattcctag

SEQ ID NO: 52048 - DNA, 731 bp, Glycine max
  Peptide Sequence Number=SeqID_143733
aaacttcatcctccgcactttcagatgaagatctaaatttaatccaacaagatgaccaattatcatcaacggatgatgatgataggcaaatcaatactctaacgagagaacaagaccttttgtttgaagcaatcaattccatacctgacccccaggaaaagaaggtttttctgaaaaaacttaagaaaatattagaggtaaaacctaggcaaaaggatttcattacaaacaacaagtttgatgtaagtaacatactcaagagattagaaaattcttcaaccaagccaacgactatccaagatctccaaatagagataaacagtctaaaaagagaagtaaaagaacttcgtcaacaacaagaaattcatcagatcattctttctcagcttgaggaagatagtgatcctgaaagtgccaacaacagtgaggaaaaccaaccagataatttagaagatgatatgtttatgggattaatcaacaagattaaaatccaaaaattttacataaacataaaaataattattaacgatttcgttttagaaacaatggccctatttgacacaggggctgattcaaactgcattttagaaggattaattcctacaaaattctttgagaaaacctcagaaaaattaagtacgtcaaacggctcaaaattaaaaattaatttcaagctatcaaatgcaatcattgaaaaccaaggtcttaggattaacacaaactttcttctg

SEQ ID NO: 52049 - DNA, 114 bp, Glycine max
  Peptide Sequence Number=SeqID_143734
atgatggccatcatcagcaagtacaaagaagaattggatttggccacggcccacgagcacaaggtggcagatgagtacacccaagtgtacgcagaaaaagaggaaaggggaagg

SEQ ID NO: 52050 - DNA, 360 bp, Glycine max
  Peptide Sequence Number=SeqID_143735
atgtcagatttatccattttatttagcattgtatatgtggtttataaacttgaaaatcctgatgagtcattagagacatctaacaacaactttcaaaattgccccatgtgtggtgtcgcttgtcaatgtcgggactcatacgcgattctcctcaaatttcagccagcccgcatcaattggactttgcaccttatgcttcagggtcatacagtgctcaatggaatgccccagggctcctccatgatatgcacatgttgcgttcaagtcgtatcctcggaaaatggaggtggaggaaacctagcagaggttatggctaccattgaattatcgagtagatatgagagcaagtttagcatatga

SEQ ID NO: 52051 - DNA, 366 bp, Glycine max
  Peptide Sequence Number=SeqID_143736
atggggacaaatcaaaacggaaaaagattctatcaagtcaagattaagggcctagatgtcaccaaccttaaggagttgggatggttgatgggacccctccaaaggcaagccttccgcaaagtgtacggaaagattttagatttgaccacagtggaggtatttacggaagccgttgtatccctcgcccaatactatgaccagccattgagatgcttcacgttcggggacttccaaatagtaccgactgaagaagaatttgaggagattttaggatgccctcttgggggaagaaaaccgtatcttttctccaggtttctttcctccttgagcaagattgcagcagtggctgaagatttggcgagatag

SEQ ID NO: 52052 - DNA, 640 bp, Glycine max
  Peptide Sequence Number=SeqID_143737
gccttttttggcaccaagagtcccacgacccgaaacgacttttccactagctaaaagatggagtggtggtagattagaatatagggccacaccttatggtgacttggtcggatataggtctcgtatagatcatatggagagccatgagtttggactacaagaagatatccctgttgatcccatgaatcttgatctacttcaccaaattgacatgcgagacaatcattacattgattggatggagtaccatgcggggaaaaacactactttgttcttgtatgttgtacaacaactacatgatccatgcacaacaattacccataatgttgcagggccaggtgttgaacaaacacattttgaaatttcacatcctcagtcaatgtattctactccttcacctgttcatcaaacttttggccacactggcgagtcagtcaccgcaaccacccatgaatggatgaccgatttatttggcgtcgatttcaatacaccaaatttagcggcatcatatttatctactttacaacagttcgatgcaccacattcgtttggagaacatggtcaaagttcttcagctgcaacaaccaacattgcaaatactaacatagaacaacaacatcatcatgacatgggagaaccg

SEQ ID NO: 52053 - DNA, 240 bp, Glycine max
  Peptide Sequence Number=SeqID_143738
atggcagagccatcaaagaagagaaagggatcatcctccaccgctaccgctgctgcccatcgccgtcacggcccatccggagcacccacaacacctattcctccttctttgtcttctccaagatcatcaacactgttttcatccgatgatcaacgtctacgatcgactaggcctatttggttcggtaccgaatgcctaaggccttacgggccaatgcacctcttccttatccacatttga
